United States Patent 12,576,115 (BACTERIAL COMPOSITIONS FOR TREATING AND PREVENTING HALITOSIS) - sequence listing, part 31

SEQ ID NO: 55 - DNA, 2543988 bp, unidentified (residues 1-1,271,994 of 2,543,988)
  source 1..2543988: mol_type = genomic DNA; note = Levilactobacillus brevis
tgtaaataaaattatttaggggcacaatgagtaattgcagttgttggtttactacagttaaaagaaatcaaagctgttaatcttaccgggccgtagcttcccactagtgtgcctgtgtgctatgatgaataggtatgacaaagcggttaaaaactagtttaagagagaatggatggaagtcgtatgaagaaatatcgtagctatcgattaagcctcggctggcagattctaattggtctggctttagggattgtcttgggggccgtattttatcaaaataagttagccattacggccatgcagaatatcggcaatatgttcattgggttaattcaaatgattgttttgccgattgtggtttcttgtttgaccgttggtattgcaaacatgggtgacattaagcagttgggacgcgttggtggtaaaacgatcatttactttgaaattatgaccaccattgcgattgccctggggctgctgattggaaatattttccaccccggcgactttatcaacattcaccaattacatagcacagatattagccaatacgtctcctcggcgaaatctgctagcaatacaggaatttggtccactttgatgggcattattccgactaatatttttaaatcattatctgaaggggacatgatgcccgttatcttcttctctgttttcttcggtttgggaactgcggcgatcgggaagcaaggacgaattatcgttgactttctcgatgccgtatcacaggttatgtttcgggtcactaattgggtcatgcatacagctcccatcggagtatgcgccctgatcggggtcaccattgcacaaatgggtttgtcggccttggcaccactggggtacttcattatcttagcctatgggacaatgctgttattcatcgttgtctttatgggaatcgctgcccgaatgtttggcttcaaattaagtgacttgctttatgtgatcaaagatgaggcggtcttagccttttcgacagctagttctgaagcagcattaccacgattaatcgataaaatggataagtttggggttagtcaagggattgtatcctttgttattcccacgggatatacgtttaacctggacggttcggccatttatcagtcattggccgcgttgttcttagcgcaggcttaccacatccatttgagcttaggtcaacagatcaccttactggtggtgctgatgatcacgagtaaaggaatggctggtgtaccaggtgcctcgtttgtggtgttactggcaacagtctcaacgattggagtcccaatgagtgggttgacctttatcgcggggattgaccggctggtcgatatgggacggacagccgtgaacgtggttggtaattccttggcaacggtgattattgggaaatcagagcacgaatttagtgaagagaagagtcaaagctatctccgcgagttgcgagcagcgaaggtaaaataaaaagagccgccattttaaccaatggcggctctttttgagttcaaacgtgttttaaataccagctcatcaatgttcagctgctagtcttgcggggtgattcccatcagcccatgggagctagcggcgttgcagtgataaccgtattggtttggtattaggattcgtatcgatcaactttgagtaaaagccaactcgttgaaacggcgtcagttacgttatgtgttcctccctgttgggttcccccagtagtgaagcgaacgtgaacgactagcacgtcaatgcatagcggtcgtcagttgccgagaaagaccagtaactctagcttgcgttatccatcgagtggggcgaatccagctggcgcacaaacgagtacgagaaatccagatgcgttgcggtcggttgcaacgccgacagcatctgaagtaaagtggccagccgattcagtttaatcgtggttaatcgaaccaccgcatcaagctacggtgtccggatacgggaaagctagagtcgctctcctcaaagcgtcaaccaagagggatgaacggacaataactttcccaccagcgagttataacacgctccaggatcatctataagttgcgttgtcatgttcaatcacctcctaaattgggtcaacagtgacaactgtggataaataaaaagcacttagccacaaccagctaagcgcaccaaaaaaattgtaaacgtgtctagctagtcgttgagttttagcactatacggcgtagttaatcacttaacagctacgttagatcaggccttcgattgacctgaacagctgactcattggcgtttctcgacgtttctgagcagtagcattttccgcataggagcctcacctaacagcttctatttatcctatgtgttaatactaaccgattttcagaaagagtgcaagaaaaaagtatcggttacagaaaataattattataataagccaaccccaacgtttatccgttgatggtaaaagaattattgctcctagtttagaatcattcttgatttaattgagataaaagattaccctaagagtgtgcttaattttactaaatgagaggagacatgatgatgaattatattggttcagtgttacccgattttcaagtcaatgcgtttcaaaatggtgaggttaactcactgacgcggtcagatttgatggggcattggtcgattctcttcttctacccggctgacttttcttttgtttgtccgaccgagttgggtgatttggctgatcattatgatgcgtttcaacaggctgacacagaaatttacagtatttctgaagatactgagttcgtgcatcaagcgtggcatgaacagagtgccgaggttggtaaagtgacgtacccaatgatagccgaccctgcgggggttttggcgcggcactatgacgttttgaatgagcaactaggtcaggcgtaccggggcgtcttcatccttgatccacaaggcactgtccggtcgtatacggttaatgatatggggatcggccgtaatgctggtgaaattttgcggacattgcaggctgcccaatttgtggccgaacatggagaccgggtatgcccagcgaactggcatgctggtgagcagactttgaaaccgggaactgatttggttggtaagatttaacatttcccgggttaagctagtcaccattagttcaaacttaaaaaatcggtcaatccagtagttcatactgagttgaccgattttttcatgaggtgctagatgtttttagagaaggattacttaccttcatcgatagcagcgtattgttgttgataccagctgtcccaagaattatccttcaaggagccgttggtgttgtatggcaaattgatcgtttgaagaatcgccaagaataaatcccgtttattagttaacacgtcagttgccagttgttggggttggaaatactggttggcatacaagtacatgttgatgtcgttcatggcgtagtctaccttatactgggcgatgatttccaaatcatttgtccggtagtggcgtaaataaaagtgggcgaagtcagttagtgcagtttgttgtgctggttcgtccaagtcagtaatggttaactctgtgtcttgcaaagttgaagacctcctcaaaaatctgggtcgtgaccagtgtcgatcgatgccctatttttattatatggcagatagatggatgcggtaaagtccagtggcccttttttttcacaaactaggccgtgtataatggaattaaacggaaaaaggggttggacagggatgcaggtattggttgtgggcgctaatgggcaggttggtcggttattgatgcaacagctactagccgcgggtgataccccggtggcggggttgaagccgaccgaagatggtgaagaatgggctgatcagggattgatggtgtgtaaaatggatctactagccaagccagagcaattagctagcgctatcatgggtatggacgcagtgatctttgcagcgggatctggtggtcaaactaaagctgatatgacattattaattgatctcgatggtgccgttaaaaccatgcaagcggctgagattgccggagtttcgcgttttttaatgatcagtatgttatttgcggaagatcgtaatcgctgggccgatccgttaaaaccgttgtatgttgcgaaattttatgctgacaactggttggttcgccagacccaccttgattatacgattgtccagccaggtgcgttatcctttcatgctggtacgggcttaatcaagagtgatcctttggcggtgggaagcgttccacgcgctgacttggcggcctttctagtggcagcactccatgcgccacagacgattgggaaaaccattccgttattgagtggggatcaatcaatagcgcaggtgattgaccaattatgagcataatgatcgccaggcggcaacattcttggtaaaataagggtagtaattgagagtgactgtcagtatttttgctaaggaggttacggttatgactgagaatgttgtattagccccaccggaagccctggaattagcgaaacatctggatgaatgggcaaaatggcggcagacccatgaccggaccactgccgacatggattgggaccaatttatttcgaagagtcgtgagaaggcacagtggcaggctggcttagctaccgaaattgaccactgggaaagcccccatgcgattcaactggctttaacggataacttaatggggaccgctcatggtggtcacacgcggcaataggtcgctaataaaaaggtcggcgcatcaggcgctgacctttttttgatgtcgatagtacagttcgaaaaataagaccattcccccagcgggccgggcttgggcgctgggacttttcgctgggctaggcgagtttgctttaaccgttcaccgaatgtcatggctggatgtctcacttttagttttagtctagcaaagcgcagggggcttgcctagcaaagagtctttgcatcgttgataaatcaatgcttgatgctaatcgttcttttgcttattgagtttatcttcgctgatttttaagcgatgggtgagatgaccaaaccacaagataaaccagatgagccaagaaaataaggctagactactaagagtagtagccacactcggtgatacgggccaccaataggtcgccacaaatgcgccggtgatcaataagttactaatcaaggaacttagccaaccggattgccaccgttgttcagctggcggtaggctgctgagttgtgcctcgaatttttgcatgaataagacgcctagcagattaaagaagactgccgctaggatgacccaactgcctaattggctaggaagaaaaaaacgttaggataatcagaaacaaaaagtttagaatctgcatgctctgataaatgggccgtagtttacgcaagatttcggatttgcgtaaataatctagcataccggtgtcttctttatcaagatatctaagcttaacccgtataggttactcagtgtaactagactgtcaatatcggggaagcttttacccgtttcccaactagaaatggtttgccgcgacaccgcaacctgtgtagccacagcctgttgggtgagctgatgatcggcacgtgcttgttttaattttgctcctagtgtcataaaatccccccctgaagttgagctaagcatagcaaatttgatggctgatgacgagctaagtttgcttgcaaagcggttgtgacggggattatcggggatgaagacgcccgtgttaagatgaggaggacctttaacgtgggcgtcataattatttggcctttaagtcgtgaatgccgtgactgagactttcaattaaaaaggtcgcaaagaaaatcacgtaaaagacagcgcaacctagttgaagcaaatcggccaggaacatcaaaaatgaaacgatttcaatggtgataattggcccagccagataagccagaccgcggaaccatttggaataacttgcgaatagttttttcatgattacgcctgaccgttagccaccaatccaccatttatcttccacgggaagataaagacaacctacttgatgaacgtctatggataaaaagggatctgtggctgatccgactaattggacttctgtggtgttggggtgactgaattcataggtggtgacctgatgataccggtcactagataattgggttctcaccgccacagccggggaacgatatccggcgaggtagaggcgagcactcgttgaaggggtcagcaggcataataagctcaggaaaacagtgccacccaatagccagcccagtgattgatcctttgctgggcggccgagacatacacctgcgagtaaccagaaggtgatgattgatagaatagggataacgggggccagctggctacggagaataccaataactggtaatagcaaaaggagtaagagcccactaaggcctaattcatggtcttgcttccaatgggcgagactccagacaatccaaaccaataagcctagaccactaaggagtaagccaatagcttcccccattgctgggcgatcgtcgatcataaagacgtgatctaaccgccacagccatgttacccaaatcccatacaaaaaaagcgttaacgtgccacgtagcaagagttgtttcatttgcactagcctactttttattcgaataccgcatgaaggccatcggcatattatttattacaccaaacgattacctccctgtgcgataccacaaaaacgccgctaaccacatcaataacagtgggttagcggcgttttgattacttaatcgagtcagtcatcagtcttattgttcttcgtaccatgagtagtggaagttaccttcccggtcgttacgttcgtaggtgtgggcaccgaagtagtcccgttgtgcttgcagcaagttagctggcaagacttcggcacggaagctgtcgtagtaagtgatagcagctgataaacttggaacagggataccagcttgaacggccatcgcaaccacgtcacgaatggattgttgatacttgccggcgatatccttgaagtaatcgtcgaataacaagttgctcaacttagggtccttgtcaaaggcatcggtgatgttttgcaggaattgggcccggataatgcatccaccacgccagatttgtgctagttcaccgaacttcaagtcccaatcgttggcttcagaagcaaagcgcaattgttcgaaaccttgggcataactcatcagcttaccaaagaagagggcttgacgaacttcttcgacaaacttgtccttgtcagcgatgtcagctttgccttgcttttcagcagcaggtaagaccttcgaagccttaacccgttcgtccttcaacatagaaatgtaacgggcataaacggattccgtgataaccgattggggaacttgaacgtccaatgcatcttcggaactccacttaccagtccccttgttgttcccacggtccttgatggcatcaacgattggcaagttcttgtcgtcgcccaagtcatccttacgggttaagatatcagccgtgatttcgatcaagtagctatcgagttcacccttgttccattccttaaagatgtcagccatgtcatcaacggagatgcccgcaacattacgcataatattgtagctttcatcgatcagctcttcatcaccatattcgatcccattgtggaccatcttaacgtagtgaccagcgccgttagggccgatgtaagtcacacaaggcttgccatcttgaggtgccttagcagcaatcttttccagaattggtgcaactaagtcataggcttctttttgaccaccaggcattaaggaaggaccttgtaaggcccccagctcaccaccggaaacccccatcccaataaagttgatcccggacttgtcgagttcagcattacgggccatggtgtcatggaagttggtgttcccaccatcaatcaagacatcacctttatcaagcaatggtaagagttcatgaataacggcatcggttggcttaccagccttaaccatcaatagaatccgccgtggcgtttccaatgatttcacgaaatcttcaaccgtgtagctaggcaccagcttcttttcgctgtgatccttcataacttgttcagtcttgttagcggaacggttgtaaattccgaccgtgtaaccgcgactttcaatgttaagggctaggttcttgcccataacagccataccaacaacaccaatatttgctttttgatctgccattagtaaccttccttttcgtttcaaaattaataacggactttccaacagttagtgtagcattgaacaatttgaaaggaaactcatttgtctcattttttgaaaaaaagtgaaaattggtctagctaaataaaaattagtgctggttttgataatcgcggacattgcgggcaaccttggctaacaattcttccaaaagggccgtctcgccggttgacaggccttgggtacccacggataagatttgttgttcatagtcttctaacgctggatacatcgcttgtcctttggtagttgcgagtagcggccgacgcttcttatcgtgggcatcgattccacgggtgacgtattgggttgcgatgagcttgcggacggcgcgtaaacaggtcgatggatcaacgtgcaattgagtagctagttcggcctgggtgatgccaggggtttcgataatccgcattagaaaaataaattgattgttactcaaatcattggcctggaacagttggttccccatggcggcggtcgcccgggcaatcaggccgatgctacgaaaagcattgggcataattttctcctttgatagttgcatatgcaattaaaaagtgtaagatagataaccatagtataccacagagggaagagattaatcgtggaatggcaagctaaatcatttgatgagttatcacgagaagagttcttcgatattgcatatgaacgtattcgaacgtttgtaattgcacaacatcgaccatatcaggagatcgatgcaactgataaagtggctcggcacattttgggatatcaagcagggcaattagtggcctatgcgcgcgtgtttcgcgaagcgggccacgtgacatttggccgagtattgacgataccggaacaacggggaactgggctcgggcgtcaattaatggtccaaattgaagcggaaatccggcgtaactttgccggagaagccattagtattgaagcgcaggttgataagcagcatttctatgaaaagtttggctacgcggcaatcggcgcggtatttgattttaatggtacgccccatattcggatggacaaggccggtcttaggtaaggtagcagcttgcagggacacttgattctaatacgcgtactagcataaaaaaagggccatcaccgattaagtatcgatgatgacccttttaaaatttaaaatacaatctttaattatttaaccggtaaatccattcgcggtggtcgcgttgaataagttcttcagcagcggcagggcccatggaatgtggtgtgtagttcgggaagtttggttcttgtaagtcccaaacccgacgaatttggtcaacgaatttccaagcgtaggaaacttctggccaacttgagaagttggtcccatcacccttcattacgtcatggatgagacgttcgtaaggttccggcgtatccttagacttttcggcgcccacaatgtagtccaacttgattggttcagtctggaaaccagtatcgttggtcttggcatttaattgtaatgagaaaccagcgtgtggttcaacgaagatcgtcaaaacgttggctgccaagggggtgttttgagattgtggaaaggcgaagatatctactaatggccgcttgaagacaacatctactcgagtgaacttgtcagccaacatcttacccgtccgcacatagaatggtgtccctgaccaacggtagttatcaaataataacttcccggcaacgaatgtttctgtggtggaatcaacaggaacgttgtcctcatgtcggtaatcaggttggtcgttaacggacccatattgaccacgaacgaagttggttgcggcgtccgctacgttgtaaacccgtaaactccgtagagccttaaccttttcagcccgaatatctgtatccgtaaaggcgacaggttgttccatagctaacagggaaacaatttgcatgatatggttttggaccatatcacgtaaagccccactgttgtcgtagtaagaagcccgttcttcaacacccaacttttcagaaagggtaacttgaatgttatcaatgtaccggttgttccagagggattcaaccagtgtgttaccaaagcgcaaggcttcgatattttgaatcatttccttacctaagtagtggtcaatccggaagatttgctcttcttcgaaggacttgcttaaggcatcgtttagttgtttagcggaatcgaagtcacgaccgaatggcttttcgataactaatcggttgaaggcgttcttgtctgttgacattaggccttgggtcttcaaatcttgggcgatggtcccgaagaactgtggtgccatggatagatagaagatccggttaccttgtaacttgtacttcttatccaatttttcggcgagttccttcaagacagagtagtgcgccgtgtcggtaacatcgtgtgattgatagtagaagtgagagataaagtcactggcttctttagaatcggcacggttaccactgtcagctaaggatttcttaacggcagctcggaatttgtcatcgtcgatgctttgacgagaggtgccaataacggcaaaatgcgtccgtaagttacctttgcgataaagattgaaaagactagggtagagtttacggtaagctaagtcaccggtacccccgaagaacatgaataaagctgtacgttcagttgccacgagatcgtcactccttaagtgtgattacgttaaaagatttctaccaaaatttaaaaactgttatatgatgttgtcactaccgggagcaaatccgggagtgacgcagcgagttgtctatttgatgtctagaccacttcacgaagtattatacgctacttctttatgaaacgcgatctttttaaagcaagaattttaaatttagacaaccggttgcaatgcttataaaacaatgtttacatcaaaaatcattttcatgaaaatgaaaaactttttgttgaaaataaatggaagcgactttctcgccaattagaattgaaatcgctaccactttaatttaacagaatatgggcatgaggaatcatttcacgcttctaatgattagattttaatgtgattatgaaaatggtatgctagatataagtgatgttaacgactgattaacctaaatggggctgaaaaaatgaccaattggcaggaacgagaaataacacgagtaacgacggcaacagatttatatgacttatttgaccggttgggtctgcgggccacggattcttgcttggtgcacacctcattgagtgcctttggctacattcctgggggtgagcagacgttggtgacggcgctcaaaacgaccttgtctcaaggcaatattgtgatgccggcccagtcggcagactatacagacccacgcgaatggctgtatccccccgtgcggcaggatttgcaggctaaagtgatggctggcatgcccgcctatgatcggacactgacaccttgccactttatcggaatcacaccagagtattttcgggcactgccagatacgcaacgcagtgggcacccaacctgttcgatgacggcttggggccgaaatgcggcgcaaatttgtgcaacatcgacgttggatttgccctttggtgcgcaagggccgttgcaaaagctttatgatctgaatgccaaggtcgtgtgtttaggtactgattttgaaacggctacggcgattcatttagcagaatcgaccattggccgcccggtttttgaagaacaggcgcccattagcgtggccggcaagccccagtggcggtcttatcaaatggttgagttggaaccatatgatgattttaatgcgatgggagcggccttttgtcaggcccatccagagcaggtcatccaacagccgctggggcagcaccatcaggccagggcgatagggatgcgggcgctggtcgactttgcgcgcgcgtattatcgggcaaaagatcggcgcgagatgggacactagttttgtagaagattaaagaggcaccatcactaatggttgatttctactagtgatggcgcctctttatgggactaagttgttaaaatattactttgccaaggccttcaacgcgtcaaagtcagcctgactcagatcaatgtcttgggcctgaatattttgcaattcgtggtcactagacttagtgcctggaattggcagaataacgtcagaacgctttagcaaccaggctaacgcgatctgtgcgggcgaagcattgtatttctgcgcaatgttcgtcagcgtagcatctttgatcagttcaccagtagctagtgggaaccatggaatgaaagcaatgtgatgggcatctgcgtaatctaagacgtcctcgtcttgccgattgctgaggttatacatgttttgaactgaaacaatgggggcaatggccgtagcttctttgagctggtcaacagagacctgactcaagccaatgtgtttgatcttaccctcgtcttgcatgtcttttagaacaccaatctggtcggccaacggaacattcggatcaacccgatgaagttgtaagagatcgatgtggtccaaacccagcgtaaacaaattcatttcaacttgttgtcgaaggtaggcaggaacgccaactggtgtccagacatctggtccttgccgggtgttaccaactttggtggcaaccatcacgtgattgtccgggcgattcttcagggcatctcgcaagtagaggttagcataaaagggaccgtaagcatcggcagtatcaatgaagttaacgccgtgatcaatcgccgtttcgatcactttaacggcattatctgggtcagcaactggtccccaaacgccgtcaccagtgagttgcatcgtcccatagcctaggcgattgaccgttaaatcggaatcaaatgtaaatgttttttccatgctgaaataccaccttcgtaagaattaaaatgctaacattaagttagtctttttacccgggtggtgcaaacattttggctcagtaaaacgctggcgttaaattaaagttaagccagattaaaaaagcctaaactccgcgagattatgtcacgattctgtaaaaaatctgttatactaacaatcggttaaaaaaataagtgccggtgggttactgccggtagactaaggggtcaggaataatgaagaaatttatggttgctttgactgggttagtcacgttagccactgttggcgcaacggtcccagctactgcagttaccacggcacatgccgcaacgaagtcaacgtatgtcagcccaagcttaaaggttaacgcgatctacactacgtccacgaaggttgctggaacggcgacgaaagggtccaagattaccgttaaggcgacaaagaatgccaagacgaacctcgccagtggtacagcttctaagaccacgggtaagtacagtattaagctatccaagaagttaaagaagaacgctaacgtttacgtctacgctaccaattcgaagacgaaggcttatttctaccggattatccgggtccaagcggcttcaacgaaggcggcaacgactaagagtacgtccacgaagaagacgactactaagaaaacaaccacggaaaagtcgacgacttcttcaaagactagtgcggccagcttttctgtaaagacgccaacggggacgtggacgtctaacacggccaacaagtactcacaaaagtgggtcttcagccaaaagaccggtctgaatgaatacctgtacaagaatggtaagaaggtcaagacgttggtttcttacgcgaagtacagtgtctctgctaagacgccaaccttctggaagattacttacacaccaaagggttctaagacgaagcaaacgatgtatctacgcttcacgtctgctaagaagttcaaggtggtcaacagtaagaaccaggttatctcaaccaaggccggcgttgctcctgctgctaagtggaccttcactaaggcttaattagaattaatgatctaaatcaaagcgaaacgatcataccaaccggttaggaagggatgatcgtttttatttggtcacacttatacgtatcagttaactgccgggggctgatcaactattggactttcacgaaccgactagtcacttcactcaaaatggcagtttaacaatgatcgtagctgttaagagtttcggtttttagtgaaatatgcgacaatgaagctagaagttcaaaataagtgagggacagtaaatgtggaaaaccaaaaaagaggtcagtttagtggggattctgtcagcgaccttgctacttaatgctgcggcagcgtgtatgtggccgttgacgaccgtttatatgcacaatcagcttcaccagacgttagcattggctggggtggcgctattagggatgtcgttatgtatgattgttgggaactggcttggtggctggctctttgataactggtcaccgtttaagtcagcgcttgtcgggacgttatgttcttttattccgatgctcaccttaattgtttttcatgggtggccgatctttgggattatgctcctgtttatcggtcttggtgatgggattgtgatgactgtcgtcaattcttttgcggcgaatatcaaagaaattagtagtcggcgggtcttcaactggctgtatattggtatgaacctgggggtagttgttgggactctaatggttggggtactgatggatcatggggttcaattggtctttatggtagctagtctaagctatgcggccttgttagtgattttcgttgtagacttccgcatggatattcagaccaagacccatcaacacgtcaagggcccggccaagccggctcaattacagctcatttggttgattgcggcgatggtcttttgcctttacttgagttactccttatgggaaagtgtgatctcggtccacatgacgaacctcggaatttcctttgaaaagtacagtctgttgtggaccttaaatggactcctgatcgtcttcggtcagcccttggctaatcggattgggacgtactttaaaatgagttcacagattgcggtggggacgcttatttttattctatcgttcttactcctggtctttgctagagactacaccatgtttgtggtgactatggttatcctgacggttggtgaaatgacggggtttcccggaattccagcctggattgatggccttgcgggagacaacgacaaggggaagtttcaagggatttataacatggcaatttcctttggtcgggcggtgggcccgttatacggtgggctaatcattgagtatgggagctatcagttactgttctggtccgttacgggtcttatgctggcggctttagcggcagttatgcttcgtaatcatcacaacctgacacgcgttaaaaagtagattaaaatggatcaacctgaaaatggttggtctattttttagtttaacgaacaaaattattttaaaatgtaagggtttacattgacgttaaatcaaccttgcggtacattaaaagtgtatcaaggatttaccaatttgttacataggagatgagcttatgttttcatttctgaagcccgcaccagatgctaaagtgaaagttcctactgaaaaagttgtggggacttatcgtttacggcagacaggtgttttgttgtcaatttgtatcggttatattggctattatattattcgtttgatttttacaaccgagcaaaatgacatcatgaaggcgtatgggtttaccaccgcagatattgggttggttatgtcttgttttgggattggttacgggatttccaagctgttcatgggggcactgagtgataagagtaatccgaagtggtatttggccaccggtctctttatttccgccatcctgaactttggcttgggctccacgcgtaacctctacgtgatgatgctcctcatgttggtcatgtcggtggcccaaggcatgggtgcggcggcctgccagcgaaccgtacagctatggtggggtaaaaagtggcggggaaccgtctatgccgtctggtcttcggcgcataacgccggtgcttttgcctgtgtggccgtggtccaaatcgccacgttgatgtttacgcactcaattgcggccgtcttctacacggcatcggttgtctcgattgtcattgccatcttcattgtcttagcgggcgccgatcgtccggcaacggtggggttacctagcatcggcgagtacaccggtgacgaagtcgttttagatgatggtcaggccacgagggccgaattaactgatctctctttgtggcagattttcgttcggtacattttgaccaacaaggttgtctgggctatcacgttgacgtcaatgtccttatatttagtccgttacggcattatgagttggattccgagttacctgacgcaattcaaaggctttgatccgggaacggctaaatggttagttggtatctttgaattggccgcagttccaggcgttatcttgatgggggccatttctgatttactgaaagatcggcgggcgatcgtttgtatcgggtgtgtgatcgggttactgatctgtctcacgacgtacttctttagcaccagtcatctagcgattattattgtattactcatcatgggtagcttgatttacgcgccgctaactttggtgggtctgatggtcaatgagtctgtgccaaagttcgctgtggggtcgtcgacaggcttcatgggtttcttccagtatatcttcggtgaaacgttggcaacggctttaatcggaattttggtagcaaaatttggctggattgccagcaacatggtgctttacacggcggctggtttagctttgctgttactgtgctacattgccattcatgaacatcatgtggcaaagattgcagcgggcgattagctattcgttgtgcttagatctttggaaacacaaagcgtcccgggcgagagcccgggacgcttttacgtactattcggttaaaaatccttgctgctgcaacgcctgcaagatccctgcccgttgctgtggatcacgactcatttcacttatgatatggtgactaaacgtttcatcgcgctggtgagtcccccgttgctggtagtaatcgtggatgacctggtcatacgccactagtcgtgcatcatcagctgtcagagcttgatacccattggtgaagtgcatcaagtcttgaggaagccggggcttttgttcgggatgttccgtagggtggccgatggctagtcccaataccggaaatgtcagttccggtaaatctaacaggtcaatcacccgcggggcatcattaagaatactccccatgatggtgctacctaagttcagactttctcccgccgtgacgatggcctcggtggcaattgcggcatcgaaaacgcccgccagtagcttgtctaagctatgcagattcgtggttgtagtggccgtaggtgggaccaactgcagattacgatattgatcagcgaccataacaaagtagtggccggcttgttccaaccaatggtggccggtgatatcaccgaggactgctagtttagcaggatcagtgacgctaataacgctgtattgttgggaaaaagtgctggtagcagcatgttgggctgcagcaattaatgtcgtcacctcatcagttgtcaacttttcggccgtaaattggcggatactacgatggttaaatagggtggttaaagttggattcatgaggctggggtcacttccttcaagcggttgatcagtgcgtcgtagatccgggtctcatctctgggaaccccacgaagctcatagtcagcgataaagggcaccccaaaagtcgtggcatagcgtttagcagtgagacagtattgctcattaaaattacggttgccactgcccacaacacccagtagttgctgagcattgtggtgataggcaatgtactcacccaagactttggtcattaattccttgacgccgttgtcgatgccattgccaccatctaggtaggtggggacaaagcagaagaatggctgtgtttcatccgttaaatcgctggtttcactgatttctgttgcggtgatttccggtaattccggttggctggcgtgctgcttggcagcataagccgtgagattttcgacaaaattgcgggtgttaccttcaatcgagataaataaaatccgaatgggttgcatgggggtccctccactttctgctagactgatatcttctagtgtacacggatttaagcaaaattgctgttaagttttaacgacttgccaaagtgatttaagctatggtatgctgtggctactttaagaaagaacgaggtattccgccgatgcgcaactaatcaatccacaactgtttgtcagcttcacccgtttaaggggtggagtgggcctgcaatttgggattgatggtgcaccgactgtttgctataggtaagcagagggcgccatttccaattgggaaatgcgtcttttttgtgcaatcaatcccgctttttaaaaggggacgattttttgacacaagtaaaattaacgaatttaatcaaggatttagcggatggtcgactattctcagccgatcgtttgaccgcgcaaactggtgattgcgtgggcattatcggcgctaatggtggtggaaaaacgacactggcgcggattattgcggggcaagacgatgagtttagtggtcaacggcacgttacagctgacgtcgttttggtgccgcaattggcccccatggatggacaatctggtggtcaaagtatgttagcgcgggtgcggcgggcactggcacaacggccagctattttaattttggatgaaccctcagccaatctggatgacaatcatcagcagtggttgatagagcagctgcgccattattcaggtttgttcctgttaatttcgcatgatcgggagttactaactgctgtgacgaccgcgatctggtcactagacgaccatgtttatacgcaattcaatggcaattttgctgccttcaatacggtccgtgagcaacaacggcagaccgcccagagtgcctatcggcaggagcaggttgaacgacgcaagctcagacaagcggcccaagctcggcatgaaaaggccgcccaaattcggcggggcagtaatcgcatgagtgctggtgaacgggccgactccaagtctgtacgcgagcaaaatgccgcgaagatggaacggggcgcccgggtctttcaagatcgcgctgaccggcagacaatgacggtcaagccgcatgaagcagcggcaatgaaattattagcgagcgacttgccaccagtggttggcaagcagttgattacggtccgtaacctgcacctaaaacggggaaaacacgagctgctaagtgatgtgaattttcgcgtgaccccgggagaacggattgccttagccggaccgaacgggagtggtaaatcaacgctgattacggccattttgacgggtcaagtggggacgcgcttagccccaagtgcacgcgtgggttattttcaacaggatatggtggcggcgttgcccctaacgcaaacggtctggcaggttatcagtgcagcgacagtttttgacagcaatcggactaggcaggtcatgggtgcatttggattaaatgcccgattctacaaccggccaatcgccgaactgagcggtggcgagcgggtcaaggtacaattgttaacgattctagttagtgcaagtaacttattgattttggatgaacccaccaactatctggatttaccagcagttcaggcactagaagattatttagttggctatccgggcaccgttttgtttgtggcccacgaccaggtttttagggaccacgtggcgacccggacgctagtgctgactaatcggcaattgcgtgatccagcgcggacagcacaaggcgtaccagcatctgatttgccccggttgcagtttgaatacgatcaagcgatgctggccccggaattagacacgcagcgcttacaggaattgcggcagaaaattgcggcactcaaagcgaccttataaccacaaacttggcattatttgaaaataatccttacgaaaaattattttttctggtacagtaatccattgtgttgaactgaaagtgagtgtgaaaacaaatggattcagtacaaagtagccagccagagttggctaaaaaagcgcgggtgcaagttgctcaccccatgctagcgatgatggggatgctgattggtgggtttgtcgggatgttttccgaaacctctttaaatattgctttgccacaattgatggcgcaattaaatgtgtcaacagccaccgttcagtggctggtaaccggttatatgttaatggtcggagtggtcttaccgctgtctagcttgattacgaaatggtttaccacgcggcaagtgattttgtttgccctgattgattttgcagttggcgccattatctcggcgtcggcacccggttttggcgtgttgttatttggccgaatgatccaagggattgcgacgggattaattctaccgttaatgtttacggtagccatgcagattttcccaccgtataagttaggagcggctatgggcatggttggcctggtgattatgtttgcccccgctgtgggaccaacattggccggaattgtcttaggtgttgcttcatggcggtggattttttggctgttcgtgccatttttggtgattgcttttggttttgcggtcacgtcattgaaaaatattgcggaggttacgcggcctaaagtcgacttcttatcaattattttatcgaccgtgggttttggtagcttggtgctgggagtcagtctcgccagtgatcaaggctggggctccgttagtgtgatcggcgcgttagtcgttggtatcttggtcttggcttggtacacccatcggcaattgaatgttgataagccaattttaaatctacgagcgtttgcgatcccgggcttccgtattggggcgagtctggtgatgattaacttcgggattattctgtcggcaatgtatttattaccgatgtacattcaaaagggtctgctattgcccgtggccttaaccgggatgattatgtttcctggtggtctgatgaacgcgattgtttcggccatttctggtcggttatatgatcacgtcggagctcagatgccagcccgtctcggttttatcatctcaatggtcggggcattaatgctggcgttgacgtcaacccaaacggctatctggtatgtgattttggctcacatcatcttgatgattggagcaccactggcaatgtccccatcacaaacgcacggtcttaatgcgttaacgggaccgattgcggctgatggtagtgcgattatgaatacgttgcagcagattgtcggtgcgattgccacggcgattgcgacgagtctgttgggaattgggcaagccgcttacttggctactggtgcccaccaagcggctggtgctttcgttaacggggcccactatgggttttacttcacgtttggattagccttggttggtttcttattagcgttacggttacctaaaatgatgaaatagaagttaaaaagtggttgggctctctagtccagccacttttttgctggcgtattgcgctgtgctgacaaatttttctccagcatgccggggtgacgtgctagaataaaggaagaagcgcttaccaattaatcagtaatgcgcagtggatacaaagtttagggggatattatgcagtttaaccgtcgatttattcactcattggatttctggagtggcctactgattatggttctaatgatttggaacattatgccaattcgagtggctagcttattttggtgggtgtgcttgctactttttgtgggcggtatttactacttcgctaaggggttagtgcggataaaatagcgtgcatccgtgttggccgataaaagtgtggatatacataaggtattaattggggccgccggaacgaaataaatcgtgtgagtgacgaagttgacagttaccatcccgcggtttatagtttaggtgtatcgatacacctaaactaattaaaggaagtgcggtaggatggcagcatttgatcgacaaagtttttcgttaacagggaaagtcgcgctgattaccggtggtgcgcggggactcgggaaatattattctttggcattatcgttatatggcgcagatatcttcattgtcagtcagtcaaagaccggctgggatgacgtcaaacaagcgattgaggcaaatggtcagcgggtagcattccttcagcaagacattacaaaaaccggttgtgcggccgacattgtcgcccaggtagttgctcagtttggccgcctggatatcttggtcaataacgctggcatgcaactgcgtaatgacgttctggcgtttaaggacgaggactggcggcgggtgattgatttgaacctcaatgccctgtactacctatcccatgccgcggcccaagagatggtgaaacagcatgctggtaaaattattaatgttggatcgatgcaatcctatcgggccggtaagtacatttttccttataccgccagtaagcacggtgttatgggcttgactaaggcgtatgccgatgcactggcgcccgaaaatattcaagttaatgggattgcgccagggtatatcagtactgatatgaccaagccactccaagaagatccagtacggggaccggaaattgcgagtcacatccccgctggtcaatggggggttccagatcaattgatggggcctatggtctttttggccagcgcagcgtctgactatgtgacgggggtcatgttgccagttgatggcggttatttattgcgatgagtttaaacgacaaacgggtcccttcagaacgcactgttctaaaaggacccgtttttaattggctaaagtgatggtttaacaacgggggcgacgggaacgtattgagtcatagtcgttggcgttgttgatagctgatgaagtaacgttgtggcggctaattggcccatcaatgccggctgttgctggagtagataaataccgtcgttgacatattgggaccattgccagtcatcaaaactaaccagtccgacatcggcgggaaaatgcaggtgtgcggcttttaggctcgcaaggatttcaaataatagcgggcccattaaagaaataattacgggtttgtcaggagcctgctggtattgacgaagttgttgggtgagccaaggcgccccatgacttgtcatatccaaatgaataactgataatcccgtggcagtgagtccggccaaccggtcggtttgagctgtatggggagccacggcacgaccgacggtgattaggcggcggtagccttgttcgcgtaagtgctgtcccaactgatagcttgcatcaaaattgctagaaagaacctgtgccaatggactgttgggtaactgccgatcgacaataatggttgggatggtgagcccggcgtatgccgcggctgtggcggcactaggttgtagaatgatgccatcgacctgttgggcggccagacgggttaattcaccgtgttctgtagtggcggtgttattggcattcattaataagacatcataaccagcaggctgcaaaacgtcgtaaattcccttaaacagtaaagaagagaagacgttggcaatgtcaccaacgaccacgccaatgagctgactgtggtcttgacgcattttgcgggcagatgcttttggggcgtaatgtagtgtggcaatggtttctttgatgcgttgcttggtggcggcgctcattttttggtagttcccattaaggtaacgggacactgtcgtaacggaaacatccgctgcggcagcaacatcggcaatggtcgtatttttcatggttaaccctcctccggttagcatcaaaaagcccactcccaaaggagtgagcttgattagattagtcttggtcgtcagtcgacgtgatcttcggtcttaccgggttaacggtaacctcaaaccagttaataaacgagttctcataatcgagaactttcaaatcaaagttttctaggtgaatgacgtcgttgaccttcacatcgggataattatcaatgatgtaaccagccatagtgaccagttccgtcgcttcaaagtctttaatatctgtgttgaagtatcgttcgaagtcatacgtggtcattttcccattgacttggaacgtgccatttggttgtttgaaaatgtattgatcgttggcatcgtcaatttcatcacggacggttccaaagagttcttcgtaaatatccttatcggtgatgatccccgaggtcccgccgtattcatcaacaacgaccacgattggggtccgctttttgatcatttgttggaggacttgggtaattggcgtggtttcaggtgtcgtggagatatcacggattagcttatcaacgcgcacagatgaatccacttgttgttgccgggttaagtcatagttataaacgtaacctaacaccttatccttatcattatccgccacgactggcagccggctaaatcgttcctgtaaataaacgtttaacgcttccttgacagttgaggtaatgtcaataacgaccaactgcgtccggtcaatcatgatgtctttggcaaccttgtcattcaattcaaaggcccgttgcatgtaaaccaaatcgtttttttccaactcgccaccttccacggcactccgtgacaggtttaaaatttcggcttgggaaaagacttcatcactttcgttagcgaccttaaggcccatcatcttaactactcctgaggcactcacgttgagtaaccagacgaatgggtagaagataacgtggcaataatgaagaggtgtgaccactaacattaagaccttcatgggcatatcaatcgaaatattcttaggaacaatttcggtaaagaccacttcgaggtaggtcaagagtaataccccgatgatgacacttacagtgtgcgccgtggcactgttaatgtgggctggcgcaatgcccgctaacaggatgtcaacgaagaaggtttccccgatccaccctaagataataccagcgagggaaacccccacttgagttgttgacaaatattcattcaaattggtgaccattttcatggcccgattgagcttagttgacggcttgtctctttcggcaattttttcctctagagcactagggcgcgtctgaaccaaagcaaactcgcaggcaacaaagaaagctgcaaaaaagaaagtaattaaaataataattagattcacaactatctgaccgctatccacacatcattcctcatttcatttcgttctatcctactattataccgcgtttccccacccgtttatagggggtgaattgaagcaaattctaccctttcttaagcagtaccgcaaccgaacacgaaaaaaagtcacgaaaaggggagaatacttaacgtttctggtaaaaaggactaaactaaagacagtaattcaaaggagattttgattatggcagatacaccagaggaacaagcaacacccgttgaaattcccgcagcagacgtggaaaaagcggcaaagttggttttggacccggggtatgtgacgaagaaagatctaccaaaaatggcagatttagcatgggcgaccgctctatctgatgctgtgatgaagcatttcttaaacgacgatgacgaccacgatccttacgtctacttcgagcaatttgattttgacggtggcgacattgattccattatctttaatatggatgttatcaagacccgtgaagaagccttacatgatttggcagatgcattgggtgaaaagattgtgcaccatgaggttgatcaaaccacttactaaaataaatttggaaccggcgataacgtaacttgttatcgctagtttttttgatttaaaatagtttgatatttattgacctttataacaaaataattgacgatttggtgactgcctattatgataatggctgtaatcgttggtattgcaatgaattaaaggaaaaattagcactctaaattgatgagtgctaattacttgcatttatgaccaatactgactattataaataatgtaatcaagataaatcagttgaaaggggttattgattatggctaatgatgtaatgaaccggaactatgatttctttgatccaatgaatttctttaatgaagtcggcaatttggggcgcgacatgtttagtggtgatagctccatgaagacggatgtagttgagcatgataaggattacgtggtcaccgcggaacttcctgggtttaagaaggatgatatccacgtggattaccatgatgaaactttgcggatttctggtaagacggaagttaaccaatcggctaaggatgacgatggtcggattttgcggcaagaacgtcggagtcaaaatgttgcccgttccttctacctaccaggtattgatttgaagaacgtgaaggcgacctacgccgatggtatcctgaccttaacgttgccaaagcaaactgaagttgatggcaatcacgagattagcatcgattaattaaaaccaaacagtctactgtgaagagtccggggcaaaagccctggacttttgtgttttctgcggattcttttattatgagaaaattgacaaagatcacacggaaattttagccggttatcaggaaattaccacgagattaaccgttgacttgcttagaattatacataaacatgtataaacccgaaaccgggtatgagtgaggagaaaataatgactgataatcataataaaatcacattgatggcgttagtcatgatgatttttaccaccgtttttggttttgccaatagtacggtggccttttacttgatgggctattcgtctatcttattttacttagttgcggcggtgttgttctttattccgtttgcactgatgatggcggaatatggtgcggcaattaagtccgacgagggaagtgggatgtatcaatggctggaggtgagtgtcagcccacgctttgcttttattggcacctttatgtggtttgcctcctatattatctggttggtctcgacatccgccaaggtgtggattccatttaccacgctgttctttggtagcgatcagatgggaaattttgggtttgctggactaaacgcgacgcaggtgatcgggctcttatcttgtttgtggatgattttggtcacagtagtctccattaagggggttaaggggattgtgcgggtcaccagtctggggggcttagcggttatgagtctcaatgccattttgctggtcatttcggggattgctctggcgttgcgtcatggagaaatggcgcagccgctccaccactttttaacatcgccgaacccgagctaccaacaacccttaggcgttatgagctttgcagttttcgcgatctttgcctacggtggtctggaagtattggggggcatggttgataaaacccataatccagaaaagacatttccgcggggcattattatctcagcggtggtcatcaccttggggtatgcgattggaattttgtgttgggggattagcaccaattggcaaaccgtcttggcgaaatcaaccaccaatatggggaatattagttatgtaatgatgcgtaatttaggtgatgttttgggtcagtcattagggctcagtgcggctaccagtaacaccattgggttgtggtttgcgcgctacaccgggttagggatgttcttagcttactcgggggcgttctttaccctgacgtattcaccactcaagacgttaattttgggaacgcctaagtcgatgtggccagccaagatgaccaagcttaacaaaaatgatatgccgagttttgccatgatgctacaatgcggtgtcgtcattgtgattatcttactggcatcgtttgcctcgacagatgcgtcagccttttataacatcttaacgttgatggctaacgtatcgatgaccttgccatacttgttcttggtctatgcctttcctaaattcaaacataatcgagatattgtcaaaccctttgaagtttacaaatcgccgcgtctgacgacggtgatcagttgggtggttttcctcgtggtcctgggtgctaacgtctttactttgattcaaccagtcctagaaaatggcgatatccagagtacgatttggatgttaatggggcctttgctgtttgggttgttgggtatcgtttggtatcaacgacgagctcggaaatagaggttaatggcgggtgattgccctctctggtcgggcctacagcgtctcgccataacagcacgccaaatttttatgataaaacaccaataggcgcttcaaaaatcatctaagatttttgaagcgcctatttagtatggtcggatttaatactgtttgcccgtttcgtaaacgatttccggttcgttaccagttcgctcatttttgtttagcaagtcgatcatggtcatttcgtcgatgtctaaactaaaatcaaagatattggcattttcctgaatacgttcgggatgcgttgacttgggaatggtgaccaattgatgttggagttcccagcgcaagataacttgagcaactgatttattgtgatgtgctgccattttagccagcatcggatcatctaagaccacgcgccgtcccaatgggctccaagcctccgtaacaatgtcgtgttcttggtcgtaatcggctagggcttgttgatttaagtagggatggtactccacttgattgacaactggcatttccttggccttagttgcgagtagctccaagtgagcgatcgtgtagttggaaacgccaatagacttaacctgaccgtctgctttcaactgttccaacgcccgccaggtatcaaagaagtgttcgcgaactggccagtgaatcagcagtaaatcaagataatccgtttgtagacgcttgagcgagccctctacggccttcatagtttggtcgtaaccctgcacgatctcagcgaccttactggttaagaataatccttcacggggtaatcccagttgctgaatggcgggccccaagatgtcctcgttgcgataaagcatggccgtatcaaacatacggtagccagcgtcccaagcagtttggatggcagtgttcatggttggctgatcgttaagtagataggtgccaaagcccataaccggcatttggcgaccatcggccaacttacgcgtggcggtgatttcggttggtgtcattgtggtgtatcctcctcgacgtgacatagtatctctatcttaggctaatcactgaaaaatgacaacgcttaccgccggcgaaactgatcgtaaagatttacactggcttctaataacatcccgatggtcattaaccacatggccaacatattttgattgctgagcatgcatcctagtaggataagatataaaacaaataaaataactgccgttgctttgtgattcatcgaaagccccccagttagcgagtattgataagatcgttagtccgcgtccagattagcgccagcatcaatgccaactaaatttttaaatcgtgatccaaagatcacaccttaattataacgcttctaaagtggttgcgattcgttaaaagatgagaaaatcccggacagattagaagagactaaccaaaatatttagtacaatagttaataaggaattggtgaaggaggttaagggtgatgctacaatacgaaccaccattagagaccgggttaacgccggaggaagtgcagcaacgggtcgccgctggtcaacaaaatgatcccttgcctccactaacgcgtagtatcaaacaaatttttcgggataatttagtcacactatttaatttaattaacgtactcttgggtgccttagtgctagtgacggggagctataagaatctgctgtttttgggcgtcgtggtcgtcaatacggcgattggaatctttcaggaaattcgctcaaaacggcaggtcgataaattagctctgttatccgaaagtaaaagccggattcggcgagctggtaagatcgttgtgcacccacaagaagacattgtccaagatgatattttggaaattgggcggggcgatcagctaccggtagatgcactgatccgacaaactacgggattggaagttgacgaatcccaaattacgggggaatcaacgccgatcataaaagtaactggcgagaatttaacttctgggagtgtgatcctagctggtcgggcggcggtccaagcgactactgtgggtcatggtagctttgtgaagcagttggcccattcggcgaagcaacaacggcgaacagctagtcaactgttaaccattattaaccgaattattaaagcgctaacgtttgcgattattccattaggtgtggccctgttcgtgtcatccatgatgcgcggtcaggacctaaaccgggccattctgggaaccgtcgcatcgatggtggggatgatccctgaagggctcgtgttattgacctcggtcgcactagcagctggggcattcactttaggccgccggcacgtcttagtacgagaattaccagccattgaggcgttggcccgagtcgatgtgctgtgtttggataaaacgggaacaattaccagtggccaattacagcttgatcgggtagagccgtgggcggaaactaaccttgaaaccacccagaccattttggcccaattggtggcggctaccagtgatgataacgaaacggcacaggcaattcaacaagcattaggaacgccaacagtcactgcgacgacggtcttaccattctcttccgggcgaaaatggagcggagcaatctgggataagcaagcctatgtgatgggagcgccagagtttatttttgaccaagtgcccgccggcctgcaggcacggattcatacgctggctggtcaagggtatcgcgtcttggtcttagcagcggctaaggccttaaccacgccgcgaccaacggcaccacgcgcattaggcttgattctcattacggatgaattgcgtccccgggctaaagataccttcagcttctttgccaatcaagacgtcgctttaaaggtgatctcgggtgataatccagtgacggtggctagtattgctcagcgtgcagagattgcgggtgccgagcggttggtggacatgagtcaagttggtgagaccccggattatggacagttagtgcgggactataccgtcttcggacgcgtaacgccgcaacaaaaagaacagttgatcaaagcctatcaggcggccggacacacggtcgccatgactggagatggggtcaatgacctattggcgttgcggcaagctgattgtagtattgcaatggcttcgggaagcgaggccacgaagagtctggctgattttgtgttagtggattctaactttgacgcgatgattaacgttttgaatgagggccgccgggtaattaacaacgtcgaacgggtagcgtccttgttcctcattaaaacgatgtattctgtggtactcaccttgatttttatttttatgagccgcagctacccctttgaaccgatccagttgacaccgatctcttcgttaatggtgggaattcctacgttcttcctagcgttgcagccgaattatgcgcggatcgcggaccggtttatgaaacaggtcatggaaattgcggcgccggccgctgtctgtgtcgtgggatatattttagttgtgatggcattgggaacccagtttcagttgagctttgccacaacttcaacgcttagtgtcttaatgactgggctaattagtctcaatgctttactgatggttgcccgaccactgaaccgatttaagattgggttagtggtcgcaatggcggcattgtttgccattatcttcttattctttggaccaatcttttcgctggttaacttacttaactggcgtttagcgttgatttatctgccgttgatggtgagcgttgaaccgattttcttactggtgcaagatatcttgggtcggcgaattctcagtcaaattcgttggcgctagatgatttgaaatttataatcattagctagtcatcaagactagttggtgtgttataatttaggtaagaaatggaagggcagggaatgttatggctgattttaatcaatacacgcggtgggagcatcagatgcatggtgttaaattaccacgctgggatgatcttcccaagttcgacctatacatggatcaagtaaccgccttaattaatgacgttttaggacctttaggaattgatacggttacgccggcgatgattaacaattatgtgaaacacaatgtgatcatggcccccgtgaaaaagaaatatcagaccatgcagttgaccgatattttaatgatcagcctactcaaacccatgtttcagacagatacggtgcgttcggggatcgaccagattacggcgggcgattatcctaaacaggcttacgataactttatcggccaattggaagaccgtctgcaccatttaggtgaggaccaggtgcaaccagccgcgcagaacttgaatgagaagctcatgcaggtggctgtcgatacagtggtctcacgtctgcaatcagaaaaactgctgcgcctgattaaacgaccattacgtaaaattgaaaagaagtaagtaaaagcatcgttaatcgccagtgagcggttaacgatgctttttgatattgatttattgcgtttgagtttccagagaaagatcattcatgaacgtcaacaggaggttggcatagctgggatgatccgtgttatccttaatttcttgttgaatcagacctaagttattggtaatgacgccgttagcgcccataaacatcatttgatcaagactatttacgtcgtcgatgtcccaagcgtagaccttcttgtgttctcggttcgcttggtcgacgaagctatcgtttagtgtcgttgattccattgtataggcgttggcccgggtccgtggaaaagttagattgtatggcatgatgtagctgacaaataactgcggatgctctttttttagtttatccatcaccttataactcagtgtgtgtacctgctcgtggttcgttaagatgcgttgaccgaattgccggtagaagcgttcggacaggtcaggggtgtcggccgacccggttttaatctcaattagaagtttttgatgatgcttaattgccgtgttgagataatgattgaagctaggaatctttgcttgatagccgttctcggtcaccgttaccttggttaattggcgtaaagtcatgctggcaacggaacgattgagtccagccagggatttcagattgccatcatgcattacgacaaactggtggtccttggtcatccgaatatccatttcgacgtagtctggccgttccttgctggttttgaccattgcgggaatggtgttttgaaccccgttaccgttgtcgacgccacggtgggcgatggtcaacggtttagtcatggctaagccgttaagataaacgagattaaacacaacgaggagggcactgatgagtgttaaaccactaataattaagagtcgcgtgcgtagcttggttctggcgggttcgcggaatgagaacaggctcagtggggtttgttgctggctatcgtgactgctaagaacaaccatcatgaagatgaccgtggagtaacaaacgataaattcggtaatgatttccatgaggaatagattgaaggtggcagcggctaagccaaaaccagtacggtcaaatcctaattgtcccaagtagatgaggccgtagattaaagtgaccatgaccgtcacgatggctaaggtcaccagaattttactgaaataggcccaaaaatgtcgacgggttcgttgccagctgaggcgaatggcctcatgactgtggtagccatccagcatcattaacggtaaaacggcaatgagtcgaataccaatataggcggctgccacgtagaagatgcccaaaaagacggcccacagtgggttggccatgaggtaggtcacgatgaaggcgggtattttagccttgttgaggagcggcgttgaaaaaagctcactaccaaacggaatgatcacaacgaagtaaccaataaagaataagaaagtactgggtgatgcgccaactagactccggaaaacatcacccagtacggcacgggaagtctggggacgaccattgcgaatattcatgattcccagtaataggtaagcaaattgccagtaaattaaggtaataatggccaataaaatgagcaacaagccaatgattgctaagggatgccgcaaagcaatactgccgatattggtgtatgacacgtaggggacgtgttgccatttcatgagggcggccgttaaccaagtaaaggcgggaacggcaacgtaactaatggccaagttcgtaatgaatacgagcgtgacgtaactcccccagtgctgaaaaaaatgacgggttgattcccgccagaaccgccaagcttgcacagttctcaactcctctcacaaatatgaactacttctactttagcatattctagtgatggtcggtggagaaaagtttgccgaaagaatcgttaaaccttatgaaaacaaaatctagttattatgaaagcaaaatgttagcatcgtgatttaattcacgtatagaaaacggcaggaaaaaagtttgttaaactgtatgcgcttacatcttaaacggccgtaagcgctgactgaatggtgttacaaaaccaattaattaattgtgatttttttaacataaaagacttgcagattcccaaaaacatgttatgatatatctcgtgaagaagttaacaagagtgttttcaaaaaatggaggcataatgatgttaaaagacgtgaaagagaattcaaaatcaaaatcaaaagaaagcgctgaaaccgttgaccagatgatcgaccggttgacagccaaggcccatgacgccctgtgtgccatggatgactttacccaagaacaagtcgatcacatcgttcaccagatgtcgattgcagccttagatcagcatatggctttagccaaggccgcttttaaagaaactggtcgtggagtgatggaagataaggccgtaaagaatatgtatgcgagtgaagaaatttggcactctatcaagcatgacaaaacagttggcattattaaggatgaccatgaacggcaattgattacagttgctgaaccactgggaattttggccggggtaacgcctgtcacgaacccgacgtcaaccactatctttaagtccctaattgcggttaagacgcggaacccaatcatctttgctttccatccacaagcccaacaatcttcagttatggctgctaaagtggttcgtgatgcggccatcgctgctggtgcaccagaaggggttattcaatggattgaaacgccaagcttggaagcaacgacagccttaatgaatcacccaatggttgccagtgtcttagcgaccggtggtcctggtatggtgaaggccgcttactcaactgggaagccagccttaggggtgggtcctggtaacggtccagcttacattgaaaagacggcgaatatcaaacgggccgtttatgacattgtcttatcgaagacctttgataacgggatggtttgtgcctctgaaaacagtgcggtcattgaccatgaaatctatgatgacgttaaaaaagaaatgcaagaccgtggcgttttcttcattaagaagagcgacgaaaaggccctagctgacactatgttcaaaccagagggtggcgttaaaggcccaattccagggatgtcagcacaaaagatcgctgatttggctgggatcaaggttcctgctggtacgaaggtgttagccgctgagattaccggagtcggaccaaagttcccattgtctcaagaaaaactatgtccaatgatttcagtttacaaggcaacgagtcaggaaaatgccttcaagctttgtgatgacttgctccacttcggtggtctcggtcacacggcatctcttcacacaatggatgatgctttggcaacgaagtttgggattgcgatgaaggctagtcgagtattgatcaataccccatctgctatcggtggtatcgggaacctttacaatgaaatggtgccatcattgaccttaggaacgggatcatggggtaaaaactctgtttcccataacgtttcttcctttgatttactgaacatcaaaacgattgcaaagcggcgaaataatatgcagtggattaaattacctcgggtttactttgaaaagacatcagttcgctacctcgatgacatgccaggcatcaagcgggtattcttagttactgacccagccatggttgaactcggttacatcgacaccgtgctgaatgaattgaagcgtcaaccaaacggcattgaatactccttgttctctgacgtggaacctgatccaacgacggatacggttaaccgtggggttgctcaaatgcggatgttcaagccagatacaattgtggctttaggtggaggttcagcaatggatgctgccaagaatatgtggttattctacgaagatccagaagccagcttctttggcgctaagcagaaattcttggatatccggaaacgggcttacaagtttaacaagccgcacaaggcccaatttgttgccattccaaccacttctggaacgggttcagaagtcacaccgtttgccgtgattacggattctaagactcacgtgaagtacccactggctgactatgccttaacgccagacgttgcgattgtggattcccaatttatcgaaacggtccctaagaagacggtggcttactctgggttagacgttttaacccatgccattgaatcttacgtgtcaaacatggcttctgattacacccggccatggtcattacaagcgattaaattagtgatggataacctgactaattcctacaacggtgacattacagcgcgcgaagagatgcacaatgcttcaacgctagctgggatggcgtttgccaacgccttcttggggattgatcactcgattgcccacaagttgggtggcgaatttgggttacctcatggattggctattgccattaccttgccacacgttatccggtataacttcaaggaaccaacgaagttatccatgtggccaaagtatgatcacttcaaggctgatgaagactatgctcaaatcgcacgttacttgggtctgccaggaacgactaacgaagagctcaaggaagctcttgtcaagaagatcattgatctggcccattccgttgatgtgaccttaagtctgaaggccaacggtgttgacaaagctcactttgaccaagcagtggacaagctagctgagttagcctttgaggatcaatgtacaacggctaatccacgcgaaccactcgtatctgaattaaagcaaattatgcttgatgaatacgatggtaagaacgttgaaaaataagtaattggataggtaaaaaggaatcacgatggtttatatcgtgattcctttttgtttagataggatttgcatatatatagtagaaactggaaaaagcgagagataaaccagatgaaaagtgaagtaaaaacattattttaaggcaacctttttcgggtaaagttctacttttttcgacggaattatacgataaaaagcgaattatcatcgaattatcattaaatatgacaagttttttcgctttttaagtgcaaaatgcacggaaaaatacccctcgttttcaccaaaatgggtaaaaattggccaataaaagcggtttatgtaacaaacgcgtaacaaatatgacggattgtcatactgtaatatttttcttaacagtggcgtaacgaaaccccaatctaaatgacataaccatcagttattctaatagccgttaagcaaacaaaggaggacattcatttcttatgaatatcaaaaaagctttagttacgactcttggaacggtagccgttgtcggcgccggtatcttcgctactaacgatacggctaacgccgacgttaaggtgacggtcaagcagggggattctgtttggtcattggcaaataagtacgactcatctattaacgctattgaaaaggctaatagcttgaataacgacttgatttacgttggtcaaacgctcaacgtacctaacagcacacaagctacgacaacgcaagctgctagtgttgctaacaacacatacagccacacgacgagtcaagtgacgacaaatacgactaccagcacagcatcagcttcaaccggggtttccggatcagaagctagtgctaaagcatggattgctaacaaggaatctagcggttcatactcagctcgtaatggtcaatacgtcggcaagtaccaattaagtgcctcatacttaaatggtgattactccgctgctaaccaggaaaaggtggctaacagctatgtaaactcccgctatggttcttggtcagccgctcaggcgttctggcaatcacatggctggtactaaacctagcttctaaacaaaacgtttaaattcaagtaggcactatcggatgcaggtccgatagtgcctttttgcgtacgctagatttggcgagtgttaacccacaaagcgtggttttagattgatatctactcagattaaacatttcgccagtttagttgccacgttagacattaaaaataaacgaattggcaacagttattaaaaaacgtaacgaattaatttaaagcgacttatcgaacgattattgttgatatatcggcgctctgaccataattaaatttaaaagacagtataaaacattatcgggtgtcgtagaattatccattatgtcacgttataataaaattgtaatgattaacaacatgtaactatgcatgataaaaagcacttaattagtcacactgttgtatggatggcaatgttcataaagggaggaattatcgtgtttaaggcgatgaattcaaaagaacattataagatgtataaaaaaggtaagctttggatgatcgcgggggtatttaccgctactgttatgatgggactcatgggcggccaaccggcccaagcggcgacgacaacgacatctgatgccactaccactgaaacagtgacgccagctaaagccacagccactgaacagttctcagcggcggcaacgccagctagtacggctagctcagcaatcacgccaaattcagcagcaacaagcgctgctcagtctgctactcaagcggcgactagttctgctgcaccggtgatttcgaagacggcctcagctgtgacgcctgattcgacggctactaattcgacgtccacgccggctagtgcggcaccttcatctgtagcgccagtatcatctgcggctgccatcgacgcgactaaggtagccacaccggtatcagccgcaacggcacaagtaaaagcagcaacgactcgcaatgtagccaatgcagcagcggttgcgcctgtcgcagccactgtccagtcagcggcgccagcagacgtcaccattgatcaatggatgcctgatacgaacttacaacaagtggttctccatgaactggcgaagacgactggcattacctcggctgatcagattacgcaggcgatgatgggcaatctgacaaaactatatgtggatacgtcggcgcagcagaacaataaagattattacttagcaaccatgcaagtccggtcgttgcaaggactggagtatgcgaaaaatttaacggatttatggatctgtcctaatctggatgctaatctcaactggactggcgcctatatgaaatacggcagtattagtgatattagtgcactggctgggttgaccaacttaactgaattaaatttacagatgaatcaaattagtaacatttcagcattgaagaacctcaaactaaaaggggtttcactctcatacaaccagatttctgacctgtcaccactccagaattccaaggatacgatgtcaacgtcggcaacgatggcttatcagattatcaagttgcccaccattgtgttgaatgccaaaacaacttcctatacgatgccatcctttatcattaccaatcttgatggcggtaatgtgccgattacaccagtgcaaacctcaccttattttgggatgactagcgccggaacaggaactaatttggatgatgcgacggtcgcttggaaagacctagggcagtcggggtatctgttcgtagattggcatgatacgttgctgggcttaccaggttacccgtttgacggtgaaattgttcagctatatacgctgagcgattcggtcggtaacgttaatgttaatttcaagacgactagtgggctatcattggcgccgcaagtgaccttgagtggcaacctgggggatgattttgacttaaatcaatccgccacggtgatgaacgcggttcagaaaattatggcgcaaggttacgcttatcagggaacagccgatgatatggccgtgacaggggtatacgccgaagatcctactaacattacgttgctatttggcgtgaagaagcttgcggcaacgttcaactttattgatgatcaaggacacacactggctgtgccgcaaacgatgacgggagattacggacaagcttggcagacgcaagtgccatcgctgaaaggctacacgtttaagcaggcaacccaggatgggcaaccgttaacgctaacagatggccaattggcgggaactttaacggctgatacgacgattaatttgatttataccgctgataccaagacggcaacggtgcactacgtttatgcggatggcagtgaagctgccccaagtcaaacggtcagtggcaagtatggtgatactatcgccttcccaacaagtccggtgattaagggctacacggcaagtaagttgccaacgtcagtgtttggtgacgacgtggctgccaatacctttaccgtcacctacaccaaagatgcggtgacaccaccaacccctacgcaacaggttaccgtgacggttcattaccaagatccggatggcaaggcagtagcatcggacttcgtctttaggaagcaagtcggcgatcgttacacgaccagtcccgccgatgtaaagaattatcggctacaggccacaccggcaaatgcctcgggagtagtgggtgatcaaaatattgtggtaacctatgtctatgtccaacagagtggtgacggggatcaagtaacccctgatcaaccagggacgacgactcccactaagccggttaaaccgactaagccaacacaaccagccaagcagccgactgtgaataagacgggtgggcaagccgatcaggttcgggtaggtacgcgagtcaaaccacaggccaccgttcaaaacggtgcaacgcaaccagcagtttcggccaaggccacgaccacgccagccgggatgtcagacccaacccagacaacgttgaagactttaccacagacgggggagcaagcaacttctccgtggtgggggatcgttcttctaggtagtctattgggattagcagggttccggcgcgaaaaacgacattaacttgcaggcgacagaacgagttatttatgaataaaatcaaaaatgagcagaccaattcggcgacgagttgatctgtttttttgatggtcgaagtagttgggcagcgagttatgacggtaaaactgctggattgcaccaataaatatgggggaaaagtactttttttaaaaatagcacaggccttaaatgggatgagaccgctttatttgacacatgaccgcaattaatcgcggctaaagcgggttaatgtgtcaagttggttaaccacattacggattgtcattttcggccgattttcttaatctgcgtgtaactcactaacaatcccgatgtaaccttcacgggttatgatgggtctcgttaagtaattgcaagacagtttcacccaaacaaaaggaggacattcatttttatgaatatcaaaaaagttttagtttctactttaggtaccgccgcagtattaggcgctgggttatttgccagcaccacttccgctaacgccgacgtccgggtaacggtgaaatcgggagacacggtggccaagattgccaaccaatataattcaagtgtttctgccattgaaacggccaacagtttaaagaatgttaatttaatctacgtcggtgaaagcctgtcagtgccgaatagcacgaccgcagctagcaccactgctgcaaccacggcgacgacgcaaagccaaagcacgacgccagctcagtcgacaactacgactagcaacagcgccaacacagcaacaaactatagtggcacagcaagccatacaacggctactacgggaacaacgagcactaacacggcagcaacaacgtcaacatctggctcgacatcttccgctaagtcatggattgctaacaaggaatctggtggttcttacaccgcgtctaacgggaactactatgggaagtaccaactgacgaagtccctgctaaacggtgactactcagctgccaaccaagaaaaggttgctaattcttacgttagctcacggtatggttcatgggccgctgccaagtctttctggcaagcaaatggctggtactaaaactagttaagacgttcacctaaaaaaatacacggaaacgacggtttagttcaaatgagctaaccgtcgttttgacgtggaaaacccctgataaaataggatttgtacaccatactgcaaaaaatggggtcgttcgttacacgtttgtaacatgcggacaatccacctgtaacttggaaaggttatgatattcttaacaattcgctgggagggaacctgattttgaaactcaagacaatttttatgttaatcgtcatggtcgtttcgatggctctgctcagcgtgacgtctgtggttacgccggcaacgacggctaaggccagtgtgacgtacgtttgcaacctatctaagaaagaaaagcgtgcgaaggcttggattgcccggaaagaatccggtggtaattaccgcgcacgaaatggtcgctattatggtaagtatcaactaacgatctcgatgcttcatggtgactacagtaaagcaaatcaagaaaagacggctgaccggtatgcccacagtcgttatggcacttggactcaggccaaacatcattggttgggctacgggtggttttaataaaaaaaggagtgatttccaggtaattggaaatcgctcctttttttggctgttgatgatacattagaagggttactgatggcggtaactcattacagaggccccaccccttattaaataggctgccactaaacccctagcggctgacgtttcatctctaagtgaaatttcaaaatgatgagtagattgaacccaatggtcatactaatcattgccagccaagcagctggcgtagcggtgttggtcgagataacggcagccttacttccccgttccccaatagcccagcgtggtcgtcgataagtgcgatcggcatcatacataacgactagcatcattttatgttgcttgagaaattgccattcactttttaacatcatacgccccccttttggctgaacagcctgttgattgaacgcctacagagtacctgcaaaattgcggccgagcaatcgtcaattttagtggaagtgttgggtagaaatggcgggtttcaagcgcggtctgcgcttggggtgagtcagttaggaaactagcagcttaacacaaaccgactagttgttgattgacaggtgccgaaaaaagatttctaatgtgggcagtaaaaggaagcaattgtggaggtggcattatggaagcagacgcgcaacgactacaaacggaaataaaactgcaacgggcgtttatcaaattggttggggagcaaggctttgagcgggtaaccgtgcggcaattgacaacggaagcgcagattaatcgcgggacgttttatctccactatttagacaagttcgatttactaacgcggtacgaaaatgatttggtcaatcaagttcacttgatcttccagcagtatccgaagcccaccgccacccaggcaggcgcaaaggatgcctttagtcagctattccgctacctgtatcgccagtggcaattggccgtaatcctattggaaagtcccgcgtcacagctgactaagcgcattaaaccgctaattcttgaggtgatcggtcaacccaagacaacgctgattcccgctgactatgcccgtgagctggtcgcccagggcgttttggactttattcgcttctggttaacgcagacgccggttcagtcgccacagcaggcatataccattttcacccgtagtcgagaattatcaccagcccagttgttgaattagggttggctgggccagaagctaagaacctaacttgactttattttcatttcctctaagctaaacttatcatgttaacgttttctttgcgatgaacatggtgtttatcgctaaattaatttggaggcaatgaagatggcatttcagatggtcacgcagtatgctcatagtccggaagatattgatcattacaatacggatgaattacgacagcagtttttaatggcagaaatatttgtaccaggtgatatccgcctgacatatacgtacaacgaccgtatgatttttggtggagtaaccccaacgacaacgcctttggaaatcaagcttgatcagcaactaggtgtggattatttcttgcaacgccgtgaactgggattcattaatatcgggggtgccggcacggtgacgattgatggtacgaccagtgatgtggcaccgcatgatggctactatattagtatggggacccaatcagtgctctttgcctcaacggatgcccaacaccccgccaagttttacgtggtgtcgacgcctacgcatcgggcttatcctagcaagcagttggcttttaaggatacgctggcaatgccgatgggtgaccaagcacatatgaataagcggaccatttataagtacattgatgcctcaactatggcgacttgtcagttgcaaatgggctacacggtcttggcgccggggaattcttggaataccatgccggcccatacgcatgcccggcgaatggaaacctacctatatactgagtttggtgatcctaatacgcgggtggcgcacttcttggggactcccgagaataccaagcacatctggttggagccggatcaggcggttgttaatcccagttattccattcactgcggggttgggacgaccaactatgccttcatttgggcaatgtgtggtgagaaccagacttacgatgatatggatgccgtggatatgcacgacttacgttagaaattaggtgatgagagatgacaaccagtatgtctggtgctgaagtggtgacgattggtgaaccactagccgtatttgccgcaactgagccgaatgtgtcgctagtagcggcccaacgttttcaaaagtttgttgccggagcagaattgaatgtggccgtggggttagcccgattgggtcattcggtgagttacgtgtcggccgtgggtcaagatccattgggtcaatttatcttggatcaactccaagcagcacacgttgatcatcaacatgttcaagtgagtgccgattattggactggtttttacttaaaacaacgggtaacccaaggcgatccggctacctattattatcgtaaaaattcggcagcggccaatcttgatccgcaggtgctggcgtcgctcgatttgactcacgtgaagttgggccatctttctggaatttttgccgcgttgtcaactaatgatcaggccatttatcgggagctgaaccggcgcttgttagcggtcggggcgaccgtggtctttgacccaaatctccgaccaacgctgtggccgagtcgtgccgagatgtgccgagtcaccaatcagttggctcgtgacgcgcagatcgtgttaccgggattaaatgaaggaaccattttgaccggagaagcagatcccgttgccattgcggatttttacctgcaacaaagtaccgtgacgcaggtggtcattgttaaattgggggctgcgggagcattgttgaaagtccgggggcaggcggcccagcgggttcccggggtgcacgtggattcagtcgtggataccgtcggtgccggtgatgggtttgctgtgggcttgattagtggcctgctggcgggggtaccgataaccgccgcggttcaacgggcctgtgctattggggcgttagccgttacgacgccgggcgataatgacggctacccgacgtcggcccagttaacccgtttttatcgtgagcatcaccttgaagcgtgactatcagcctgtcgcaacgttgtcgttgccggcaggttttttaataagttgaacttatcattgaaaacggttacatttttctttagactggaaagtaattgataatagattgggaggagtatcatgggaaaaacattagctatcaacgccgggagttcaacactgaaatggaaactatttgccatgccagaagaaacggtcattgcctcagggatggtcgatcgcttgaatttaccggggtccatcttcaaagttaaattagcggacgggcaaaagttcacggaaacgcaagataagattacgaataaactggctgcggcaatggtattgacccgactgaaatcttacgggattgtccagcacttgagtgaaattacgggagtgggccaccgcgttgtcgccgggggtgaggtgttcaaggattcagccgtcatcacgcccaccgtactgaagcaaattaaggaattgaaggactatgcgccgttacataacccagtgcaggcctattacattgatgtattccagcaattactgccagaagcgcagcaggtcgccgtctttgatacgtcgctgtatacacaaatgccggccatgaactacttgtatagcctgccgtatgcctattacgagaagtttggggcccgaaagtacggggcccacgggactagtcatcgttatgtggcgaagcggacggctgaactcttgggccagccgttagaggcgttaaaattaatcacgctgcatttggggtcggggtcatcgattactgccttcgatcatggtcaagcattggatacctcaatgggctttaccccattagccggtgtgatgatggggactcgttcgggggatgttgatccgtcgttagtcgcctatctagcagaaaaattacagaagacgatgccagaaatgatcgatattttgaatcaccagtcaggactcttgggtatctcggaattgtctcctgaccaacgggatttggaagacacccaagctgaccggccaaaatctaagctggctttagacatgtttgttaaccgggtcgtgcgttacgtcggtagctacgtggctgaactgggtggtgtggacgcgattgcctttacagctggatctggtgagaacggcattgcgatgcgacaagacattgcggaccagttggcgggactcaatattgcgattgacccggccaaaaatgatttccggggtgaggaacgggtgattagtccggatggcgcggccgttaaggtcttagtcgttccgaccaatgaggaattgatgattgttcgcgatgtggcgcgacttacccattaaactagataactggaccaatcgtgccagtgagtggtgattggcccggttgtttattggggaaccgaagccttaaaggcaaaatcccccaatctacagtaacagagctaggttagtaaaagcttaatggctaattttaactattttttgtagacaatgtcgattacgtaaaaatcatgccagtttgtcatgaaaatcggattaccttaaccaagcagtaacgttaaactaatcgatttgagatatgggcgttgtaagctagggtcaatcaaaaggaggaacgatttaatgataaaaaaagtgattttaacgaccgtgagtgcggcggcagtcttggcagccggtatcggtttttctaacgtaactgccaatgccgcgacggtccaagtaccggcacaaagctatcattatcaacctcaaacagccaccaatggcacagcgccgacaacaaagaccaatcaaacagtcgcaacgacgacaactaacagtaccactaacactactacaacgagtcaggcaaccggggcgacgattacggaagccgcctttgaatcccaaggggtcgtttatttgaatggaaataaatggacttattattcaggtagcacaaccgccgatggcactaatatcagtgccaatgggttagattcaaatggctaccgggtcgtggcagcaccggcaagcgttgcctttggcacaaaaattatgacgccattaggaatgggggttgtgcatgaccgcgggacggccatcaccggcaaccattacgatgtcgtcattcaatagattagaaagcgcaccccgagacaactgtctaagggtgcgctttttatcgtggttaacggagctggagatctcgccggtggtagcccagccagcccaggaataagactaggacactcaaagccaccatccaactaaatgtggtccaattgaccgcatgaacgggaacgcggggcatccacccggtaggcgccaagcgttggacccaagtcggtaattggaggagaccacccatgtagaccgcgataaagcctagtgcgaggtagccccaactgagtgccttaatgcgcggcacccagccgactaaacccactcccagcgccaaaaatacccagatcatggggagttgagcagcgatggtttgccaaaattcggcggtgctaatgccatcttgaacatggtcaaggctagcatttccagtcacaataacaccggcgaggccaccaatgtaagccacggtgctcaagcccaaggcactgctaacgtaactgaccaacaggcgcgaacgactgagtggtcgtgcatacagggcctccaaccagccatgcgtttcgtccgtatgcagttctaaaactaactgtagaccgggtataacggccacactagccatgacaatagctagcagactagtgaaattcagtagaatttgatgattggcatcgtgaaccattgctcggccgaagacttgttgcatggtgggattggtttttaaaatgttaccgattgtgttaaagacggtaccatatgccaccccaaagagggtaattcccaataaccagccaataaaaatattgcgttgttggcgccagatgagggagagcggaccccgtaacaacggagaagccgttcgacgtcccggtcgagtggtcaaagcgccagaacctaagtcccggtgtgcattggcaaaaatcgtacatcccaaaatcacgaacgttaaaagcaagctgagacccacgggtgtccaattgggatgctggtaaggactgagtttttcaatccaaccaagtggtgaccaccaagtggactgggggtgctgaacgtcagtgatcatccgagccaagtaactgattccaaacagggcataggcgagaccagtggcactagcggcatggtcggtcaactgggcagttaacacccccacagtgccaaatagcagaccagttgtcccgagtcctaagccaatcagccagttcccactggtggtcgctccgggcatgtgggtcagttggagccctagaccgtatagaacgctgagtccaccattgataatgaccagttctcccattgccgcagctagtggggctagtgccccgacagtatgggcgcgaataagttcggtcacaccttgatcttcatcgctacgggtggcgtggatacttagcgtcaggttcatgattacttggattagggccatgaacaataacatttcgttagcaaaaatttcggcagtggtgacgcggccagtgaaacgaaaggcgccaaacatcgcgacaattccgggactagccaacgtttggcgaatcgccgcaatctcgtgaggggtgccgtagataccgtcaaatttagccgcaacactggccatgagggcagccagtaccacaatccaaatgacgattcgccagcgatcacgccggcagttcaaacggagtaataaaccagttttatggtattgagacattgtgatcactcctttgcgtagtagtgcatgaagagatcttcaagggttggtggcgtgctttggagcgccgcaatgtgatgttcagctaatgtggtcatcgtggcggctaagctatcggcatcaactgaaaattgccactcgcgtgcggcgtgtccgggcgtaacggcatgtaaaccgggaagggtggtgacatcgaagtcatcgcccaacgtgacggctactgtggtccgcgttaggtgacgcattgcagcgagactaccggtttcaatgatttgaccctcacgaataatcccaatgcgatcacacatgcgttccacttctgacagaatatgactggataatagcactgcctttccccgttttttaagcgccagtactgctgcttgaaaaagccgctcgttaagtgggtctagccctgaagttggctcatcaaagatgtagaagtcagcctcctgggagagcgcggcaatgagggccaccttttggcgattacctttggaataggtccgggccttcttggtgggatctaatccaaattggtgaatcagggtatccgtttgagtcgtgtgggcttggtcgttcattcggagcagcaggtcgatgatctcgccgccagttaggttaggccagagatagacatcgccgggaacgtaagccaatcgctgatgaatctgaacactatcctgccagacgggccgaccgaagagagtggcggtaccaccactggcccgaatgagcccaagtaagatgcgaatcgtcgtggatttaccagcaccgttagggccgataaaaccaaagacttcaccgggatagacgtcaaaggtgacgtcctttaaggcacgaaaatggccaaagtttttttgcaaatgctgtaggtgcaagagtggtgtggtgctcatgagtcattccccctaacgagtctgaaatcgattacatcgtaagcttatcgctaagggaagtcaatgtgaacgccctttatggaacggtgactaaattttgctcagtggtatgctaaaatagaggcagacgttagggcgaaccggtagccctggcaaggaggaaaacggatgacaacgacagttttagcagcagtgcggcaattttcacaagccaaaatgggggatgatgagacgggccacggattcgaccatattcaacgggtcgtggggttggcggatcgtttggtacaggcctacccgcaagccgatcgggttttaacactgacggccgcttatttacacgatgtgattgacgaaaaattggtcacagatactgtcgcggccagtgacgaggtgcggcagttcttgaaccaacaagggttaaccgctgaacaggtagccacggtcttcttgattatggataatatgtcataccataagacactggatggtacagccaagccactgccattagaaggccaaattgtgcaagatgcagatcgcttagatgcgattggggcaatcggcattgcacgagccatttactttggcggtcactttggtgagaaaatttatgatccggcggtagaaccgcggacagccatgactcacgcggagtatcgcaatcttaatcatgaaactatcatcaaccacttttatgaaaaactgctgacgctaaaggacttgatgaatacgacagccgctaaaaaattggctgaacaccgccaacaagtcatgcttgatttcttggcagagtataaagcagaatggaacgcagaggcttaggcccctgtttttttatggcttaagtagaccacgcttgctaataaatcggcaaatgaagccacaataaatcagggagatcaaccaggctaatggattggcgtagcaaatagcgacgaagccaagtggcgtcagggctaatagactagcgaccagccggccggccaattcaccaaatccggagacgatagcataaaagctgtggccccagccttgaatggtattccgaaagatcattagtaaaccatgcactgggaagaagaaggcaatgatggtgagatattgtagggcacttgcggtggtggtaggtgacccgttacctaaaatagcagtgactaaggcccgtcgactgaaccataagatgccaaaggcgccaaatgaatagatgatttggatgagacaaccatttaagatgccccgcttaatccgatcccgattccgggcaccgaagttttgggcttgataggtggccatcgctgcgcccacactttccatggggagcgtgaacaattgacgaatcttatcagcggccgattgtgctgccatgatagctgagcctagttggttgatggcatcttgcatgataatggccccgatggcggatactgaatattcgaaccccattggtaggccaatggcacacatgcgtttgagcttggcccaggaaatccgccaatcagacgacgttagttttaattgattctggccccaaaagaagcgcgagaggttcagtaacccgccgataaactcactgattaccgttgcccaagcagcgccagcgatgcctaaatgaaactgacaaatgaacagtaaatctaaaacaacgttcacaatcagtgaaaatacgaggaagtgcaacgggtgaattgcgtcaccaaaagcgcgtagggccgctgccgaataattaaataagatattggcggggatgccgatgaaggaaattagtgtaaaggtttcggccattgctaggatgttattgggcgtgttcagccattgaaggaagtagttggtgcctaaaatcatcagtggcgtcagcaggaggcatagcccaccgcttaaccacaccccgttggtaaaataagaccgggtggtggtggccgttttggcgcccacgctttgagacagggggatgctaaatccaatgcaactgccttgaacgaatcctagaattagaaagctaaggggatagtaggcccccactgcggccaccgcatcaatgccaatcagtcggccgacaatcagcgtatcaatgaagttatagagttgttggaagaggtgacccgccaattaagggcaacgaaaataaaagtaagcgtcgcaggggactaccagtcgttagatctaattgattcatgccatcactccttgaatacaggatagtaataatggggaaccaccgtcatacaccggtagttccccattattcattgaaaaattttagtcggttgcgccttacttttggtcaaagaaaccaaaataatcgtgggcgttattatacgaaatatcttcgacaatcttgccaagataagcgtcatcgtctggaacctgaccgcgaaccacccattcaccgatcagatcacagagaacccgacggaagtattcgtgccgtggataggaaaggaagctccgcgaatcggttagcatccccacgaagtttggcaagagactttgttgcgccatgattcgtagttggtcatgcatgccttcgcgggtgtcgttgaaccaccaagcacagcccaactgcatcttttgagtgacgccaccttggaagctttgcatccccgttgctaattcgagccaatcattcgggttggttgagaagaagatcgttttaggaatattattttcctcagccatatcactcattaattgcatcagttcaccggcaatgcctggttgtgaacccatggaatcgaaaccggcatcggcacctaatttgcggaacataggaccatttgcattgcgcaaaacattgacgtggaattgcatggtccagccaaattgcttattcaagcgcattagggcttctagtagggccgtttggtatccgtcgatgtcggccgcactgaggttttgattgtcttgacgggctttatcaatgatctggttcaattcaggcttggaagccttccggaagtgatacgtgttgagaccatgatcggagaggtgaccgcctaatgagttgaagaagtcaaagcgctgggccaaagcggcaaccaaggaatcaaaatcagtaatcgtgacaccagagacgtcacttaactggcgcaggtaagcgtcgtagtccccttgattaatccgtagggcgttatccggccgcattgctggcaagactttgaaaccgttagttgcttcttcttgcttgagcagttggtgataatgcaaatcagaagcaggatcatcagtcgtgcagacgactttaacgttagactttttgattaaattccgtggcttgaagtcgtcagtctttaacaacgcattggctttttcccaaatggccggagcatttttggtggtaaaaggttcatcgatgccaaagaagcgcttcagttccaaatgggtccattcatatagaggattgccaatggctttttcaatcgtgcccgcccaagctagaaacttgtcatattcatcgccatcaccggtgatgaggtcttcagggaccccgttggcccgttccaatcgccacttgtagtggtcgcccaaactaccatcgtttaaccagatacgggtgatgtttgggtaattcttgttttcgtaaatgtcttttggttctaggtgacagtggtaatcaatgatcggcattttttcggcgtgttcgtggtagagccgtttggcaggctcattggttaatagaaaatcttcgtttaataatgtcatgataaaattcctctttctatgacagatggttttgataaattaaacgctttcatttgttagatggtcaggcgcttatttattttcttcagcggcattttctgcgtgaatttcagctaatttagcagcattggcattaacgcgcttcttgctcagtgggtagaagaccaataggatcaagccggctaagaagaggcagaccgttgggacaccagttgctaacgtgtagatatggttaataacggtggtcgtttgatcagcgccaccaccagtggaggacttgtaaccgatgaaggtcaacatgaaaccaccgaaaccaccggcgattgcttgggcaactttacgggcaaatgagttaaccccgtaaacgataccgtcttcacggacacccgttaagacttcatggttatcaataacatcggtaataaaggcccaaaccattaagttgaagaccccggcacctaaggaaccaaagaataacataaccaagtagaacagggagctttgggtgtggacgatcattaaagttccataaatggcagctccaataaataaggccacaatcgaacattctttccggccaaaagtccgggtcatccaggtactgaatggcgcaagtaaaataaccgtagcaaagttgaagatcaaagcaatccctaaggctttggtatccttaaagtagtcattaaacaggtaagtcagtagcgttcctgagaggttttggttgatgacgattaaaatatccacgacaactaaaacaaccagtgcccggttctcaaacatccctttaacaacgctagctaaaggtacattttcggacttttcagttcgtacccgttcggtagtcagtgcggtggtcagcgtgtagcaggcccaggcaatcagggcacagccaaccacaacccagaagaagcggctgccagaaatcttttgtgaggcgccgatatagatgaacattgggacaatatagctggttaaggcactaccaacagcggaaccaatggcccggaatgttgacagtgaggttttatcgttaggatcaccactaatggcagaggccattgaaccataagggatattgacggaggagtagaaaattccccaacccaagtacgtgatgaagacgtagacgagtcgtgctggcaaagcccagtccttaacaatcggcacgaaggttagaataaaggcaatgagtaagggatacttcatgcgattaatccatggcttgaagcgcccactcttatgtagcttactgttgtcgactaaccggccaaccgtgatatcggcaaaggcatcgacgaagcgggcggttaagaagaggatccctacttgggcccccgttaaccctaaaacgttggtgtagaaaatcattaagaaggaattgatgatgttgaaggagaagttattcccaatatcaccaaacatgtagccaattcggtctttaatattgaaaggcgcagcagccacagtgatggttttttgtgttttttccaatgtctgacacttcctaaaatataaattatgatgagggtacaggttgttagataaaagcaaaatacggttagacgtttaactcataggcaaatctccttcaaaactgatatataagctatccacagaatagcacgttcagaaaccgctttcaaggataaatgacaaaaatcacgaagtgaaataaaattggctttatttaaaaaaatggttaaccaatcccgttatattaacgtttatactttaatcgatagtgacctttaattattaaaaagatggttgacagcgcttccaaaagattttaaagtatcactagagacacatttctgatataccacctaacctgctttggaggcgcattatgaaagttagctcaaaattgctgagtatcaccaaccatcatgagtatcttgatttagttacagacggcgcaaagtttagaatttacttactagatgagaatattattcgcatccggggaacgtttgatgatgacttcgcgccagaagagtcctacgcactggttaagacggcgtggtcggatgcaaccgatgacctaatcggtgacgagcggcaacgggtaaccccgattgcggttgaattgacggaaacggctgacggttatacggtgtcaaacggtcgctacacgttggaaattcatgcagagcctttctattttgaaattaaagatcaaaatggtgtgacggtgcataaggatctcgtgaaacggtcctttgtccaggatgatttaggtcgtcgtttccactacagtgccatgggcgatcacgataagttttacggatttggtgagaagtccggcaaacttaataaatttaaacggcgtatgcgcatgcacaacacggattctttaggttggaatgccgctaagtcagatccgttgtataaaatgattcccttctatattgatttcaacacgacgactaatatcgcgagtggcttgtactacaacaacacgcacgactcggtctttgatatggactgtgaacacagtaactactggttacgttacagttatttccagtgtgatggtggcgatctagatgtcttcttcattggtggccctaccattaagcaagtggtcgagcactatacggatttgacgggaaaatcagccatgatgccattgccatcgctgggctatatgggctcaaccatgttttacacggaactggatcaggatgccgatcaagccatcctggactttatcgatacgtgtaagaaaaacgggattccgtgtgatggcttcttcctatcttcggggtatacctcgggcaaggatggcaaacggtacgtctttaattggaataagaaacgtttccctgatccacaaaaatttgtggcggaactcaagaagcgcggcgcactgttagctcccaatattaaaccagggatgctggtgactcacccattagccgatgagtttatggaaaaggatgcttacatcaagacgcccgatggtcaagggagccaagtcgaccagtattggggtggcgatgcccactttgttgactttaccaatccccatggtcgggatgcttgggagcaaaaaatgacggaggccttgctatcaattggcattacctcgatttggaatgataataacgagtatgaaatcaatgatacgcaggccgtagtggatgccgaaggacaaaagagcacgattggtgcgctaaagccgattatgccgacgatgatggctaaggcagctaaggatgccattaatcgttatgacgcaacggttcgcccgtatctagtcaaccgagcaggatttgccggcattcaacggtatgcccaaacgtgggctggtgataactacacgagctggacgaatgtgaaatataatattcccactattctaggcatggggttgtcaggagtggcgaaccagggttgtgacattggtgggttcgatggcccgctacctgaaccagaactctttgttcggtgggttcaaaatggtattttccagccaagattctccattcactcttgcaacaatgataatacggtcacagaaccctggacgtatccggcttacaccaagtacatcagggcagcaattcagttgcggtattctttggtgccgtacctgtactcactgctgtatgaagcctcaacgaaaggctcaccgatcatgcggccattagtttatgaattccaagacgatccgcaggtggcggaagaaagttttgaatttatgttaggcgcttcgttattggtggctaacgttgttgacaagggtcaaaccgctaagtcagtctacctgccagcgggagtggattggttagatctgaagacgtcccagtattatacgggtggtcagacgatcacgattccggtagatttagggagcattccgatgttcttgaaagccgggagcatcgttcctcaaagtaagggactgatgaacctgcataatgacgtgatcgacaagctggatgtgttaattgaaccaagtcgcgatgctgaatttgtggtgtatgaagatgacggagtaacaaataattaccgccaaggcgaaaccttagaaacgaccatcaaaacgacggcaacagctgacggcgttgtgattgattttagtcgggttggccagtatcaaacgcaagttaaaaccatggcactagcagtttgctgtccgaagattgcgccgttaagtgttgatttagccgaccaatccttgccacggtacctcaatgcggctaagttcgcgaatgccgctgagggttggtactttgatggcgaaagtcgccaggttcaaattaaatatgctaatcccgaagtggctggttatgccgtaaaggttaactttagtgtgaaggatttaatttcgatttagttgtgtagactcataatttgagtttaataggtcattggtgcattttttaatcgggtagatattaactataggttagtcacttgaaacacaagatgggcatagactgctataaataaaggcagctggtaagaagtcaaaaattcttaccagctgccttttaatatatagaaacccggtatgtcacagttgaactacttaacaactaaacttaatgcaagtacaacgagtagaccaacgaaagaattaacgaattctagggcgccccatgtcttaaatgtatccttgagagaaatgccgaatgattgttggaacaagagaaaaccaccatcgtacattaaagtagttgtattgctaccgcaagcacaagctaagaccatgagaacaggactgacatgaaaggccgcaatcatgggtgccacaataccggcagcagtaattgcggcgacggctccctgaccagttaaaatacggattaggacggtaatcaaccatgcaagaataagtggtgatacgggaaaatggccgaccaaactgacaatccgcgagccaatacccgtatcgataatgacttgtttcatgacgccaccagcggcgatgactaaaagaacgtttgaaatgccttcaatggcagcggtcagatgttttgtaatttgggtttcgctttgtccacgacggtagccaaagacccacatagcgactaaaacagtgatgagcatactaatttcagcgctaccaatgaaagttgccagcttatatataagcgagttttgactgacaaagagcttacagattgaggcgatgatcatcattaaggctggtagaagtggaacgagaatactaattgcaaagctcggaagatctgatgccggccgcttttgagcgggcttcatcacatttcctaagggcatgtcattcaatccggggataaagtaacgaatcaaaataccggagcagatgatggttggtactatgacaatgaaaccaaatatataaacctgcacaatatctgcatggaatgcagtgactaaggccatgggcccaggttggggtgggaaaatactatggcccatagtagcgcccgcaatagttggaatgattagacgcatgtaagggatctttgcttcttgagcgatactaattactagcggaacggtaatcaagaaagccacctcatagaacattgacatcccgaagatggtcccaatgattagtaaagcaaatggcaaaagtttaatccccattttagccacaatcgtatcagctatttgttgagatgcacctgattcggtcatcaatttaccaataattgcgccaaaaataacgatgagtgcgagtgtggacaggacgccgcctaagccggtctcaatggtagggacgattttggttaaagacattccttctgcaaaagcaataaataaagcagagataagtaaggccacaatgttatgcatttttaatttaacaatcatgaaaactaatagggtgataccaacaaccacccaggttaaagccagtagatttgctcccaacggtaaaacctcctaaggatttagagaaagaaaaaagcagactagttcactaaaacgaacataaaaagaattcccccgattttaaatggatgtgttagataattaggccaacaaatctcacaatcgtggggaactttcaatgactaaagactctgaaaatttaaaaacaatgcagtatctgatgagatttctaaatgttcacaaaggttgcttgaatctgtttatactctttcatgtatttcttagcgttctgagtgacgtcagcaaaatcatcattggctgccggagctgttagaccaccaccagcaccaacaacgacggcgccagccgcaaaccagtcactcatattttgaacattgacgccaccagatggcatgacatttaggcatgggaatgggccatgatattccttgatggccacagtgccagccatcgcaccggggaataatttaacaacttcagagccatacttcaaagcggcttgggcttcagtaacggtataagttccaggaacgtaagggacttgatagaggttacacattagcgcgacttctttgtcgaaagtcggactaacaatgaactgggcaccggcaatgatggctaatcgagcggaagtggcgtctagaacggtgccggctccgacaacaacgtcagaatcggaatacttcccaactaagtcactgatgacagtgtcagcatgcgggacgctgtatgtcagttctagacctgtaataccaccggcaatcacagcatcagcaactttaatggccttctctggggtttcggcacgaattaccgcgatcacaccagtatcaatcatactttgtaataagtttgctcttttcataaattttagccttcctattctgtaatttgttgattctgcaagtagctattaagttcatccgatgttgggtagccatcgttatcaccaggactcatgacagctaaagcaccaattgcgcaaccacggcgagcggccttgttaattggcagtccatctaataatccggaaattaggccaactgcgaaaccgtccccagcaccaaccgtatcaacgacgttcttaacatgaaaaccggggatggtttgtgcattaccatttttctgtttgatgtaggcgcccttaggtcctaatttcacaatgacggtttgtgttgtttggctctgattcaaataaaaatcagcaattttttgaggattagaagaacccatcaagatttctccctcatgaatgccaggcatgaccaggtcggcatgtttagccaactcgttggttgtcgcgaccatgtgcgcttgggattcccaaagtgcgggacgaaggttgggatcaaaggtaatgaacttaccgttttgctttagatgttgacccaaccgcttgagtacagccaagtcattatcagatagagcagcaaagatcccggataaatgggcaatttgaacatcgctaaaatcaatgatatccagaatgtttgcatcaaagttagcggcggctgagttccttctgaaataaaaggttgcgggatcaccgtggctaacacgttcctttaaataaaatccagtccaatggtcaacatcttcactgacataggtgttgccaacgccagccgcggtcatagatttacgaatgaatttaccaaacggatcttgaccaactgatgaaatatattccgtccggtgccctagtcgtgatatgccaatggcgacatttaattcggcgcccgcaacaaattttgtaaagtcggtcgcatcttctaagtttttgtcgatattagacgatgcaaagacggccatgggctcgccaattgttaaaaattcagccatgtatcttcctcttttctatggtgatgtcgattgtaaaaataaaagggatgcgagctattcgcgtcccttttatctaggcaaacttaatcgttgaagaagccgaagtaattacgggcgttctcgtaactaattcgcttcacgattttaccgagatactcgagatcgttaggtgcttgaccgcgggcgacccattgcccgataacgtcacacattacacgacggaagtattcgtgacgaggataggataagaaggaacggctatcggttaacattcccaagaagttcggaaacataccagtattggcataaagtttcatctgatcttccatgccgtcacgggtatcgttgtaccaccagccagcaccgaggtgcattttttgtacagagccttcttggaaattacccagtaaggtagcaatagccatccaatcattaggatttagcgagtagaagatagttttcggaagaatccccttagtttgggcatcgtagaataaacggcgaacttgttcggttaggtcagcttgggttccaacagaatcaaaaccagtgttgggaccgatcttatcgaacatgggtttgttctgtgagcgagctacattaacatggtattgtagaacccagtcgtgcttttgagcgagttgcatcattgtttcaaccagtgcagtcgtgaacttattaagatcatcagtagatagggctttattagccaagcctttagcaaaaatgatttcaagatcattagccgatgcatcagcatagtggtaagtgttcaagccaaggtcggcgatcttaccaccatgatcggcaaagaactggacacgttgttccatagcggcagtaagcgttttgaagctcgagatggtgataccggctgcggcacctaagcgctttaaatagtcggcataagtatcggcggtaatattgaatgcctcatcaggacgcattccagggagtaccttgaatgccaaatgttcatcagccagcagttcatgatactttaggtcagattctggggcgtcagttgtgacaaccacctgaacattggagcgggcaatcagagcgcggggagtaaaggatggtgtagccagttgttggttagcttcatcccaaatttcttttgccgtgcttggatcaagtcgactattgattccaaagaagcgacgtaattccagatgagtccattcatacagcggggaccctaatgaatcgttgatcgtttgggcccatgctacgaatttgtcgtagtcgtcaccatcgccagtgatcaaattttcaggaacgccatggtcacgctctaaacgccacttataatggtcaccatataacccttcattgatccaaatctgagaaatgttttcgtaatttttgttttcatagatttcctttggttctagatgacagtggtaatcaatgatcggttcgttctgggcatattcatggaatagtttcttagcaacgccggtagttaatagaaaatcatcattcaataaagtcataagagttacgcctcgatttctttgcctaattcatttaataacgctacccaagacatcttgccttgatacttgatatccatactggcaacaaaacgtgttagaattccttgggttttctcactgtaattggctttaaccgtctgtaaggcctcattaattcgtaggtcctcccattgcatgtaggcttgactagcccaggatgttccgttgaaaactaaggcgaatgtatctgggtgaagcattttttcaagatcagtattggtattaagatcaatgtcactgagattgattttagcgggcgcgtcactgttaaatgtttgagtcaaaagcttttgtttgggttgattataaataataacggttgtaggcattggttactcactccttagatttgtcagtttgtgattcttcatatgtttcgtcaggccacagctcatcatatgggtgtcccgttagctcctcggcaacttgtttggcttcaggggttacatcgcgtttgttaccaccatcttccaaacgattaatttcaccttgtaacacggcatgagtttgacggttcaacttgaacgtccatgagaccactaacgcaatgataattaagagtaatggtgcaatgacgaagagcaaggcaatcttgtcggtgatgccaggtgcttgagtggtagcggtggagacatagccgagagcttccaataaaatcccagcaatccaagtagccaatgcgccggttgatttgcggaagaaggtcataactgcggcgtaggtaccggctttatcaccacgagtcatgatacgatcgacatcagggataaatgggaaaacgttccatggtgtaaattcaagaatcccccgagataattgataaacgatcgtaataataattaagatggtcaatggattcttaacgtgcatgaagtaagttatcccataagcaatcaaagcaacaataatgcctatgtaggacaggctgtaaaggaatcggggaccgtgagtaatcattaacttagcagcggctaaggttgataaaattccaaagacagcaaaggcgttgagaacccaagggatattggaagccatgcccatgcagacaacgatgaatgttggtaacaaggtcgcgtagaagtctttccctgtgaacgagaaaatatagatggttaaatgcttgctaaaagctaagtttcggaaagtctggccgtagtcgtgcaatgtttctttaatatattggccaacagttagctttgggcgtgcatcgagttcagcgataaattccttagtcagtggacgttcccaagtactgcgataagagatatagatggcaacgacaaataaaacagtccaaagaataccggcaaaaaggtaagcatttttcttcgcttcagcactgggtaaggattgcagaatggctaagataaagaacactagtgaagtcccagtagcggagataaacattcgggagccagaaagtacggttcgcttcgtgtagtcggttgtcatttctgttggtaaagtttcccaagggatcaggatcattccaacaaagagttctgttagtgtataaaccactaggtaatagacgaattcatgacccggtccaaaaattgaagtggctggtacccagaaggctaggaaagaaatggcaaaaccaatcatgccaatgaacatccaaaaatgtcgacgaccatactttttaccaagatttgttttatagaaaccgtcagtgatggttccgaaaatcaaacaaaagatagcatcgaagacccgagcgatacctgtgattgccccagccattgcgggattcagaccgacagaaagtgttaaataagcgaagatgacacctgaaacaatgttgttccagccaccgcccatgagatcagttaaaccgtaagcaaccccacgcttaacgttgatatccttgggagtgtagacccagcgactattgcccataataatttcatcctttcgaagtaacagtactttcgaatatttcggaaactgaaatattagtatatctgaatacgctttcattctattcggttttcaaataaagtcaacgatttttttgtgaatgttcattcaaacaacacaaaaagggaataaaaaagcgccgcttcagtgcgaagcggcgcctttagtgaacagtgaaatatttatttgatttacttttgggaataattattcaaagaagtctggatggagttttaatgccaccttaatatcgtcatcgaccatatgtagatgacgactgacacaagtttcggcgcgggtggggactttatcagcaatggcagccacaatagcacgatggtcgtcgaagatttgttgccagtcgagatccgcgacttctaaacgaaggtaacgaaatcggttaaattgaaggttaacaacttgtaaccaattccaaacaaattctttgtgatcaattttataaaatgtttggtgaaaggattcatcaagattaaaaaaccgatcataatctttagaatggagttggagttcttgtaactgaatcaaatatcgcagctcatctaggtcagattcggtgatatgactaattatttccgcgacaactaacttttcaatattttcacgcacaaagcgcgcttgatagacttcatcaacactgatcttagacacataagtgccactttgtgggcgaactaggagcagaccttcacgacttaaccgcaaaaatgcttcgcgaagtggggttgcaccaatcgagagctcgtcttgtaaatcttttttattaatacgatcaccgggcctgagctctagatgtagaattttattacgaatggcaacgtatgcctcatcttgataatttgttatttcgaccatctgggactccccctgaatatttttcaactaaagtataccaattttgccggttataaacaaaatttaatttggggttgtaatcgatttcagtaggtgttaatattttcatggaaactgatatattaatataataagtatacactgaatttgaatgaaatacgttactatgatgtgcgtgtttggtggtagtcgtgatcaggcgtttatgttgatggtaaagtttattttggtagttctatgctaaggctagctaagttttgttactcatagaagagtattatcgatgcacacgctaggttaaaaaacagcaactaaaaaattgcatgtagaggtaggagaatggacctatgaagaatatgggatttcgttggtatgggccagatgatgacccgattaccttaaaaaacattcgtcaaattcctggaacgattcaggttgttggcgcgctgtttgatgtaccggttggtgaagtttggccaaaagaaaaaattgccaagcttaagaaagaagttgaagatgccggcctgaaattagaagttatcgagtcggttaacatccacgatgacattaaaatcgggaagccaactcgtgatcaatatattgaaaattacaaacagacgattcgtaatttagccgagtatggcatcaaagttatttgttataattttatgccagttttcgattggttacggacagacttgcactatatcttggaagatggttctaacgttatggcgtttgagtcaagaatgttggccgatgaccctcaagaaatcatcgattctacccgtaacggcgctaatgggtatgctcttccaggttgggagccgaaacgattagcgaccattgaaggccttttcgatgcctataaagatgttgatgaaaccaaattacgtgagaatatgaagtacttcttagatgctatcatcccgacttgtgaggaatgtgatgttcggatggccatgcatccagatgatccgccgcgtttattatttggtttacctcgtatttacaagaacgccgaggatatgcgcgcgattgaagccatgcatgaatctaaatataatggttttacgatttgtacgggttctctaggagaaaatccgaagaatgatgtgccagctatcattcgtgagtttgttaagaaggatcgtgcgccattcattcacgctcgtaatattaagtttatgaataatcagggggactttcacgaatcggcgcattttagtgagtgcggtagtttagatatgtataaaattatgaaggctttgcacgatacaaactttgatggttacattcgtcctgatcatgggcgtaatatctggggtgaagacggcgtgccaggttatggtttatacgaccgggctctaggaatttcttacctgaatggtctttgggaggcgctggaaaaaaataagtaaagcctcgtgtcgttgaatatcataactgtcttgtaagtttggtttggaggcccgtttattttcggattgggtctcctttttatgtctaagtagcaaggcagcgtcagtcactgattaattggattaaaatataaggacgaatggatttgaagaatctattttccgtggtatactagtttttgtagatgaatgttcacggtaacattacttgtttaaaggcaattaaagggtattttgttttaaattattgacgtggttaactgatgtattagatttcgtaaaaattttaaaaaatgttgctttagataaagcttattattgcacactttgttaggtgtgccgggcagtaaggctgattaaatgggccttgacattttgtttttttattgtaatatgaaatcggttacaaacgaatactgatatataagttataagcgatagtcatttggttcattaaggttattgagtgcatgtttttatcagaaaggacgtattgacatggttaaattaactgacgattacttaaataataaagcagcgtttgaacaagctggaatcaaggttcccacttacgatcaagctgccctaaaacaagcaacggctgatcatcctcgctgggttcactttggtggtggtaacttattccgggcgttccacgcggccattgcgaataccttaattgaaaaaggtgaattggattctggcgtgattgttggtgaaacttacgatgacgatgttgttaaagatatttaccaagcctataacaaccggatcttacgggttgtgacgaaagctgatggtaactttgacaaagaattatttgcatctgttgcggaagcttacttctttaatccaagccacgaagatgactggaacaacttgtttgatgtctttaagaaggattctttgcaggtggttacgttctcgattactgaaaagggttataaccttcggaccgttaatggtgatttaaatgacctcaccaaggccgatatcgctaatggccccgaaaaacctaggggcaacatggcgggattagtttccttattattggcgcgttttaacaatggtaaggcaccactggctctcttgagtaccgataacttctcacaaaatggtgatcgcttaaaagaaagcgttttaactattgctaaaggctggcaagaaaatgggtttgttggcgctgacttcttagcttacttacaagacccacaacaaattagcttcccattatccatgattgaccggattacccctaatcctgccgaagctgttggagacaaactagccgctgctggctttgaagatcatgagattgtgcacacgcctaagcatacgaatattgcgccatttactaacacggaagaagcacactacttagtcgttgaagatgcctttccaaatggccggccaaagtttgaagatgctggtgtgattgtgactgaccgtgacacggttaacgatgctgatgaaatgaaagtaacgacttgtctgaatcctttgcacaccgcgctagccatctttgggagcgttctgggctttgattccattgccaaggagctccaaaacaaagacttagttgctttaatcaagcaaattggttacgtcgaaggcttaccagttgtgactgatcctaaggtgattaacccgaaggacttcatcaaccaattagtcacgaagcgcttgcctaacccatacatccctgatacgccacaacggattgcaaccgatacctcacagaagattccagttcggtatggtgtcacaatcaagcactacgatgaacgcgatggttttgacccagcaaccttggaattcattccattgacgattgccgcttggttccgttacctgatggctgtcaatgatgaaggcgctagcttcgaaccgagtcctgacccaatgatggccgacttacagaagtatgttggtgatatcaagttgggtgatgacgtggatgtccacgcccacttgaaggatgttttgacgaatacgtcgatctttggtcaagatctctatgcagttggtctaggcgaaaaggttgaaaattactttaagcaaatgattgcgggtaaaggtgccattgttgccacgctagaaaaagctttagctgatcacgcccaagcagttgactaggcaaaggagccgatatcatggtaacgattcaaaatgatcgtttcacagcaactatcaatgaagtgggcgcggaactcactcatttagtggaccaagcaagccaccgggacctgatctggaacaacgatttgtggccgaaacacgcgccagtattatttccggcaatcgggcggtcgaatgaagacagctatctgattgatggtcagagatatgaaatgccccaacacggctttgtcagtggcgagacatttatgattgttgatcagactccaacggcagtgacgctttcgttgacggccaatgccgcaacgcgggtgtactatccctttgattttgaactgcaagtgacctttacgttagttgcaactggcttgaacctaacctttagtgttcaaaatcacgggcaacaggatttatcttattcgttaggatcacatccggcatttaacgtcccatttgaggccggggaagcctttacggattatgaattagtcctcgatccagccccaacggacttgcaacaatttgaaattgttaaaacccctaatccttatcgaggcggcaaagagttaccggtgacgacagataagggggtcattaaacttaactatccgatgtttgatgccggcttaattattttaaaggcgcctaacttagcgcaccttacgctacagtcaacgaagtccaagcatagcatttctctgaatttggatgactttgattacgtgacattgtggaccaaggaaggtgctcaagcgccattcctgtgtttggagccctttaatgggttgccagatgtggcgggtgatctgcgtgaactagcgactaaggaaggcaatcatcacgtcgctgtgggtcaatccgaaacgatggcttatacgattacggtggattaactgctaaggagggatcacagatgaagaccattaccgttgactttgtccgtcacggtcaaacgattttcaatacaatgaataaattgcaaggctgggccgactcaccactgactaaggccgggattgcgacagctgatcaggctgggcaactcctaaagaatgtgacctatcaggccacctatgcctctgatctaaagcgggcaatggatacggcacagcatattctccaacccaatgcttttaccggggagttgcaaaccgacacggcctttcgggaagtcttctttgggtcctttgaaggtttagataacgatgagtcttggcaaacggttggtcagtccctaggttgtcaaacccaagcgcagatcattcagaagtattcatttgaggcggctagagatgccatgcatcaagcggacccgcgccagctatcggaaaatgggttgacgtttaaacggcgggtcgatgctgggttacaacggttattatcccgttatgccgatcaggaccgcattctggtggtgacccatggcacttttatccgttcactggttttgcgctttgggcctcaattcgatgtgttatccagctttccggctaatggtggggtgacaaccttacaactcactacggccaatccgggattcgatggcctagttactagctacaaccgacttagttaatgagagaataaaaatttttggaggtaagttttccatgtcagaatataaaattgcagttgtgaactcaagtagttttggtcaagtgttcaaggaacattggcaagaattggaacaaatcggtgaagtgaagcggttcatgttgccaaccgacattgatggtaagacattagccgaaacacttcatggctacaacattatcattgcttcagtgaccccaatgtttaatcaagaattcttcgataacaaggatgacttgctactgatttctcgtcacggtattggcttcaacaacgttgacgtgaaagcagccaaagcccacgggacgttggtaactatcgtgccacaattggttgaacgggactccgtcgctgaaaatgaactggttaacctgttaaccatggttcggcgtacggtaccggctgctgaacgtgaacgagctggccgttacgaagatcgggccgaattcatggggaatgaattgagcggtaagacctttggggtgattggttgtgggaatattggtagccgagtggctgaactattcagtgtctttggcgggcaagtcttcattgctgatccagatcctaaggcaccagctggctggttgaagaatcacaacgtgcaacacgttgacttggatacgctcttaaagaactgtgactatgtttctttgaatgcctccttaaacgatggtgattaccacttgatcaacgctgataaagttgctttgatgaaggatggcgcttacctatgcaacaacggtcggggcgctttgattgatgaagatgccgtcttggctggggttgaatctggtaagttggctggttacgctgccgatgctgttgaagttgaacccgttcccgctgaccacccattcttgaaaaatgaccgtatcttattaaccccacatacctctgcttacacttacgaatgcttgcatggtatgggtgaaaagtgcgtgagtgatgtgaagaacgttattgctgataagccattggttcgtgaattaacaagtactttagcctaacgatgagtttaaacagaaccatgtgcgcgtgaattgacacgtggttttgtttagctaatcaagcgggtatgactgaaagaaagctgggaaacgaaatggactacttaattggaattgatgttggaacgacgagtacgaaagcagttttgtacaatacagatggagatatatttggttacgcaaacaagctctaccccttgattcaagaaaatgcggatatggcagaagaggatccaaacgtcatcttccaagccacaattgacgctttggctgaagttacagcgaaggctgatcaaacgcaagggaagattttaggggtttcttggtcgacccaacaacatagtttaattgggttggacaaggaccatcaaccaacgacgaacaccatcacttgggcggataatcgggcggaaaagtacgcctcacaaatggccgcagatggtagcggcttggccttgtacaagcggacggggttaccaacgcatccaatgggtccggtctacaagatcttatggctgaagaatgatcatccagagatttacaagaagacgcgttactgggttggcttgaaggaatacctgttgtatcgctactttggtcagttgaaacaagaatacaacatggccgcaacgactgggttgtttaacatccaccagatggattgggacgaagaatccatgaagctagtgggaattacccgtgatcaattaccagaattagttgatgcaactcatcaactgacgggcatgaatccagactacgctaaacaaattggcttcccagccgatacgccattcattatgggcggaacggacggttcattgtctgaaatcggcttaggggcaattaataatggtgaagttgctgtgacaattgggacatccggtgctgtacggacgttcgttgacaagccacaaatcgatcccaagggacggattttctgttatcccgttatgcaaggcaagtggatcattggtggccccgtcaataacggtgggattgtcttccggtgggttcgcgatcaattatttgcaccggaaaaagtgatggccaaggaattgggtgaagacccatacgatgtattgacatcaattgctaaacaagttcctgctggctccgacggcttaattttccatccattcttgggtggcgagcgggcccctatttgggacggtaatgcgcgggcttcattcttcggcttgacgcggcaacattcacgggctcacatggttcgtgcggccctagaaggcattgtgtataacctttacaccgttgaactggcactgaaggaagcaaccggagaaccaactgaaatccgtgcagcgggcggcttcgcccggtcacccctgtggcggcagatgttggccgatattttcgaagaacccgttacgattccggaagcctttgaaagtggttgtttaggggcaatggtcattgcccaaatcagcttgggactggcagatgacttgtcagtggttaacaaatttattggcaagaagaacacctaccagcctgatcccaagacctttgaaaactatcgtgaaattatgccaatttatattcgtttgggacggaagctacagagcgaatacagtgccattgcggaataccagcgtaagcgggaaccgaaggaataaagcaatttttaatgacttgttcgttgcttaattgaggtgatggctgtctgccctctggctgcggcaaatgagctggaacgtaccggacacgactttaagtcaagtagcccgcttgtcttaaagtctggtcttatcctactaaggataacgacggtactgagcccatttgccgctttttgttgggctagtgtggcatggccacgctagttaatgattattgctgcagaaacgttggatagtgttagtttgaactttggctattgttaaggtgataattatccgtggctgtaactgattttaactagttttggcccgaaagctaggctcatccataaatgtagcccagccaggtcaaacgatgactaaccataaattgagttcaaatcagccataaataaaacttttgtaatttttttacggttttaccttgatatatgtaaatttttttcatataataaaaaccgagctagtatatcacaatttttaaccacaggaaggaacgcatacaatgaaaattggattagttggattaggcaagatgggtatcaacttagcacaaaacatgatggatcacggccacgaggttgttggttttgacttgaacaaggactttgtcgaccaagcagcaggttttggtgccgaaacggccacatctttggatgacgttttaagcaaattaccatcaccaaagattgtttggttgatgctcccagctggtaagccaactgaatcaacgattgatacgttggttggtagcttgagcgccggcgactacatcgttgacggtgggaactcattctggaagaactccgttgaagatgctaagaaggccgaagcagttggcatcaacttctttgactgtgggacttctggtggtcaatctggtgcccgtgctgatggtaacttcatgatcggtgggaccagtgctgaagcctttaacgctgctttgaagcctgtcttcgaaggtatcgctcaagaaaatggttacctctacaccggtgctgctggttcaggtcactacttgaagatggtgcacaacggtgttgaatacgggatgatggaagctatcggtgaaggtttcgatgtcttggcacacagccaatttgactacgataacgaagccgttgctcgtctgtggaactctggttctgtggttcgttcatggctcatggaattggctcaagaagcctttgctaacgacgctaacttggacgaaatcaaagggacgatgcacagttctggcgaaggtaagtggacgttggaagaatctttggaccaacaaatcccagtaccagttatcgctttatccttgatgatgcgttaccgttctatggaaaacgatacgtttacgggtaaggttgtttctgctatgcgtcacggtttcggtggccacgcagttgacaaggcttaatttaaacaaattttgattataacgaagggcggtactatatttagtacggcccttttttcttggattaaagatgatctgctttgtgctagaataatggttaaatatttaggggaaatccctagtgaaggactggtagtgaccaatgcaactaacaaataatatgcgcagcgaggcttacaacgaaattcgttatcgcatcatgcacaataaatatacgccgggtcaaaaggtgtcggaaaaggtgatctcagatgagctgggaattggacgaacaccagtccgagaggccattattcgtatcgaacgggatggcttgattgatgtcattccgcaaagtggcacgtacatttcaaaaattgatatgaataccgctaataatgcgcgtttcgtccggcagattatggaaggcgaaattatgttggaggcaactgggcgaatgacggatgccttctatcaagaactacaagcgaatatggctgaacaggaacgggtggttcaaaaacgcgatcccgatgctttttttgatgcagatgaagcgtttcataaactcttctatatggccgccgatcgcgaagagatttggaactggttacagacgattaatacgcaactgaaccggtttcggtggattcgattgaaagtcagtgatttgaattgggccacgctcttaaatcaacaccgcgatattttgaaggccgttcatgatcgcaacctagacgatgtccggtttgaaattaccgctcatttacgactaatgttaagcgaacggaagtatttgttgagtcgttttccagattattttatgaacgttagtgatgaggacttagcgggtatccaagcgtagccgcgtagtgataagaaagaggttaaataatcatggaaatgggatttcgctggtatggcagtcagaatgatcagatccacttggcagatattcgtcaaatacccggtgtccgccaagtcgtcggggccctgtttgatattccagtgggcgaggtgtggcctgaggaccagattatccggctcaagcaccaaattgaggcggctgggctaaaatttacagtggtcgaatcggttaatattcatgatgatatcaagattggtttacccagtcgtgatcgatatattgaaaattatcagcagacgattcgcaacctggcagccgcgggtgtccgcacaatttgttataattttatgccgatttttgactgggtccgaacgaatctgcacttttccttggccgatgggtcgcaggcgttggcctttgaacaccggcaggtgcaacgccaaccgcaagacatcattcatgagattgaaaataacgcgaacggctttgttctacctggatgggagccggagcgactggcacaagttcaacagctttttgatgcgtatgcgggggtcgatgagacccaattagcagctaatcttaactactttttggacgcgattattcccgtgtgcgaggaatgccatgttcaaatggccttgcatccggatgatccaccacgggaattatttgggttaccgcggatctataagaatctcgcggatatgaaccaaatcgttgcgatgaacccctcaacagctaatggttttaccatctgtaccggtagtttgggtgaaaacccgcaaaacgatgttccagcaatcattcgtgagtttgttcctcaagggcgagtgccttttgtacatgcgcggaatattaagttcatgagtgatcagggtgattttcatgagtcggcgcacctatcatcgatgggctcgctagatatgtttgcgattatgcaggccttacatgagactggattctcgggtgttattcgaccggatcatggacgggatatttggcacgaaagtggtcggcccggatatgggttgtacgatcgggcactgggaattacttacttgaatggtttatgggaagccttagaaaagcaggcgtgattttgcattcattgctaaaaaggtctattctataacaactaaaatatgcgggtatcctaagagggggagacgagatgacggaagtaacgattcgtacgattgcacagcgcgccaacgtttcacacacaacggtttcgcgtgcactcaacgatagtccattggtgaaagaagaaacgaaacgcaagattagacaattagcggatgaattgggctatgttccgaatttaaatgctaagggcttggttgaaaaccggtcgtttttaattgggatctttttttcggaactagatacggggacgtcaccgagtttcttggtagacgtgattaaccgggccaaagtggctttgccagcaggttattcgttgtcattagatagtattgaatctttgagcaaaagtagtggtatctctcgtcatcaatacgatggtgccattgtggttagtcagtcgcggcacgatgatgcgttcattgagatgctgatcaaacaaggattgccggtggtggtgctaaaccgtgagattgatcgccaagatgttcccaactttgcgactaatgactacttgggaactgaaaagattctggaatatgccattcgcatgggccatcagacatttgggattattcaaggggcaacggacttcgtttcggcggccgatcgacagcaagcatttgaggacgtcgttagaacgcatcaggtgacggttaagcccgaatggcgcaagcgggggacctacttaccagatagtggctacgaggccatgcgggcgattctaggggcctccacggtgccaacttgtatctttgcggctaatgatgatatggcggtcggggccatgcgcgcttgtcaggacctcggctatagtattcctggcgacatttcaattattgggtacgatgacatgagttatgctaaatatttgattccccgattgacgactgtccgaaaaccaactgacagtatcgtcaaggatggcgtggcggctttgacccaattattggatgacagtgcagaaaaagtgacgaaaaaaattatcgtcccaaccttgattgtccgggattctgtgaaggatttaagaaattaaatccttttttttgcaaaaaaatgttaacgtgtgcagaactttgtgataagataatcattgttagatggaaagcgcttactaaggcgtttaagtagaacatcgtgttttggtggttcacggcgttctacggcttatcagcgatgctgatgggttacatatcgttatttttgttaccgtgtgtattctgttggaaccgctttgtatttggctgttgataattttaggaggtgctcgaatgagtgagaatgcagcaacaaatcctcatccagaagcagacgtaagtacacaagatgaggccatgattaatgactcgtctaagcagatccccactcgtgaaaagatcgcctatggttttggtgattttgggaacgggttcatgtttgacttaggtcaggcttacttgactaagttctggattgacgcctgtggtattggtgcaggggctgttgccggaatctttgctttcaccaagatctttgatgccttcatggatcccattgccggatcggtgattgataatcgtaagaagattgggaagcaaggtaagttccgacccgtcatgatgatttctgcaattatcttagggatcatgacggtggtcacgttcaccatgccaagtggcttgagtggaacgcagaagatcatttatgcttatgcagcttacatgatctggggactggtttactcgtttaccaatgacccgtatggttcgttggcatccgtcatgtctcggaattcgcaagaccggagtttcatggcaacttctcgtcaagttggttcggtcggcgcgcaattcatcgctggggttgcctttatcccattgatgggaatgattgccaatgggaatactggtgttaaggaagaacacgggtatttctgggccgctgctgtctttgcggttatcggggtcttgatgtttgccgtttgtttcttagggactaaggagaacgtcaaagttcaccggaataccggtgagagtgccaaaaaggaaggtttcaaagattacatccgcgttatcttcaagaacggtccactgggtgctttgattctgatgactttgtttaccatttctgccatgaacaccaacaaccaaatgatggtgttctacgcacaatacaacttaggtaatattggcttgcagccaattgttaacgctatcatgatgggctgctccatcgttggggtcttcatgattccaacgttgactaagcactttggtcaaaagcggacggcaatgtggagcttcgttatcggggccgccgctaacatcttgaactacttcttaccatccaatgtgattacattcgttgtcttggtaacgattggttacacagcgctagctattccaaacgggattacgtgggccatggtgtctaatgcgattgattatggtgaatggcgttccggtgtccgaaaagaggccattacctacgccgcatttaacttctcacggaagttagcacagtccttagctgctttggttagtgccggtgttttggccttaacgggttacgtggccaacgctaagcaaacaccagaagctttgaatgggattaaagcagcgatgacgctgtacccaggaatttgtttgttagtcgccgcagttgtcattggtttcttatacaaactggatgacaagaactttgctaaagtcgctgatgatttggatcatggtcgttgggaacacggcaagattggtggcaaccttaaataattaggtcttatgtttcttaaaaatggtttagataactatattggaggcaatattgatggatttacaaaaattagtttcagacgtttatgaaattatcgacgcacaaggtaactacgataacttatcagacaaggaagtttatgccccttctattcaagtagaacggcgcaatgtttacttcattttgcacgaaacccaaaacaagcaaacggttaaaacgttagtggtctacgaagatcgtgatgacgccaaggaatttgacgctaaggatagtatccaagatgctaacaagacgttgatcattggtgacttaaacgaaaccaactggcacgctttagctaagcgctttgcttggatcaagccaacctctcgtcatggttacaagtacacctttggtttaggtgaccggttaggtaatgcttctaacgctcatttacgcttattcaagggccgtgggattgtgccagtcttagcccaacaatccattcgtgaattacttttgatgaaccggaccgaaacggacgtcttattagatgccggctggtcagtctttgaagaaggttatacggacggctgggttgacgatggtgaccacgttaagaacccacacgaagtggactatgcggttaaagctggttgcaccatgattaccttggatgcgactgaaaagatccacaacgaagttgccgacttctctgatgaagagttggatgcgaagtacaacgccttaaacaaggacttggttgaccgtttcaacgaaacttatttagacaagacattccaaatcagcgacgatgctgcggttcacttctccaagcgtgacctggaagaatctgttttgatcttcttcggtgccgttaaatatgccatctttatctaccacaagttcattgttccttacaacttggactttgagatctccatggatgaaacgattgtgccaacgacaccagctaaccactacttctttgcgaatgaattgaaccgtgaaggcatcacgccagaaacgttggcccctaagttctatggtgaattccaaaaagctattgattacattggtgacgttaagcgctttgaagacgaatacgtggttcacgaagctatcgccgaacactttggttacaagttgagtatccactctggttccgataagctgtctgtttatgaaatcattggtcgtttgtccaagaagcatggctggcacgttaagactgccggaacgaactggttggaagcattgcgggtaattgcccacgttgatcctaagttcatggttgaaatgtacaagtttgcttatgaaaacttggatgatgtggcttccttctatgtcttcaatgcccaaacggatggtaaggcacctaagccagaaaccattaacgaaggcaatgttatgactttgctggaaggcgacgactcacgtcaggttctgcacaccatgtatggctcactcttaaatgcgcaaaagagttacgaatacgtttaccgtgataagttcttcaagatcttgaaagaaaaccaagacttgtatgacaagtacctgaacattcacatcgccgaacatctcgacttactccaaggcttagccaagacgaaggaagaagttcaagcgaagtacgaaccaaaaatcaacgaataatcacgatgattcttcattaattaaggaggacaagactaatggacttgctggacaacgatttcttactcggaaacgacatggccaagaagctgttccacgattacgcacaaaacatgccaatcattgacttccattgccatttgaacccagaagaaatctatgaaaacaagaactacgaaaacatcaccaaaatttggctaaacgaaggcacttatggtgaccactacaagtggcgcttgatgcgggccaatggtgttccagagaagttgatcaccggtgacggcgacgactatgataaattcatggcttgggctgaaacgattgaaaagtccatggggaacccactatacgagtggacccatttggaattgaaacgcttcttccacattgatgaagtcttcagtcgcaagactgcgccagaaatttggaaaaaggccaacgccttacttcaaacggaagacttcaagccacgtaacttaatcaagaactctaacgtcaaggctgtttgcacgacggatgacccagcgtctgacttgcattaccacaaggaaatcaagaaggacgaagcggaaaatggtttccggacattaccagcgatgcggcctgacaagttgatccaaatcgatcgggacggctttgcggcttacctgaaagaattaggtgatatttccggtgttcaaatcagttcgttcaaggacattattaaagccttgcaccaacgctttaccttctttaatgagatgggtggccggctgtctgaccattcgctgttgacttatcacttcgttgaagccacagatagtgagttggatgccatcgttaacaagggggttaacaacgaagacttaacccctaaggaactggaccaatacattacgatgttattggaaaacctgatgaagttaaacaaggaattcgattggaccatgcagttccacgtgaactccatccgggacttgaaccggccaatgtttgacaagttaggtgctgatacgggttacgatgccgttgggacccaaccagacatcgcgggtgaactgcaaaagctgtacaccaagatgcgtagcagtaacgatattccaaagagtatcttctactccttgaatgataatgactggatgcaattggcaacgatgatgggagccttccaagaaggcggccaacaacggttacaattgggtgccggttggtggttcaatgatactgctgaaggtatggacaaccagttacgaatcttcgcacaagaaagcttgttaccaaactttgttgggatgttgacagattctcgaagcttcctgtcttacccacgtcacgaatacttccgtcgggtgctttgcaacttctacggtaagttagccgaacaagggcgtgtaccaaacgatgaagcagcgttgggtcaaattgttcaagatatttcttacaacaatgcttataagttcttcggtttcttcccagacaagacaccggacgaattatttaagacgaccgccaaggcttaattggtgattgcatgaaggcattgtctagccacagccggtgagcttggttggacgataccttttttggattaaaaatgctgcgccttccagacgcgggtctcatgcgagtcttggaggcgcgccttcgatccttgaaacccacaagtgttgggcttaaagtcgtgtccggtatgttccagctcatttaccgcgaccaaagggtgaccagttctttgcccaatttaaaactaaacgagtttcatctcaattgaagcccaattggggttactattgaggtaatcggagaaaacgctagaaaaggagtgagtcacatgaatgataatccattaaatattttgcacacgatcgggctaaaggccctgtacccggtcatccgctgtcagttgaaatcggccggtcaattggatgtatcacggttaattcaggccgttaacttgacagctaaagtggtgccagaactcttttgccgctacgaactagccgataatagttggcagccagtggtcactgacgcttcaacacttgtacaagaagtgccagctgatgcgccgttagatgatacgccggactggtttacgcaaccccagctcagagttcaggtgcaggcaacatcttcgggaactacactaacgttgacgatcagtcatattttgaccgatgggagtggatttaaacaatacctttatctcttaagcgattgctataatcgtggcccagtagccattacgggtgtgaaaaatgtggtcgagttgagctggttaaaagaactgttggccagtcactccgcaccgcaaacggggaatgtggatcaccccgcccaaccgttgcaattacctaagttagcagcggcttcgacagaacagcaacggcctcaagttagcggtttacggctttcccaacagttaacgcgggacttgatggcagccactcatgaacagggcgtgacggtcaatgatgttttgttagccacttttggtaagaccattcaggcctacaatcagggaaatacaaccttggcgatcgcatgtccaactgatatgcggcaagccatcaagaataatcacgatttaaggattgctaaccatacggctcggtataatccggtggtaacatcggctagtgatgaacccattggaacagcagtgcagaagatgcatacggaaatgacgcagttgaaacagcgagatcaattcttggattcggttcggtcactgatggcccaataccaaacgctgggaattcatgaacttcaacagattgttgaagccaactatcacgtgcgcgagattggttacacaaattttggggttatcgacgatcagcgattagtctttgaccagttaccagtgacccagtgtctgttaaccggctcatttcggacggcccccatgttccaagtggcttgcagcacatttaaaggtgaactgtcacttggattcaatatgattggaacagacgacgaagttcagttcggtcgcgtagtgacgaccgctatggttgctcagatcatagccttcgttgcccagagcaccactgacgcggttgttttgtaaaaagtatggcagtctaaaaaaagccccttcgtcattagtcgtgacggtggggcctttcagtagctttcatttattgtagtggttcgatttgcttttgaaccaattccttgtaagtcgttgaaagggagtggttgtggttaacttgactcgtggttgcggcactggaatcagcccaagccttagtggcaaaagcaccagaacctaaaacagcaacaacagcaacgatagcaacaacagttttgaatacacgcatatttgataatccccttttctgctctcttgatttgttcacgtgaacatcgtaaggctttcagaaaaataagtcaagaatatgaaaacaattggaaagggtttcagttaaaaaagttttgattaaccgctttcgcatgtgaaaaagtccaatttagggcctgacttggcggaaaaagatgcgtatgataaatagagaagcgattataatttcgatgaaaatgaatgaaaaggaagcgacttgttttgtctaattcaaccaaagtcactagtaaggaactggtggcaatttttgccgttgccttgatggcctttgtggggattctcgtcgaaacctcgatgaatgtgaccttccccacgttaatgaagacgatgcacgtctctttaaatctcgtgcagtggattacgacgggatatttgttaacggtagccttactgatgattacctcggccttcttgcatcagcagtttaaaaaccgacaactctttgtggtgggggcctctttatttattctgggcgacctgatttgtgcgttcgcacctaacttttggatcttattattggggcggattgtccaggcgggatgtgccgggattgccattccgttgatgtttaacgtggtcttagagacggttccccgcgcccgattaggtttttatatggggatggccggactgattttgatgattgcccccgctagtggtccaacttttggcggggtaatggtggccctcggtagttggcgttggatcttttggtctacgttaccgattgaagcattgattctaattttggggtatggggcgattcgtcaagttagtgacgtccgaccggtccgctttgattggaaacaatttggcctgctggcggtggcctttattagctgtatgttaggtgtcaatagtctgagtacggccggctggctgagttggcagttcctaggcggggtactcttagccatcgttgccattctgagctatgtgcaagttgccaaacggagtgcgcaaccactattgaaactggaaatatttaaaaatccggttttcacctacagtttctttgcgtatgtgagtctgcaattttgtaatatagggatcaactttgccttaccgaattacgcgcaaatcgtggtgggcgctggctcactgattggtggtttaatgctgctaccaggaagcttaattacagcggtttgccagccgtggtttggccatttgctagacgcccatggtgctcggcttcccattttgttgggaaacagtctatttgtgctggcggcgcttggttttacgctgatgggccagcacctgagtgtgatcattatcgcggtactgtacattgtctttagtattggtcgctcgatggcatttagtaacaccatgacgaacgggttaaaagaagtgaccatccagcaacgtgcggatgccaatgcgatttataacacggggcagcaatttgcgggatcactggggacaaccattttagcggccttgatgtcgtcggttaagaatgggcaaatgtcttatgcccatgaaacggcggtggggagtcaactggcatttggtttaatcttagtcttgggcctgttgaactttattctctatacgattgtttttcggtatcaaacgacggataagtaacttgtctttgggtaaacgttttggaaaagtgatcaccataaataagggttcaggacaaatggttctgaacccttatttgtggttaatactttttaagtcgggatacggaaaccagccccatggcggcaccaaagaagatgctggcaaggcctgttttggtgagctggtgcatggacattaggtcgtgtcaaaagttagtgccatcaaagaccgtgtcgattagagctatcattaaagattccagaatgaaaaagtatagcgcctgtcccaccgacacccaaaagatatgccggtaggctgcgtgccgatcctgatagctgatttcgtgggtggctaagcctgcttgacggctggcccaagcgatatagggcaagaccactaatgtgaagtaaaaaaagttcgttaagattagccccagcaaggcattttccggcgaactttctgcccaaaaacaggcaaccactggtgcgatgagcaagatcggccaggaaatcatgaaggcattgttcccgatccgattaacttcttgacgtttatactcatcaaaattccccgaaattctgtaaaagtgtttcacaattttatcccaaagactttcttggttagtcatggtcattcctctccgaagtacgttatggctaaaggcgctttgaatcgctatcaaacggttaatctggataaaaagaaccgtcattatcaacgtaaacagcgggccatcttcaaagttagctacacagattattcacgtaacacgagtaatcgcctgacgggcgttaagcgatacaaagttgctggcgggtatatttctggtaatccacggttagtgacaaatctgtattaccaaggccgaccacacagccgtcaagttcgcgtgattgctcgctcaggtattaggggctatcagcatcagaatctgacgggccgatcttataagattcccaaaggaaaagtgttaaaaattcggcggataattgttcgcaatggtttggtcaatcgttatcaattaaccaatggccattacattaccgccaacaaaacgttcgtaaaaacgaaatagcataacttaaacaggccattaaactgtcagcgtttaatggcctgttttttgcgtgctaatgatctttaatctgtaaggctaatcggactagaaggttggtgatcagtgagaccagtaacgcataactcaagacaacagcgagtaggatcatggccgccgtaacgattttaagaaatgccgccacgtggttaagcatggttaagccaaccgttaggatcgtaaccagtgtaacaaaaccaatgaagccaatccgtgagttagcaaagtcagcggtactcagatcaaagccgccaacgctaatatttagcgataaaaccaacatcagggtccaccgtaaaccggcatgagtatcaccaccgagtgcttgacgaaatccgacccagtcaagtgcaaaggggttggcaaccagtgtcagcatcccttgaaatagactgggaaccagcacagccgttagccccagtagcacggccgcacaaccaaaaattggcgcaatgccgatgaataaattaccggtggtttggtaccaatttcgctgattccatgagtgattgacgtaacccagtgcgagatcgggttgaccgtcaaagccgggttggtcgggatggaggcgcttgagcaagcggactcggtcgatgcgatggccgaagactagcgctgttacgaggtggcttagctcgtgaaagaagatgccgagaaagcccagatatagttcactgttgaggccaaagccgttagctaagaaccgtttggtatcccggttgaggtaggttaggacggtaataaagataaacggaatcacaataacgtctaatcccacgatgccgagatttttaaaaatcagacctaagtcagtattcatccgttactccagtagatccgtaaatgtaccgtgaacgagcgttgccaattcggtagcatcgagttctacggaacggccaatttgaccggaggataccaagatttgtccctgttcctgagctgaattgtcgaagtagatggggaagtggttcttttcccaaatgccaacgggggtgttggccccatgctcatagccagtcgtcttgacgaggtccttgagggggaccatatcaaccttcttgttgccggagaccttggcgagcttcttttcatcgagatgctcatcaattgggagtacaccgacgacggggccggtggtgggaccactgagaactagggtcttataaatgtggtgttcgtctacttggtcgtgatcgacctccatctgggcgacgtcaccttttgtgtgggtagcaaattcgtattgcttgtaaggaatcttatttttatcgagaatctgttcgacaagggtcttatggagccgcttgcctttctttttcttagccatgttggtcacctttcatatatagattggaccgcactttaaaaatagctggaccggttgcttttagagaaatgcagacaccacacgtaaaacctgctatactcttagacagtgacacgtcaagttgaaagagtatgaggagataccatggcagatttagtctatcgacaagtgatgcgcgacttgaagcaacgcattcatcaaaatgaatttcccaataagcgtttgccagatgaacgtagtctgagcgaagcctacggggttagtcgcagctcggtgaagcgcgccttgagtgtgcttgccaatcaagggattatttttaaaaaacgagggtccggtaccttcattaacccattatatatgaaaaaccaaacaatttttcaatatgagggctcaaatttgggaatcacggatagtatgaagtctgctggcaagacgccaggcattcaattgctacagtttgacgtggttccagccagtaaagaaattcaacaggatctttttttggaagatggcgatttcgtttatgaaatcaagcggctacggacgtttaatgatcagccgttcatgattgagacggggtacattcccattaagattgcgccgaatttatcgaaggccacagtctctggctccatttttaactatttggagagtcagggaaaggtcgttaccaagtctttcatgtcaattcaagcgcagccctcgacggcagaggatcagaccttgttacatctaaagccggtcgaaccggtgggcatcatggaaggggtcttcttcctcgatgatgggaccccctttgaagtgtcaaacatgcgcctccattaccaatatttgaactataacacgtttgtctctttagatgaagaatagacgtgagaaagggatgatcaggcaaattgccggtcatccctttaaattaaccctatgattcaaacaggagttgtgatataaataataaatagttaagcggttaaaaaatagggggaatcatcatgcgttggggtcggggagttttgctagttctgttaggtggtctgttaatgattgggttggggtaccgtagcggtcagtttccacaactaacggccacaattgaccaagcgcggaaccgaatttctggtttgatgacgccacaaggacaagtggttacgcacgctcattcgttcgaggtacccaagaatgctacgcccgtagaaagtattgtgcggggcgtgagcttggataaaacgtaccactatcggtttagtgaccagttgaatgctgacggtaaacaggcctttagtgatgccgtagaagtctataatcaaacgggggtagtccacttggtgactggcagtagctgggggaatcacaatcagattaccttctccgtttaccacaagcagatgccccgtcaatctaaattcgttgagttgggacatggtggtccagaaattattcaaaccacgactgactgggggaccaagagtgttaatcatgcagtggccagccttaatggtgattactcgcaggcctatagtgacgcggtggccattcatgagctgggacacgctttgggactggaccacagtaaatcccggtcgtcggtcatgtacccggtgacgcgtgggaaaacccaattatcaaatggagatattgccagtttgaaattgatttatcaataaactaattgcagataacgcgcctgggacaacggccccagacgcgtttctttaatggtatactaaggctattctcattttaaggttaactggacttgattaattttgacccggtaattggcgtgcggcgctgaaatagtgaccgtatcaccggggtggtggccgagtaaggccttacccaatggtgacacgcgagtgatcttaccagccgctaggtcggcttcttgtgtccctactagttgataggtggcttgttcatggtcgtccaggaatgttacggtgacccatttacctaggtcaaccacatcggagttactgggcgctaccaccttggcgtattggagttgtttggtgtaaaagcgtaattggctttctaagtgacgtaaatcccgtttagcggctgaatattcggcgttttccgacaagtcgccgtgggctcgggcttcggctaaaatggcaattttttctggtcggtcagcttcgagcgcagcaattttagcttgaaggtcttggtaaccagctgcagtaattggattgaaatcgcgtgaatttggcataatatcctccctaatcagtgacgattaaactcattttaacgaactcgattgtaaaagaaaaggagtctccactatgaaaataacctggcagtattggttgaaacaggctggtatcggtttggtggtcgttttagtaattgctggcttaggccatctgaactatacgcaatggcggctgttaccaggctggacgatggccgattggtggtttgccttgtgttggctatgttttccgttggcaaaatgggtcattttagaggataaccgagatctgcaggcccccacaatccggcgtcggacccgggcgcaacgggctgctgataagaccgcctcgatctatgaaaagatgacccccaaggcccgtgagccgcggctagcggctgcgccaaagacagcattagcctggtactggcgcgggataattgatgtggtgctgatatttgtgggcccactgatcttaggcggatttctaacatattcgttacggcacaattaaattgtgctgtttttctcggcattatcgtctaaaaatagacgtttgtgccagttattatttagtgtggggattccatgttaaagtagtgacagttgaaaggggatcagttcttcgataactgatttcgctagtcaatcggttagtgtgtgtgcgagtatacacaagccagattggcggatggcccctgatgattctctaatcaacataagcggtctgattgaacgataagctgtgtgggtaaccggtgtgttcggtgttaccaatgtccaaagagtgaacgatggttattggacgatccgagggagtttgactagttagaacttgggggagtgctaatttagccggtagtaaggttcaggatttgcttagaaaggggagctaccatggggggtagttcctttttttcggtgggaaaagcacgagcaaacgtttgcaaactgatgaatttcaggttacattagtggagacagatgttaacggacatggtaaaagggtgtgataagctttgctagctgtctatctttgtgaggataatcccgaacaattaaaacagtacacgcgggtggttcagcgttacattatgatcaatgattatgatatgcaagtcagattagcaacgccgagtccgaaggccttgttggcagatttaacgcgtaatccgcctgaatatgccttgtttttcttagatattgagtttccggcagagcatctgacgggattggaaacagctattcggattcgccagcagttaggttttgcggaaattgtttttgtgacaacgcactctgagatggcattactcacctttgagcgcaaggttgagccgatggactttgtggtgaaagacctaggtcccgaacagatttatcaaaagttacgagagaatattgattatggctatgaacggtataccaattatctgggtaatactgaaaatctcttcagttatatgattggtggtcgaaaatttagtttgcccatgggtgacgtgtacttcgtggaaacagccgaaacaccccacaaggtcattgttcatgcagcgagccaactggtcgagttcccgggattcttaaaggatattgcggatcagtatacagagttatatcgtacggacaagagctttttagcgaatttggataatgtggtgggaattgatgccgatgaacggcgcttgattttccccaatggtgataaaacggatgtggcaactcggcggtttcatgaagttaagacattagtacaaaagcatttaaaggcctaagaaggtgacaaaatatgcaaatactgggtccgcatttttggataaattttgtattagcaatgaccatgcagtggtttatcaccctatgggttggcgtgattcgacctcagaactggaagttgcctttgaagtggatgggatgggccttgatcccggcagtgattggtcagtcgtgggcgctattgttaccgccgatcagtgccttgttgtacctaattcatcaccaaccacgattgacgctgatttttgtgaatgcgacaatcgtggtctttttggtcgttgtgatggttaacgatgtagttcgggcggtagctattgaaatttttggctggagtgtcagtcaatccatgccagtgattacgttaagtttggttttccagattatcgtctatacattgttttctgtggcggtttcgggaatgcggttgcagccaggaaatctggaaatattagcccttagtcgcaaagagcagtggacagtaatggcgttattggttagtctggcaacgttggcacggctttcttcggtggtgattcatcacctcgtggtttcacatgccatgctaacgtttgatttgagtattgaattggtcatgattctttcgattagtgccagtttatttgttttcttacaaagtttctttcatcgtcaacgcgtacagacccaataccaagaggccttattacgaacacgttatgatcaacggatttccgatcaagtaaaagctattcgtttatttaagcaacgatatcaacaacaaatgcttaaattaggggattatttagatgctgaggactacgtgggattagccacttattatcaaacgttaaattcacaatggcagacaacaagtcagttggcaggtctagaggcggcggggttacaacgactgcatgatccatcattgaagagtctattatttcaaaaattgctgacggcccaaggacaggggctaattttgcggttggagattccagatttaattcagtacgtgcccatgaatagcgtccaattgctgcgggtgatggggattctcctagacaacgctattgaagctgggggagttggtcagcgacgagaaattcactgcgcgattctggactatccagacgcagtcgaattggcagtcgcaaacccggtatccatgaagaacccaccacaattggctcacatcatggccgctgggtatacgactaaggggactggtcatggtcagggtctgcgaattgttcaagagatcattggtcaaacgccaggtgcagcactacaactggctttaaaacatgatcaattatattttacgataattctactgaagtccggaggtgaattgcgtgatagcggttagtacgttgagttttgctttggccgatctgtcgatggtctactggttcatttattttcaatattattggttctctgaattagtagttttcaagcatctctcgttattctgtttcttggtcgccattggctatacgaccgtggatttagtgaatccgtttacgtttagcggtgccctgttaggtgcgttaccggttatccttctgttggggttagagttctttttgatagggattcggcagcaaacggaatatttgccagcatttattgaggtgtcaatcttagcttatttgttagttgagtttgtagacctaatggtattggcactgatgatttggctgactggtttgatatttgccacgagcttgtggggaacgttagttgagctggtgattaacaatgttatttttgcgttagcagcttccggtctgtggctaacgcgtgcgccgatggagaatctcatccaatcaatgttaggacgctcaacagaatatctatttctaggctttatgtcagcattggcgacggtctatattctatttgaatactcgttacaatcattggagaattcagcccagtaccttttcttcttaggtggtattgcggggactttagtgataggtctgtcgctgagtacctatatgctcatgcagacacacttacaggcgcaacatatgcaactacaagcacagcaacaagcctttagagaacaatacgcgaccgaattgaatcggcaaatgggtgtagttcgtaagtttcaacacgactatcaaaatatgttgttgggtttaggtgggtatctagatgatcacgattacgaaggatttcgccaactttatattgacattcgttcaggatggcaaactagtgatgcggctgatttaacggttgaagatttagaaaatgttccaagtgccggattacgtcttcagttgtatcataactatctcttagcccaacgtgccggagtccagctatttgttcaagtgccagaaccactaactgccaccgtcacgacgattaagaagataggacaattggtggatgtgacgctgccacctttgttaccggttctcagccgccaacaaccggcattggtgacgtttgagctgcgggaaacggcaaaacagcttcgctggttattgacctttccaattcccaaggatgctcgtttggatgggcatagtcgggtaacggccagccaggggacattagatttttcttatgttcataaaaatttaccggctaaagctaccgcaacactgcaattgaaacttcattggggacaattgatggttgcattacccaaaagtgagggctaatttgcctgaaataatgttctgaaagtttcacaaagtaagccttagcaggtgcttaatgaacataaggtcagtgaacaaattaaagttctgaaaacgcttgcatttctacggccgtctgatatactgataattgtaataccaatcaatctttcagagaagccggaaaattttgtggttttacgggttcttgattttgtgaagtttttctcattagaatgatcttcacggcacgattagttttaattaactaaaagtgatttgaatagctcaatacctacatattgagatgaagctgatttgagtgacagcgttatcctgactacaaactgtgattatgttgcaactctaatgatgctagtgggaaccggagagtggttactccggtttttttgtggttccagaggggttgataatttttatgacaggttgagatgtaagcgcttgcacaattgcgaacaaacgactagactaagagtagattcactggtgtctgtacttgttccgaacaaccaaatttcattttggaaaaggggaaatgactcatggcacgtttagatggtaaagtcgcaattgttactggtggtgttaagggaattggcttagcaacggctaaggcttttgttcaggaaggcgcgaaggtggtcatcacggatgttgatgagcgtaatagcgcagcagcattaacggaaattggccaagacaatgctatttttgtgaagcaaaatgttgcggatgaagcccaatgggaacccgtttttgaggccgccgagaaggcttttggtcccgtgaatgtcttgatgaacaatgcggggattttaagctttaacaatgccgaagaagtgaccgaggatagctggcacaaggttttagcggttgatctggacggtgtcatgtatggtgttaagcacgcgattgcgcatatgaaagacaatggtggctcaattattaatttgtcatcgatcgcgggattaatcggtatttcaaatctcttcgcctacaacgccgctaagggtggcgtccgcatgctgaataaatcggcagcgttatactgtgcggaacaacactacccgatccgagttaactcgattcatccaggatatattcacacaccaatggtcgatgcttatcctgaaatgcggcagcaactagaagccttgcacccggttggccggttgggtgaagccagtgaagttgctaacatggcagtctacttggcctccgatgaatcctccttctcaaccggtgcggagttcgtggttgatggtggttatacggcacaataatataaataacaatccaaaaggcgcgggactaatctctcgcgcctttaactatttaattaggttaagcgttccccagattaacaagatagcgagtaacccgatcagaataatgagcgcaactttctgtcgatgttgcatgcaatccccccaaacttctagaattagtgtaacaggtttttagtgacacgttggctaaacgacgacatcggctgtatttcgacgtttaagtactaactgaattggtcaaaatcatctggtacgggtgcagtgacggttgtgcggatatcattaacggcaaatgggtgtggaaaggtgagttgccagcagtgtaaccgtaagcgattggtgtcggtcgctgggccgtataaaggatcaccaatcagcggatggcccgcagcggctaagtgcacccgtagctgatgggtccggcccgtctctaagcgaagctgaatgagcgtggcttgttcacggtgatcgcaaacgtggtagtgagttaccgccggttgcgcatggtcaccattaacctggcgtttacgtttatccagtgggtcgcgaccgatggggtccgtaaagatgccgtcaccagtcaagtgaccgtggacccaagccagatagatgcgctgcacttgcttatcggcaatgtgtcgaatcatgatgggcacgacagcgggggtcttggtcatgagcaaggcccccgtcgtttcttggtctaaacgactgagaatataaggtcccggttgattaggtcccaaataagccgccacgtgattcaaggtggttccccgttctcccggttggttagggtgcgttttactgccacgtgttttattgatgactaacaagtcagctgactcatacaagacagctactgtggcggcactatcaggatctacgttggggaaaggctctttaaagtcagtgggtaaaaaggtcaattgcacggtgtcaccaccatagacgatctgattcattgaacgataagctccattgacgagcacgcgctgatgaatacgaagatcgtgaatcaggtgactggggagccgccaatcgatgagttgttgtcgtaagggcgtagctatataagtggctggcagttgctgcgtataagtccagtgcacggcggcacctccttttacatgggtcaatatgaagccgtgtgagcataaaataaggccgggagctggtcccggccttaacgtacttattcgttatttggtagcttctggcttaacaatcaaaacatcgcaaattgcagaacggctaacgtagttggtcacagaaccaaccatcaaacgttcaacggcagttaatccagttgatccaatcacaattaattcggacttgtgatcggctgggaattcacgcgcaattacgggtttcggattaccaaaccgaacgtgaatgctgacgtccgttaccccggcgttgattgcttgttgcttgagggcatcaaggcgatcttgaacgtcttgagaaagcttgtaaatgacgtcaccgctaacggcaccaccataggtatcgctaaattggttaacttccaacacgtttaaaatatctagatgcgttttgttgcgtttagcaacttcgattgctttttctaaaaccggttgcgttgctttggaaccgtcaacgggaaccagaatattcttatattgttgtaacatatggaatgccaccccttcacgagtcaatggttaagactttacccttactatatcatttattccgtagagtgtaagcacttaattctgaaaaaatgtagtgaaagagcatgaaaaccccgtgatttagggcattgaagaattacaaaaatattaccgattaattgggaagcacgactggtggcgcctcacggcagttggtcactggggatgaccattagagcagtggcggccacattgaaggtttgcttcatgagggtatcaacttgttgcgtcagttggaagatttcagcggcagtcatcgttggtttcacggcaacggtgacgctaaccataatgaggttaccatcgtgatacgctttgaggaaaaccacggctttgacagctggtaagtggtcgatgacctggcgataacgctgctccaaggttggatcgaagtagtcgacgaggtcgagaccattttttcgaaaaatctggatgccggtataaagaatatagccacccagtaacatactcatgttactgtcgagccagggaaggtgcagtgttgtgacactgacaacggtgagaacggtaacgccgctggttaatgcatcggtccaagaatcttgggcggcggcaactaaagcggtgttagctaaacgatgggcccaatgccaattggctagccacaataagaggaggataaacgttgaaagtccagcaccaatgccagcaatccgcgattgtagtactggcgttgtgggagaaaataacgcccgagtcgcttggtaaataatgttgccggcaatctccaccatgactaagccagccactaaggtgtaaagggtttcgaagcgaaaccgggattgttgaattcgcggactcatagccagctgttcactgggcgcaataggggcgccccacagatcgttgtcgtgagttttagcggccatgtaaaggccagtcatcagcaagctggtggagaaaattcccgagagattgttaaacgcatccgctcgcagaacttgtgaatgggctagctgggcacaactaagttcgatgacaaaaagcccaagataggtgccaacattaagccacaggtgttgccgggcaacccgtagatcggtaacggtcgtttgctggatagtttcccaagtgtttttttgtagtggattcatcaaccctcactccgttctggtagctagttgacggtgataacggcgtcgtgatttaaaaaggaagaggacgcttaacatgagaccggcaaagggaatcgctagttggtacgggcggataaaggcccgcgttagttggcgtttggcatcccgatgaatcccgcgcacggtgtgggtgagtgcccggttggcctgacggacttgttggctgacacggcggctaacttgggcgtgaatttggtgcttgattggtgcgggtgcttgcagcgcgtgtgcctgttgtagagcggcttggtaatggccttgaatgagctgctgggttgcgtgagtgctgataaaggtggtcggtgatggtgcgctgacgcgttcagtagccagttggtgattgaccgtttttagggtgtctcgtttggccttagccggaatggttaacgcggccacggcctgttcggcatggtgagacacggtgattttagcggtagaaatattggcagatagggcggaaacgaaaatggcgacggctaacgaggtgccaatttggcggaaaacaccaataacgctttgtgaggcggttaggagcttgccagagaagtcgccggcagctagcacggtcactggctcgataatgacgccataccccgcaccggacagcatgagggcgatgctgacctgccaataaacggcgggattgctaaggctaagtgtgatgtagccactcagaatagctaaacaaccggtggcaatgacggctcgtggcccgaccttacttaagagaaagccactaattggtgagcagatgaagagcatgagggaagcgggggtaatcattagggccgcctgtagctctgttgctccctgaatcttggtgaagaagctgggcaagatgaccattaaggcaacaaagaaaatgcccgcagccaccgtaacgattgcagccccattaaactgctgatccttaaataatgcgagtggcatcatcggttgagcaacgtgactttcaatcacgaggaagagagctaaagccaatccacaggtgcctatcaggccgatgatccgccagctggttcacccccaaccattgcctttgattaataacagtgacaggctaaaaagtgccagcattgaggtgagagcgccggggatatccagcgtttcgtgctgaccgccggtgtgatgccagtcgaggaggtgtaggcacagcccgagcgctgctagggctaacggtaggttgattaaaaagatggttcgccagccgaaatattgggttagcaccccaccgatagtggggccaaaggcggcggccaatccttgggtgacccctaaaagggcgatggcctgcgtgcggcttgccagcgacgtgctttgaatgccgatggtcatactagccggaaaaacaattgcggcaccgacactttgcagggcacggccagcgattaagaagcccacggtgggggccaggccagaggcaatggagccaaggaaaaatagacttaagccgactaagtagaggcgttcacggccataaatatcggcaatccgtcccaacgggattgtgaggcaagcgaagagaatcgtatagatatttagcgcccaggagaggtgggctagatcagtgtgtaggccactttgcattgcgggtaaagcgatactcataacggtggtgtccagaatacagatagaaatcccaatggtcattgtgagtaagattctacgtgaatgagtcatatgaaggacctccctttgtgtggggatagtgtataagatggtataccggaagaaaacagttgcgtgacaaaaaaggaggtatttgtcaatcatgagtccacaggaattgaaagaccagaagctgcgtgagagctaccgcgcattgctattactgctggcgcgcaagcccatgccggacatttcagttacggagttgtgccaacaagcgggggtatcgcggacgtacttttataatcgttttgggaactttgacgaaattattttggcggcctaggaacaagggatcagtcgctatttgcgagcattacctaatttccagcaggttgatttaacgggactgatgacgcgttactttgaattggcccaacgagaggcggacaatcaattattattggtgaaaaatggcaaaattcgggtgttgatggcgacctttcaacaggtctaccgccggttgttagcggagagccgaattttggctaaggccccgctaactgtggaagattactacatcgagttctttgcgagggccgtgattaatctgtctgtcacgtggctagagcgggggatgccggagtccccaagactgatggaacaaaaggcgagtcgcttcttgttgcggacatgagttgagtggattgagaacgcaaaaaaacaccgagcctcacgggattcggtgtttttggtgtggcttatttgagacttgatgaggttaacgaaaggttagaccagaagctattgttagcgggacccatatcaaagcccttaactcgagtattaactggaacccagttgtaactgaatgagccgggagcaacggcagcttgttcattcatgtatttctgccattgtttgaaggccttagtccgataagtgtcattccaagccttatcactgttcatttcattcatcaattgcgtatttttcttagagacgaagtggcccatgttgtaggtcgcatcttcaccataaagttgggtaggtgttggttcagatgacacgccccaagcggcagcataaacatcaatggagctttgttttggcttttgcagagttgagtagaaactgttcatttccatcgtcttgccaccagtgaactgaacgtttaagccgaccttgtgccattgctgtagatagtcttggtattcggctgcttgtgcggaagtcccagtcattgcgccaaagtagatggttaacttcttaccactgggatcagaacgccatttgctaccattgcgtttcttgtagcccgcgtcggttaacaatttgtcagctttcttgatgttgagtgggtagcctttagcagatgagtcgtagtactttgagaagattggtggaattagcgtattggcacgccaagtgatcccattaccaaactttttgctgacggcgtcaaggttcaaggcatacatcatcgcctgacgtagactcttattggccatcttgctattcttatccatgacgttcttttgggtcttagtgtcgtagtgaccgacattgaagccgaagtaatcataggaaagcgctggctgaccagtaatcttgtagttcttcacatttttaagctctttgtagtcggttccatgcaagacgctaccagggaccgtaaaatcatacttaccagattgaatggctttatcaatattgttagaagaaacgacattgatactgatatgcttgatttgaggggttttgccgtagtagtacttgtttggtgaccaagtggttgattcaccttcaacgaccttatctagcttgtaagcacccgtgaagatggggtttttccgaacttgtttagacgaagccaattttgcaatcggaacattcttgatgtattcatatggttcaacagttccccaaatgaaagagttaccagagtacttcatggcaggcgtgactttggttaaatggataaccgcagtgcgtcccttttcaccatctgggaaagtaattcctgaaatggtcttagcttttccagtatggtaggccgccattcctttaatggtattaaaatcagctgagtattgttgtgaagtggtgtttttgttagcgataacttcataagggtattcgatatccttagcagtaactttagagccgttcgaccacttggcgtctttttgtaaagtgatggttacggttttagccttccgattaatccgttggttagctaatccaccatcgatgattttgtaatttttatctacattgaatagggagccgccaccaccaggagcaaagacatcagcgtcttcttggttggtggatagaacttgatcagagatcccttggaagggtgaatcattaggttcagccagcttcagtgtactattcttggtggctgaagcattagtggctttcttattgttaaaagtcggtgataatttcaaagaagcagtggtaccattttcagaactagatgaactcttgctggaacaagcagcgaggctaacggttgctagaacagccatcgctgacaatgcgagctttttcttatccatttatgtttcccccttaattaatagttaggtacaagcgtgtcattcccctcagaatgatacgataagactagggcgcgggatgtcagggtggcaccatctccttaaaagtcgtgaattggactagttaattgatccttgacgttgcgaagcatctgcggaccgtcgtagaacctgaccaacgtaactaattgataaacataaaatgatgatttctagtgcggctggtaaccaagtccaccagtattgggtaatgttgttgggatcattggcattggcaatcatggtccccagcgaaggggtttggctaggtagcccgaatcccaagtaagaaagacccgtttcaaccccaatgttttcggcaaatgatagggtacagtcaacgataatcaatgaggaaatattaggcataatttctctgaagataatcttccagtgatttgttcctgaagttcgtgaggcagcaacgtaatctttttccgactcagcgagggttcgtgaccgaattaaacgagacgttccttcccagtagaagatagaaaagattaacgttaaggtaactgaattgtagtgtgggatgatagtaacgaggacaatgatcatcatggtcatgggtaacatcatcatgaagtcatagatccgttgcatcccccaatcaatatagccattaaagtagccagaaatcagcccccagcaaatcccaaatgtcgaagaaattgcggtcaagccaattgcgatcccgattgaatttcgtgagccgacaatcagctgcttggcaactgaacggccaccggaatcggcccctaaccagaaatcactggtaaatggttgattgaagtaagccataatattagtttccatcattttgggcgtgttgataaataacgcaccaatcatgacgaatacaataaagccaacaataataattaaagcggccatcgccggtttatcggccttgaattcactccaaataattttggcggtcgaaggggtagcttctgcttgtgcttcttgcgttagccgggctaaatcagctgcggaaacgtctgagtgttgttcaaaattttctgccatgtggtttagcctcctttattgaatccgaatccggggatcaacaatgcttaagatgatatcggaaagcaatgtaccaatgaggttcaaaatcccgtaaattaacactaatgcggtaataaccgtgtaatcacgataactaatagagttcacgaataggaggcccataccgggataagagaagaccgtttcggtaaagatggacccgttcagtaacccggtaatggagtaacccgcaaaagcggcaattggcaacagtgagttccggaaaatatgatgccggtagatgtccttgttgggcacccctttggaccgcgctgtacggacgtagtcagaatgcttggcgtcaatcacttctgaacgtaagtactgaacaatattgacagtcccgaacaacgctcccaataaaccaggtaacagaatgtgatagaaccgagatccgatggtggataaccaactgctggcatcggacgatattgacccggtcgttgggaaccaaccaaagacatacccgaagatccaaatgcctagaactaagatgacaaagaatggaatacagtaggtcacgtaagtgtagacccggataatagtatctggtagtttaccttcatgccggccggcataaacacccattggtaaggcgaaagcataagttaaaatcatggtgaataatgccaaccataacgtgttacccgcacgtcccgcaattaatcgcgtaacgggttcctggtactggtaactgttccccaagttcccatggaataagtgcacgacccaattccaatattgttggtaccaggggtcatacagaccgttaatccgcatcaagtgtttgatttgagccgggtcggccttgggattaattgaaccggtaaatggatcaccaggcatcgccttggccaagaggaagaccagaatactgagaataataacttcgggaatcatgattaagaaacgacggagaatggttttccacattaggcctgcacctccccttcttgattagctagctggtgagcgatttcttctggtaaggccaccgaatgggtgggacttacttgtaccaacggataagcttcaccgttttcatcgtagtatttactctgttgttcgtcgtagatcttttccacggccaaccgggaagctcggtgagcggcccgttggttgacgttggtttcggggatggctgcaagcaggcgcttcgtataaatatgtagcggatggttgtagatatcctcacgcgtaccgatctcaattaaccgaccgcggttcatgatggcaatgttgttacacatgtggcgaaccacgccgaggtcatgtgagatgaagagataggaaatgccaaattgacgttggattttcttcataaagttcagcacctgtgcttgcacagataagtccagagccgagacaggctcatcagcgatgatgagcttggggttggtagcaacagcgcgagcaaccccgattcgttgtcgttgaccaccagagaattggtggggatacttgtaaagggcatcggcatctagtcccacgatatcaaggagctgtaatactcggagcttctcatcttctttactcagatgttcaaagttacggagtggttcagcgatgatgtcttcaatccgcttacgaggattcaaactcgataaggaatcttggaaaatcatttgcacgtcgcggttgtaatcgagcttgcggcggttggcccgttcggtaatatctttaccgtcatacataatggagccactagtgaccttttccagtcccacaacggacttaccggttgttgatttgccggaaccggattcgccaaccaaaccgtaagtttcgccggcctcgatgttaaaggtaatgccatcgactgccttgaccgagtcggtgacccggttccagaaaccggaacggatggggtagtggactttgagatctttgatttcaactaagctcatgccgtcacgcccccttgttgatctggaaattgaaagttcttgtagcaggtgcagcgaacctcatggcccggcgctacttcgtgcatactgggatgttcttcatgagcactggcgggaacccacggaatccgtggcgcaaaccgatcaccctgactgggcatcttttgcagtgatgggacgttccccttaatgacatagaggtcatcattctcgttttcccgctggggcattgaccggagtagagaacgggtatacgggtgttctggggtgttgaagacttgttcagccgatcccagttccacaatttggcccgcatacatgacagctactcggtcggccgtttcggccacaacccctaggtcatgggtaatcaggataatgccggcatgattttctttttgaatatcacggagcacatcgagaatctgggcctgaatggtgacatccaatgcggtggttggctcgtcagcaataatgaggtccggcttgcaggcaatcgcaatggcaatgatcacccgttgccgcatccccccagaaagctcatggggaaattgacgcgctgttcgttgcggattcacaatgccaacttgatccagtaattctaggacccgcgcatgcttggcatccttggacaggtcggtgtggtaatccataacttcactgatttgatcttcaattcgtttgagtggattcaatgcggataaggggtcttggaagatcatgccaatcttatcgccccggtattggttgtaaccatcctcgtcaagctgtaaaagatcggttccctcgaagtcaatctcaccggtaatcttagtctctgccgcatcatgaagacccatgatggtcgtggctaacgtactcttgccacatccggattcacccacaatcgcgagaatctcatcgtgatgaacctgaaggttaacgtgggagatggcatcgtagaattgtccgttaattttaaaggcggtgctgacatctttaatggtcaaaaagtttgctgcagtgtccacggaaatccctcccaatgtatttttctctaatatatctttcatttttgaataaacctttatgaataaaggctcggacctattcaagttggccctaaacaataattgcgtttgattatagttaatcaaattctaattttcaagaccattttttaaataatttgccatttatttttcacaaattcttcaaatcctttgatatggcaatcatcgcagatgctttgaaaaatgataaaaaaattcacttaaatccaccaagttggataatcgggttatcaaactacccggtaatggaataatcctatgcaaatgatcacgcaaatatgcatgtatattttgaatgagggaatcctgtgattaccaatttgtgactattatcgagatcgcagagtgtggtatgataccagtaatgacagatttttcgaaagcgatggctgaacgatgagattagacttttcagttgccgttcacagcttgctttacttggatgagaaccgtccacgtaagattgcaagtcgggagctggcgacttccttacaactgaatgcggtcatgattcgcaatattctttccgtcctgcataagcagggctatatcgaggggttcgtgggtaaaaatggcggttatcaactcattaaggatttagcggagatcaatgtgggtgagctttatgacctgacaattccaccgaccattagctatgcccggtttatcaccggtgattctaagggaacgcagacgactgacgagacggatatttcggcaaacatctcgcaaacgttgacggatttatttacccttgccgatgaggactatcgcaagttctaccaccaattcacgatgacggatttaaaacgtgacttacatgcacatggtttcttccgtcagttaattaaccccaaatagaccgctgggagttattggcaaagacgtgagctaaacgctattttttagttagcaaaccgattataattatggtgtagatgaggaatggtgattacggtcaccattaatgtcgttggaagccgcccggggtgaacctggacggcttttttcgatcaataaccagcgataaagtagcaataatcttctataaataaggtaatgaaaacccagatgaaagctgaattgtaatcgattacaactcgtgctatgatttaaagtaaccaagacaccgacagttaggagtcggggccgtggcgtggttaatttgaaaggggttttgggttatgtattggtatgcgatgaagtcacatgatattcgacacaatttagcaacggaacagtacttaatgaacaacaaaaagttcgatgaaccattggtattgttttactatgaaggaccctgcatcattgtcggtcggaaccaaaatacattagaagaaatcaatcaaaaatacgtggaagaacataacatcaccgtcacccgtcggttatcgggtggtggcgcggtctatcaagatctcggcaacctttgctttagcttcgtggttgatagcgatagcgaagaattcggtgattttaagtctttcgtccaaccggtggtggatgcattgcatgcgatgggcgcaacgacggctgaagtctctggtcgtaacgacattctggtggacggcaagaagttctctggaaatgcgatgtactcacatagtggcaagaccttctctcacggaacgttgatgcttgatgtcgaccaagatgtgattgcgcacgctttaaatgtcccggaagataagatgaagtctaaggggattaagtcggtgcggtcccgagttacgaacttgaagccctatttagctcccgaatatcaaaacttaacggtgccggagttccgggataccttgttaaaggaactcttccaggttaaggatctcaaagcaattgccgataaggaagtcaccatcaatgatgatgaaaaagtggcaatcgataagatctacaatgactattacaataactgggactgggtctacggcaattcacctgaatttacggtgaaaaagcgccaacactttacggccggtacaattgatgcacggttattagtggagggcggcaagattaagaacctaaagttttacggcgatttcttcggcccagccgatgcgactgaattagcggataagctaaccggcgtgcggtatgaccgagaacacgtgggcgccattttggatagtgtcgatacccagcaatacttcaatggcattcctacggcagaagttcttgatttattagttgattagctggcgttagtttttggtgattagctgattttcaccggggaatacgttagaatagaagaggaaattgactaagacgtggtcggtttgaccacgtcttttattttagaaattattgaggggtttaggttaaaatgaaagatcgtaacgttattgcctgggcgattgtgtccctagttggattcatcgctattagttttttaatgtcacggttctttggtcaaggggccaataccgcaaaagtcatgactgatttttggcgttcaacgctgacggcagtcattttatatgcgattccggtagtgctggcggccattgattggcgcccatccttttatgtcatgggactggtcatcgcgatgtatacgctggcgctaatcagtgtgttactgaacatgtggaccgggggaacgcagaataccatgatggtcaaactactcatgtcggcgttcagcttagccctcatggtgggaaacgggtactggctggtcttggcattacggttgcgcaaaaaggaacaagataggcatgaccggaaacggtttggtcgttaaaacgaggtgggaaaatgaaacgagaagtacaagcatttattaatgcagtcgctgaggatgatatgcaacactttacggcggagaccacggtggctgatttttatgacaagccggaccaaacgatggcgccactggcggcatttattcgtgaacaaattggggctgacaaactggcccaagctgaactcaaggtgaccgatgctgagatgtcagttcggttggagttaagtgtgattaatttgccattgcaagatacgaagacgattggcaagattatggaaacttctgaggaagccgatttaaacgtgtatgccgtgattgaatcgcctgatattaatgtttctgggttgcggattgatgccttagcaccagctaccacctatgttgaacaagctaaagtggccgacgagagtcttcatgattggctaaacttgcagattgaaaaactacaagcagcagcgaccaacaaagaagccactgacgttaaaaagtagttcgtgtattcagtgacgccttgtactttagctgagattgtgctaatatcttatctatgcgatgagtcgagaaaatcacgcgactttcgggtcgtccgcgcaagcggctaggtgaatttttcaacagggcacatatgtcaccgtattgtgacgtgtctgatcttgagggaatgtggattccgagatagatccactcgtgcaagcgagtgctgtatgaaagcgtccaagcagtctttgactggttggacgctttttttgcgtaaaaaatgatagtgaaccttgatcgggggggaaaacagctcgttttctggtttagtgcgattaagccagccactattggttgggcttgcccgcccatttgccgcttcccgtcgggctaccgtggtgagtcatggttacgttggttgcaccctaagcctgattagaacaattttgatttactgtcttggaaggcggcaggaccaggacagtaactcacataagcaaaaggcgaccaacaaggccaaatcctcgcagtgacgggtcagtgaggcgtgcgctacaagcgagatcatcttttttgaatttttttgcgaaaacgcttgcattcaaaataaatccttgtatacttgtatttgtaagttggttgtcgcaacgaactaactaggagggcttttataattatgactgaagaatactggaaaggcgtcgacaagattcaatacgtcggccatcaagataagaaatctggtttaggattccaatactacaacccagaagaagagattatgggtaagaaaatgaaggattggttacggtttgccgttgcttactggcacacctttgaccaacgcctagttgacccattcggtgacgggaccgcgcaacgtccttatgacaagtacaccgacccaatggacttggctttagccaaggttgatgctgcctttgaattttatcaaaaattaggggtagattacctttgcttccacgatcgtgacttagctccagaaggtgatacgttacgcgaaacgaacgccaacttggacaaagttgttgacaagatcgttgaataccaaaagacttctggtatgaaggttctttggaacacgtcaaacatgttcactaaccctcggttcgttgaaggggctgcaacctcaccatacgccgatgtctttgcttacagtgccgcacaattgaagcacagtttggaaattggtaagcgggttggctctgaaaactatgtcttctggggtggccgtgaaggttacgaatcactctggaacaccaacatgaagcaagaacaagaacacgcagctaagattttccatatggctaaggactacgctaacgaaatcggcttcgatgctcaaatgttgctggaaccaaagcctaaggaaccaacgactcaccaatatgactttgatgccgctacgacgattgccttcatgaaagaatacgacttggataaagacttcaaattgaacttggaaggtaaccacgctaacttggcaggtcacacttaccaacacgaaatccgggttgctcgtgaagctggtttgttaggttcattggatgctaaccaaggtgataagttaattggctgggatatcgatgaatacccatcaaacttatacgaaacgaccgctgcaatgtacgaagttgtcgaaaacggcagcattggccctcgcggtgggttgaactttgatgctaagcctcgtcgctcctcatttgccccagaagacctcttcttaggccacattgttgggatggatagctttgctgctggactccgggttgctgctgcaatgaagcaagatggcttcttagatagcttgaaggccgaccgttacagctcatacaagtctggtgttggtgctgatatcgaaagtggcaaggctgacttgaagtcccttgaagcttacgctatcgacaagccacaatcagaattgatcgcggcaacgcattctgatcacttagaagaaattaaggatacgatcaaccattacatcatcgatacgttgagcaagtaatctttgagcgtgttaagatataactaattaaccatgaaattggcggacggacggtgtgttcgtccgccttttttaaaccgaaaataactaggaggaatgaccgatggggaaatatgtacttggcgttgacctgggaactagtgccgtcaaggtgtcggccctagaccacagcgggcagattgtcgcccaagaaagctttgattatgatctgattcaacagcaaccaggatacaatgaacagaatccagaggactgggtttctggtacgaccgttgccattgtccgcttgattttaaatgaccacttggacgccagcgatattgaaggcttaagttactccgggcaaatgcacgggctggttctgctagacgaaaacaaaaaggttttgcgaccagcaattctttggaacgatacccggagcacgccccagcgagaagaaatcgaagccaaattaggcgatgaattcgtggatattacccgcaatcaaccgttagaaggcttcacattgacgaagttactttgggtaaaggaaaacgaacccgacatttgggcccaagctaaatactttgtattgcccaaagactatgtgcgttaccggatgaccggtaatctagcgatggattactccgacgctactgggaccgtcttgctagatgtcgcgaaaggcgaatggagtaaaaaaatctgtgacacctttgatatcccattaagtatgtgtccaccattgattaagtcggttgacttagctgggacggtaacccccgcttacgctgaattttctggtttgactacgactaccaaagtctttggtggtgcggcggataatgccgccggggccgttggtgccggcattttgcaccctaatatggttctatcgagcattgggacatctggggtggtcttgaagtacgaagacaatgcggatgttaactaccacggcgtcttacagttcgaagaccatgctatcccagataaattctattcgatgggtgtgacgttggctgctggctactcattaagctggtttaagaagacctttgcgccggctgaagactttacggaagtcgttgctagtgctgccaagtccacggttggggccaatgggctactctacacgccctacattgttggtgaacgggcgccctatgccgatgctgacattcgtgggagctttaccggtgttgatggaacgcaccaacgctatgactttgtccgagctgtgttagaggggattatcttctctttccgcgatctctttgacatctatgaagaaaatggcggtgattttgatacggtcgtttccatcggtggcggcgctaagagcccgctgtggctccaaattcaggccgatatctttaaccgtaaagtggtcagcctgacgaacgaacagggacctggcatgggcgctgcgatgattgcggctactggcttgggctggtttgactccttgcaggattgtgcggaaacctttgtgcactttggtaaggcctatgaaccaaaccctgaaaacgttaagaagtacgaaaagatgcatgcgatttacaagcaggtttaccaacagaccaaaacgattagtgaacagttgttagactatcggcgagcggagctttagactaaatcaccggcaaccccaagggggattgttggtgattttttgattacccaaaaaaagaaaacggtttcaaaaagcttgtgaaagtgttatgataagttcatggttggttgcggcaatcaaccaacggtttgcgagactaacttacacacatattggatagttgctagttatggaaacgacggtgaacgtcgtaataaggagcgagatttatgcgaaaagtttcgaccggatttgtttatttcttcggcgcccttggtgggttactcttcgggtatgacaccggggttatttctggagccattctgtttattcagaagcaaatgaatttagggtcttggcaacaaggctgggtggttagtgcggttttgttaggcgcaatcttaggtgctgccatcattgggccttcgtccgaccggtttggtcggcggaaattattactgctttctgctattattttcttcgttggggccttgggctctgccttttcaccagagttttggacgttgatcatttcccggattatcttggggatggctgttggggctgcttcggccttgattccaacgtatttggcggagttatcaccagctgacaaacggggaacggtttccagcttgttccaattaatggttatgacagggattctcttggcatacattaccaactatagcttctctggtttctatacgggttggcgttggatgttagggtttgcagccattcctgctgccttattgttcttaggtgggctgattttacctgaaagtccccggttcttggttaagagtgggcatttagatgaagctcgtcacgtgttagatacgatgaataagcatgatcaaacggctgtaaataaagaactaaccgatattcaagaatccgctaaaatcgtgagtggcggttggtccgaattatttggcaagatggttcgaccttcactgatcatcgggattggtttagccattttccaacaggtgatgggctgcaacacggtactgtactacgcaccaaccatcttcacggatgttggcttcggggtttcagctgcactgttagcgcatattggaattgggatctttaacgtgattgtgaccgcgattgcggtagccatcatggataagattgaccggaaaaagatgctaaatatcggtgccgttggaatggggatctccctgtttatcatgagcatcgggatgaagttctcaggtgggtcacagaccgcggcgatcatctctgtgattgctttgacagtttacatcgccttcttctccgcaacttggggtcccgtaatgtgggtcatgattggggaagtcttcccattgaacattcggggcttaggtaactcctttgctagtgtgatcaactggacagcgaacatgattgtttccttgacgttcccatctctattggacttcttcggaaccgggagcttgttcattggttacgggattctctgttttgcttccatttggttcgtccaaaagaaagtgttcgaaactcggaaccggtctttggaagatatcgaagccaccttacgtgctaagacaggcgaagatgctgctgaattaagtacgacaaaataatgaaaacgattacgaaaatggtgggatcaggtaaaacgggtctgaccatttttagttgtcatgggttagtggaaacttcccgacgcaatcgctttctttttcccgttttattcgctattatgaggttgtacctggaaaatttacttatctaaaggagtgaatggcacatggcatcaaatggaaaagtagcaatggttaccggtggcggacaaggaattggtgaagccatctcgaaacggttagctaacgacggctttgctgtggcaattgctgatttgaacttggacaatgccaacaaggtcgtttctgatattgaagctgctggtggcaaggccattgcggtcaagaccgatgtctctgatcgtgatagcgtgtttgctgcggttaatgaagcggccgacaagctgggcggctttgacgttatcgttaataacgccggccttggcccaaccacgccaattgacaccatcacccaagaacagtttgatacggtttatcacgttaacgtgggtggggttctttggggcattcaagcagcccatgcgaagttcaaggaattgggtcatggtgggaagatcatttccgcgacgtctcaagccggggttgttggtaacccgaacttagctctgtacagtggaactaagtttgccattcgtggtgtgacccaagttgcggcgcgtgacttagccgctgaaggtatcacggtcaatgcttatgcacccgggattgttaagacaccaatgatgtttgacatcgctcacaaggttggtcaaaatgctggtaaagacgacgaatgggggatgcaaaccttctcaaaggacatcgctttaggtcgattgtcagaaccagaagatgtggctaacggggtggctttcttagccggtcccgattctaactacattacgggtcaaacacttgaagttgatggtgggatgcagttccactaagctttcataattaaacacaatgaagggcctatccgctactagtggataggcccttttagctggaatataggatacaaaaaatggtcgtcagtaacgacgaccattttctggttggaagaattgaagcaaatggtgatactcgtgctaataacggaaggggggtcatgttatcagcccttactaacaagatagcaaagtcatgtgtaaaatgtgtcgcggaatggtatgaatccggtaaagcttgtcataacagtaattataaatggtgaatgaccacgataatggttattaaatggtacaatgatgtcaactaactttatcagttgaggtgagaacgatgattgcagattttgaaggttatattaatcgagttgacaatgcggcaaatcgcgatcaattacggacggtcttaacttgggttcaagaaacttttccccaattggagcagcggtacgcttggaatcagccgatgtttactgatcacgggacgtttattattgggttcagtgtagccaagccgcacatggcatttgcgccagaaggtcaggggatggtgcactttgccgagcaaatcgcggcggctgggtataatccggggaaaaagtttggccgcattaaatggacgcaagacgttgactatgatttgttgaaacaaattatccagtacaacattgaggacaagatcgactgcacgacattctggcggcggtagggatttttaaggggagaaatagagatgcaacgacaacagttccagcggggacggtggcagcagccattaacggccaccctattggcgttaatgatgatggtgaccctctttgcgttacggggaataacgccatttgggaaccataatctgttaatcggcgatttaggggtgcaatataccccgttctttacagattttgttcgcctggttaggcagcatacttggtcatttatgaatttgcaccaagcacttggcggcaattggatgccggttatcagctattacatattgagtccgtttaacctgcttttgttcgtggggcgggcgagtcagattccggtgatgattgccgtcattattatgcttaaagtagcgacgattgccggaaccatgaccttttatttacaagaacactggcgtacgacgagtcgatttgtgttggtatttgggctggcgtttgcgtttagtgggttcgtggccttaaactttttcaatgtgatgtggctcgacgccttgatttggttaccgctggttacgtggggcgtggatcaattggttcgaactggacggacggtcgcttatttcggctggctgttcgtcagtgtggtgacagattactatctgggatacatgacgtgtttgtttatcgtggcctactttggctacgtcatcacggcagagtggccgaaggggcaatcagtacgcgcatggtggcatcagcaacgcggcttgatttggcggtttatcgtcacatcattattgagtgtggggaccacgctagccatcttactaccaaccgttttgagtatgctaaaaacgcccaaggcgagtgccggattatcgaactttttcttggtaccaacgtttggattggaattttttagtcagctgggaatggggaccacgacgtatctgcaacggttaaatcatgcgccgggtatttttgtgtcaactttcgtggccctgttggtgctcgtttactttgcattgcctcaagttaaacgcggcgctaaagtgcgctcggccagtctcttgttagtggtcttcttagggatgtggttgcggggatttaataccgtgtggcacatgctatcggccccggctgggtacccgtttcgcaacagcttcttctttagttttgtgttaattctactagcagccgatgcttggcatgctggcgtccagcagctgtctcgtcgttggcgatgggggttaccaaccatcttgggtggcctgatgattttgggcacagtaatgattggtcccatgacgagctggacacaatcggcttactataccagtctccagccagttaattggggaaatttgacgctgagtgtgttgatactcgtgttggcggctggggtgttatggtatcggccgcagtggacaggattactgggggtcctggtcggcttagaattactggggaactttaatgtggcgctcacgggcgcagatttcggtaatcaacggcagtatgcggcagcttatacgcaggcagtcaaacgcttacggccccaaaccacggccgcaacggtatatcgaattcggaataacgtaccaaccgtggccgccgggtttgctgggcattataatccgtataacgacagtatgtggttaggttataacggaacgggcgcgtatagttccaccatttcagccgcgaccattcagatgagtcagcagttagggatttttactcgaaatgttcgccgtctcagtccacagggatttactccagtgaccgagctgatttggggcgtgaaggaaaaattaacgaccaccgggacgcaacgagtggggagttatgttggtatggggatggccgtatcaccccaactattgcgggtccacttatccgcggatgcaattaccaaccaggaggctatcctacaggcgttacgaccacaaacaacgccgtattttcggacggttacttcggggcatgatgcggtgtataccaagtggcagattaacggcgcagatacgacctttccgtataatcatcgctggtggattacaccgactgcaacgggtcgcctgtacttttatgatccgagcggtaccagtaagtattcgacgatgcgggttaatggtcacttggttaagcccaaatggtttgctgatcaccaaacgatgatggtaaatctggggcagtatcgccgaggtcagcgactccagttaacttttgcgagtcagcaggcgaccgtcaccgggatgcacgtggcaactttgccggctgaaaaaatgactgccgtgcggcaccaggttgctcagcatgccttgaccttgcatcagtaccgtggacacttacggacgagttatgtggggaacctgacgggaacggcgcaaaaacgttgggcgttattgagtttaccggccgaagacggttggcaaattaccgttaatgaccaacgcgtgactccccgaacggccttgcacggattaattgccgtcccgattcatagcggtgacaatcatgtggtgattcactatcatgtggctggtggccggctaggggtacttttaggtctactcagtctggggggctatgtggttttagaatggcgtcgccgcaattaaatagcaaagtaaagaccacaactagtagaatgtgaattctatcagttgtggtctttttagtatgctagattgttaaggtaacttgggttgctcgcgattcttggcaaccacttgttttgtgtcgattggtgcaccagtcgtatcggtgcgaacgacaaacacatcaatgtttgccatccgactgacataggctgtgacggagccttctaccatacgggcaacagcgctcatcccagtcgcgcccagaacgattaaatcattgtggtggtcggcgacaaattcatgtgcgatgaccgtcttgggattgccgaagcgcacgtgaatggccagctctttgaacccagtcgccgcacgcgtggtttcgaccagagacgttaagtaggccgtcgcatcttgtgcgaggtcatgaataacatcaccaggcattgatccactggcgtaaaaaccataatggttgattcgtaagacgtttagcaggtcaacgtgggcgtgctcactctgttgtgctaaggccacagccttttttaacgccaattctgcttggacggaaccatcgacgggaaccaagatatttgtgtaatgttgttgtgccatagttagccttctttagtgaattagacgcgaccttttaacgtaattgtagcggtatccaaaacgtgaccgttaatttgatgtaagagatcgttgagccaaaagccttccgctaagtctaatttggtattcaatgcatagacggttaggctgtagtcgtggtcttgatccggcggaaatgggccggtgtagttttgaaaaatggccggatcagtgttgcctactagggaaccggcattgctattgcggccatgcgtgtgtggaattgcattggtgcgcgaaacgtcggctgtaatttcacgcgtggttccaggaaagttcgcggcaacccagtgaatccagggaaatccgctaacgggaacggcatcgaaatcaatgaggttcagcgcaatggtttgcgtttttttaggcaatttggataagctgatcggaaatgattttacaggttgaccggcatagacgtcgtcacctgtggcgtgcttactgtattcatcggctagatagccattttcggttggcacaaagattcgcataaaacccctcctaatgattggtacttactcttattataccgcaggaggggagttattcgcgaatattcataatttatgtataaaaaaccgaatataataaaaatatcgaatataattccagaaatatattgtttttcccctgaactcgtgtatgataagtaccaattactggcagttcaggaaggatgactgagatgacgccccaacaaaaaattgaaattctacaaacgttaattcatattaaatccgttaatgctcatgagaccgatgtcgctgattatttggcaagcctctttgcgccatatccccaagcgcagattgaaaaggtaccgtttgcgccaggacgagataacttagtggtgacgatcggtaatcccgctgggcctcagcttggtttatctggccacatggatgttgttgcggccggcgatgagaccgcttggacgcatccaccatttggtggcgaaattgtggatggccggctttttgggcgcggtgcatcggacatgaagagtggactggctgccattgtgattaccatgctagagtttctagagcagggtacatcactcgcgggaagcctacgcttgctggcaacggttggtgaagagacgggcgaatatggagcagcaacgctcacggatgcggggtacgccgatcacctggcgggcctggtcattgcggagcccagtgggttggaccaggtggtttataccgctcgtggggtgattgattacaaagtggtctcaacgggtgtggcgagtcacagtgcgcagccggaaaatggggtgaacgcgattgataacctcatgaagttttatcatgcggtgggaccactgatggctaaacatacgaaagttgaccccgtactcggcgggttgctccataacgttgatctgatttcgggtggggagcaggtcaattcaattcccgcccacgcggaattaatggctaatatgcggaccattccagcgtatcctaatcaaatcctctatgacgaactggaagccttaattgatcggttaaatcaagaaccgggggttcaactggagctgagttatagttatccggaagaagccattccgggcgaccctcaagcaccattggtccagctggccaagcagattagcgatgacgtttgtcagcatgagacgcagattgtgggttccggtggagctaacgatggggccgaatttttacgggccaaagcggatttcactagtattgaaattggcccgggaagcgatacctcccaccaagttgatgaatatattgaattggatgattatttacaggccattactttttatgaaacgttggtcccggccttctttgcgcaaatcgggcaatcgagcaaacgtcagtaattctttaaaattctcccaatgtgactggtaatttcctgaaatctaggtatattagaaggtaattcgtaaatgggggaagaaggatagcacatggcaaagcaacaacgcccatggttaatcgcctatcatgtaggcgtgacagtactcaccttgtggtcggtggtcaatgtgaccttgatgtttttgaagtggggcgattacgcaatagaatttgcgattgccaatggtcttttggtggtattcgcggtcgattacctgttccgctttatcatgacaaaaaatcgaaaggtcttcttgatccaatcagcatttgacttgttgggcattatcccgttacacccggtgtttgcgttctttcggttggcgcgattaggccggctgattcgctatcaccatctcttctggcggctgggaatcgcgggaaaatggacgaaggcttatcatcggtttatctataagaccggcttcatctatttattttcgatcagtgtcgccatcattgttctaagtgcctttctcttttcgttaactgaaaagcaaagtctggctaattcattgtggtgggcgattacaacggcaactaccgtggggtatggggatgagacgccgcacacggcttttggaaaaatcattgccagttttctgatgtttggtggtatcggatttattggtttgttaaccagtaccattaccgattttgtgacggagcgggcatcaaaaaatgccgcggcccaaaagactaaggaacaagctgacattgtgttattgctgagtaagatcgacacgctgaccactaaagttgaccgattacagcaacagatcgagcgactgcatcaatctaaataaaaaataacagcggccctagtagcatcgtcatgctacggggccgctgttatcaattaacggacaaactttaaattatagttaccctgaccatcagacgtaatggtataggtagagtatccggcttgtaaccactgctgcttagaggcctgagcccagttttgggcgtcattgaccgatgagaacgtgtgggtactatcgaatgttgaatccgaagaagcagatgaagattgttgcggtgctgatgatgaactggtcgtattagctgagcttttcttcgtcttagcttgatctaatagattttgttcgcgggtttggatcgcatcattagattcatcgttaatgatgctttgtagtttttgtttttgcgtgacggttaacccgttgtcgttgtagctactgtacgttgagcgaaaactttcgtaggccgtttgttcggatgctgacgaactggctgcggccactgatgagctggcactcgttgacgacgatgtggacgagcccgttgtattgtgatgattgatggccaagaccaataaaatagctatagccagcgttaataacgtcataatccacggccaccaacggcggggcttgcgttgccgtcgccggggcggttgatctgacccttgattaaagttataccgttgtacgcgtgattttggttcttggttgttcaactgaaaaacctccatgtccagaacggtgtgaaaaaacaagtttgtcgttttaacgacaaactatcacactcctcatgataccgcaaaagggcgttagaataaaatgataccctcatttttccgcttttttcggtcaaatttccccagaatgagacggggtattgtatgatggaaagagaaacgaagtttgaaaggtggttttattttgcataatgatattccagacttacccatgaataacggtcatcagattccccagttgggcttgggtgttttccaggttgataatgctgaggatactaagaacgccattaagtgggcgctagcagctggctatcggcatattgatacagctgcttactatggcaacgagcaatgggtgggcgaagccatccgcgaaagtgatgtgccacgcgatcagatttttgtgacctcaaaattatggaacagcgtgcgcggctacgatgaaacgcaggccgccttccaagaaaccttagataagctgggcttagactatttggatctgtacctcattcactggccagccccaggttatttagacagctggcgggcgatggaagacctgtataaggccgggaagatcaagaatatcggtgtgtcgaactttaaccagacgcagatggctgatatcttggctcacggcacggtcaagccggttgtcgatcaaattgaaacgcatccttatttccaacaaaacgacatgcacgcttacttggaaagccaagggattttgcatgaagcgtggagtccactaggcggggaaaacaacaacgcattgaccgattccgtgattaatgaattggccgctgctcatgacgtgagtgccgcccagattatcttacggtggcatgttcaacgtgaagaagttgtgattcctaagtcaattcacgaagctcgtatccaacaaaatcgagacatttttgcttttggcctggatgaagatgaaatgaaggcgattagtgacctcgataccggcaaacgagtgggtccagacccagacgataccgcttggttaaagaagtcacagacctattctggtcgcaagtaagttaccgaaagggtggaatcccttgagccttggcttttggctctaattgctcagttagggcatttagaactgaaaagggaactttagcgaagggactcagaaatccgggatgatctggatcggggacatcctgattagcttttaatttaggaattaatgggactaggtcttctttgtggagacctagttttttggcgtagtagacggtctcacggtaagtaaagtttttgaaatagaagtaaaaacaaccacccgctgcggtaaagtaccagaagatggtccactctagaccaatcttagcagggtccaaaaagttcagccagatggcagcgatgacaaaaaggacatagagtaccactgaaacgccagcccagcgctgtttttgtgtcaaaataacggcctcatctccataatagtattgtatccagtgtacggggtaaacgggtcagaattcaagcgattttataaaatcattgccgatcatttcgttattgcttaacagacgtgtataataacacagtattgttaccaatcgctttaagaaatgagaggtagacgacgtgagtttaagtttcgagaccatccaaccaactgattaccagcaggtagaccaattggtgcaagcagcctttgaacccgtagaagatagtcaaggtaatgaggttgacctgattcatcaattacgtaagacttatgattatcaagctagtttggaagttgtggccaagccgtccattgacacaatagtgggccatgggctattaagtccggtgatgattcgtgggaatcggcatacaacgacaattgtggcgctggccccattagcggtggcccctgattggcaaggccaaggtgtggggagtgaattgctcagtgaattagagacgcgggctagaatggctggctttgcggcagtgagcgtcgtgggtgatatgacctattatggcggccgcggatacgtgatggctgaagactttgcgattcataatagcttgcctgtcccaatgggcagtcacctcatcaaacccctgacggccggggccttagcccatgtcggcggcatgctggaatacccggcaccatttctgggctaggttgatgggttaaagataaaaataaaattagaggttgacgggcatttctcatcgtgctattatcaaagtcaatcaaataacgaacgctaatttccattaccaagtagcgtgtcatctgggtgtcagaaagtcggtggttgctgcgaaccgatcagggtgattacgacgaaatacagtgggatgtcctggtccgccaggcgggaaataactagagccgttaccttctagtgagtggagtgactgggtctagaaccagtggctcaagttgggtggtaccacggtttagtctaaaatcgtccctgttgcagaagatgcagcaggggcgatttttttgtacataacttgagttaagaggagcgattaacatgaaagaaaattcaacgaaaacgggtaaaccaattagttttacagaggctttgatgattttgctagccatgctagtagtgatggggttaggggttatcaagtttggattatcaccaaccaccccagttttattggttatttccttggtgattctatgggcgaaggtccgcggtgccaattgggataccattcatgatggcattattgacgggattaaaactgggattattcccatttttatctttttactgattggggccttgattagtgtctggattgccgccgggattattccatccatgatggtctttggtttccatttgatttcggcacaatggttcgtgccatctgttttcctagtttgtgccatcattggtacttccattgggagtgcgtttacgatcatttcaactatcgggattgccctgttcgggatggggacaacgatgggcttcaatccagcattagtagctggggcaatcatttccggcgcgatcttcggcgataagacgtcgccgctatctgattcaacgaacttggcctcagccattgctgaatctgaattatttgcgcatattaaaaacttgatgtggtccacgattccagcattcttagtttctttggtgctctacttcttcatgggaaacggggcatctgatgcgaatgccatgggcaagattaatgcgacgttgaccacgttgaatacccacttctcgatcacttggtgggcagttcttccgattttggttatgtttgcctgtgcttggcggaagattccggccattcccacgttactgttaaatattgggttagctattgtgatgatttttattgaaaagcccacgacatcgttgagcagtattgcgacgatgattgaatccggatttgtgtccaagacgggtaacggcagtgtggatgccttactcacccggggtgggattagtgccatgatgtcgacggtgtcactgattattctgacactcacccttggcggattgctgatgaagttcaatgtgattcagacggtcatggccccattggctaaacgcctacacggaaccggttcattagtgacagccgccattctagccgggatcggcgtcaacatctttgttggggaacaatacctttccgttattttaccagggaaagcctttaaggaaaccttcaacgcgcgtggcttagataacttggcactgagccgggtgcttgaagatgggggcacggttatcaactacttggttccttggggcgtggcggccgtcttcgcggctaacacgttaggcgtctctacactggcttacctgccattctgtttcttcagtctgttgtcacctgtgttctccattctcagcgggttcaccggtgttggtctcaaacgactaccatctaaagatgatcgcagtgcgacagcagcgtccatcgcggctaatggtcggtagagtggaaagtgagtatcagtagaatagaatcagttagggttgggcctttgggcacggccttttcttatggattcagtatgctagccaattaggatagtgagggacaaaatatactggtcttgtgacggattcagcaatattcataatcacttacaaaacttacattacttacataactttctatatgtataaaagtgagcaaactcgatatatgattaagccatcagataaattaattcggaggcgacaaccatgagcgtgctcaaagcagttgaatcaacgttcacaaatgcagcaattattagttccatcacatcgaccatctttattattcttctcggcttcttcctacggcgccgggggacttttggcgaaaactttggtaaagtgttaaccaaggtcgcactgactgtggccattccggctttagcgtttaactccttcatgcaacccatggatggcgacgcttttaagcaaggtatgggggtcttagtttggggaattgtgatttatattcttttgatttttatcacgcccttcatgtatcaacgttatgttaagggacaacgtgaagttttagcaatcttaaccacgtttggttccacaactttctttgggattccgattgttggcgccgtttatggggccaaaggggtcatgtatagttctatttttaacatcgggtaccggatcttcctctattcatacgcctacatcaaaatgtctgggttgaagatggaagccaagaatatcaagaagatgtttgccaatcccattgtgatcgcaactttcttggggctcttcttctggttagcccaacacctcgttccccaagtgacagtgcatgccgcgattaacggcgtacaaaccactgggatgacgaccgttgccttttatcggatcgatcagaccgcactgtggctttacaaacccctgacttacttagcgaacttatcttcaccactggcttggttggcaatcggggtaacgctggggtccatttcctttgccgatgcggctaaggacaagacaccctggtattacgctttaaataaagttatcttggtaccgctattaaatctcgtgatcctttggctcttggacatcaccggtattttaccgttgagtttcgtcgctgttgccacggtagttgttatgatggcaacgccaacggcttctgtagcttctgcgtatgccattagctttgaccgagaagcagtcttgtcttccaatgcatcctttatctcgaccatctgtgcggtagtgatgatgccagtttggattgccattctccaagtggtgagtggactcggcgtgttccattaaagaaaggaagtttcctagtatggtaaaaattacatcttacggcgtccgaccgatcgagcaaccgtatttcgataagctaaataaatatgattttgacatgacttatgttgaggaactcctgactcacgacaacgtgacagcggctcaaggcgctgatgccgtattagtacggggtaactgtgtcgttgaccggcaaaacctcgaggcctttgcgggttgggggattaaatacgtcttcacgcgttccgttgggtttaaccatatggacctacaggccgccgctgatctgggcattgaaatggcccgtgtgccgggttactcgccatacgctgtggctgaattggccttcacactcggcatgacactgttccgccacgtgaacttagcgatcagccaaacccgtcaggcagatttcacgatctccaatgcgatgtttagcaaggaaatccacacggcaacggtcggaattgtcgggattggtcgcttgggctacacggaagccaagctgtacaaggccttgggtgccaaagttgtggcatatgatccgtatccatctgatgccgctaaagagctggctgaattagtggatttaccaacgttattagcccaaagtgacattgtttcgattcatgtgccatatttcccaggtaagaatgaagatttagtcaatactgactttattcagcaaatgaagtccggtgccgttctcattaatacggcccggggggaactggctaacgtgccagccatccttaaaggtcttgaggatggtcaccttagtggctacgggactgacgtggttgctgacgaagtggcaatcattggtaagcaattcgccagtgtcaatgaagtgcctaaccaaggggttcaagacttactacgagctaatcctaaagtgttgattacaccgcatgtgggatcgtatacggaaccggccttacaagatatgattcgcattagttacgataattttcatgatatcttaacgacggggaagacagctaacgccatccacgcctaatcaagtgagcgtgagacaacaagagctcgggacttttgtctcggactcttttttgccgcaggcgtttcagttgcgacaaaccggcctggtcaggtatattggcaaatgaggtggcggatgtgcagagattgaagaaacaactcccgttttgggccattgtgattgccgtcatggcactagcaattggggtatcagtggcaacaacggtggtcctgatccaccgggatacggtagcggagaataagcaaacgattcagcgacgaattctgcgggtggcccgttcgactgccaaaatgccggcagttaaacgggtcattcgtgcctccaatgcgggagctgatacgaatttacaaacagtgattaaaccgttggtcagtcgcgatgacgtagattttattgtggtgatgaaccaccagttaattcgtttatcacatccacgagcgaagagtgtgggccatcattttagttcagttaaggacccagccccagcattacgtggtcagattcactattcccaaaagcctggcgtactgggaccagagtatcgggtattcctgccagtttatgaccgtggccgcgttattggagtcgtctgtgttggcctaacccaacagaatttggatcagcagttacagcataagacccggcctatcttgctgggcgggttactgggctttctgattggctgcattttggccattttattgggcatgtatctccgctatctgttattaggcatggaacctagcgagatttccgaacggattgcgcggcaaaagttaattgatgattcattgccggaaggaatcgttgcaattaaccgcaatgggagcattatttctgcgaatcaaacggcacagcacctgtttggtcagccgttatcactgaatgaccccttgccggcaacacttcgggcactcttatttgcgccagcgacccggcagaccagtgggagtgaagtggcgtttcaagataaacggctattggtgacgaccaatgatctccgagtgcggggacgggtaatcggacaagtctcgcttattcgtgatatgtcagccattacgggcttgattgataaattagccggaacggagcattacatctcgtcgctccgggcccaaacgcatgagtttatgaatcagctacaagtcatcaatggcttactggagctggctgagtatccccgtgcgttgcagtttatgcaggaaattactaattcctatcaccaagacgtcggagcagtcacggacaaaattaagtggccggccatggtggggctcattttgggtaaacgccaagaggctaaggaacaagggttttcactgactatcgatgcccaatcggcggtgactcaggtgaccttcgaaaatcgggtggaagttctcgctttacggattgtcagtaatctattagataatgcgattgcggcaattacagcacccaagtcgaccgatcaggtgacgctgcggttagtactaacggcaactggcacattaacaattgtcgtgacggatacgggcagtgggattagtccagcggtgcgcacccagatgtttacccaaggcttctcaactaaggggccacagcggggatatgggatgagcttgattatggctgctgtaaccacgctgaaggggactttagccataacggccaattctccccaagggacagtggtgacgattcaagtggagacgggagcgccaaaatgaaaatattaattattgaagatgatccgatggtgcggttgattaaccaccgcttcttagaacgcattccccaattacaggcggcaacgattgtggaatgtccgagtgcagtggcagcattggcacgaccggatttagcagaatatacgttaattctattagatatgtatctcccccagttaagtgggacggaatttttggctgagctcttaggccgtcagctgcatccgcaagtaattatgatgacggcggctaatgaccaacaaacgttaaaggaagccgtgaactatggtgtgttggatttcttaattaagccctttacgttcgaccggtttcaacaagcaatggctaaattcacgcggttattggcagtggatgataagcacacggtgtcacagaccgacttggatagcttgttcttgggggcaacggtgccggtttcaacaacgaccactgccgaattacccaaggggctaaccaagttatcgctacagcgaatcgtcacggcgctggcaaccttaaagccggggttttctaatcaagatgtggcagatcaaacggggttatcccgggtctccaccaagaaatacgtggattttttggtagctatgggctatctgacctcagcgattgtttatcagagcagtggccggccgttgaccacctttcaagttgtgccaactagtgagcggctgattcaaccgtacttaacatgaacgaaccaaaatggacctgtcagaagacttaacttctagcaggtccatttttataatggctattagttgccagccgtaaagggaaccaaccgggataacggattcgttttgatcgaacgataacccagccacccaatcaggatgacggcaagtaagctcaggctaatcaaccaccataacgcactggtatagccgctgttagccccgccatagagcgcattaaatgttgagtatacaccttgagacatcggtgtgtgggtactcaaccagcgataaaagccgtttaatgctggccgtgggatgatcgcaccacttgctaccacctgacttactagcagtggcagttgaagaatcatggaaggaagaccaccgcacagaaaggcaatggctaaggtaaattcaaagaccgctaagccaaagagtacctgaacgccgaatagttgccagaaagccgaactggagaagctaattaggcagcggagcgttcctagcgtaacgagtggggcgactagaacgccgatgaatccgttaagctggacagcaagtaaggcagaccatttaccgataacgtggcgagcactcatgaacatcagggttaagacgagactcatcagcatgattcctagagttgttgttgctggcgctttacccgagcaattgcttgttgttgcagttttttcaattgtgccggttgttgtgctagctgaggtgattttgccaaggaagcctggagttgttgtttaacttgctgtttagccacggcttgttgcttttgcatgagggccttgccagtcgattgtgcgagcatctgggtgaccttggccgtagttaattgggaggcaacttgagtagtgacttgagtagtgacgtttttggtcaccatgttttgtagcaagccgttcgactgattaacggtatacgtcagcttaggcgcttgtccccgggtgactcgctggtagaaacccttatcgatttgaataatgagggcagcctgccgcgtatttaactggcgtttggcgttagcaaatgaggtcgccgtgaccattttaaagggcagtttgttttctaagtgcgttgcaatattcttggagacagatgattggtcctgatctaggacaacaacgcgaaggttttgggtcccactggggagcttgttgaatccgggaactgctgccaagacaaagatgagaccacagaccattgctagaataatggcaacgtatgctaagggatgtttaaaccactttttcaatgtaaaaacccgctttctttttgcgtgcaggttgattaatcattataatggacacatctgaaaaagtgattatgggagggataattttgggtgagcgaaccgaggattatcgttatgtcaaaacacaacacaagatttacacagctttaattgcgctattaaagaaacgggcttttgatgatattacggttagggatctctgtcaggccgcgcaggtgagtcggagtggtttctatctccattttgtcgataagtatgacctggttgacagctacggtcgtgatctggtcaaaatggggatgcgattattttacgcgaatcggggcaacggcctggagaccttatatacggagctgttaacgctgattaatgaacagggcgatctgattacattgctgctatcccggaaaggttcagttgagattcagaatcaaatcaagaatcaattacggcagaatgccgctgacaatatcctgccatattatggcattaaaaatcagtcaccagtagcgcaacgttacctgattgccatgacaactggtgcggtgcttagtatcttgcaggagtggctggattctggtaaacaggagtcaccagccgaactagtggcggtcatgcaagagcaggtgatgccgacactgcaacgtagccaatttcggctttaaaatgagccaataaaaaaaactcgctaggtgctaatgcacgtaacgagttttgtttaagcggaacgctacccgcaataaggaacgggtttactgtagtaatagccttgcgccactttaacattgtacttttgtgctagtgcaacatcagctttatcctcgatgccttctaaggtaaaaccgaggtggtagatgtcagcaatttggcgccaagcgtctaggctgcccatcagttccccctgtcgatgttgtaagcggaagttctgcatggcaaatttaatactgtccatgaacggtaagacgtcttgaacactgggacaccacgggttgtcagtgccgacatcgtctaagctgagcttaataccaaatgatcggtatagtgccacgtagcggtgtagctcgtctaatgaaggagtctcagtcaattcaataatcagtttcaaattcttaaccgactttttcaagtggatcaagtggccaatggtacggctgtcagtgaactgctgacggttgagatttaatgaaatttccggattatctggatggttttgtaaaatattagtaatttcttggtaggatagcgagacttgttgttccatcggtagtgccgtgaagtctttaggcgttacccagtagtcatgcgaatatgaacgcagaagaagttcatagccggcaagtttttgcgtgatggcgtcaacttgtggctgaacaaagaatcgatacatgaattgaagatctcctttctacggtaatttaaaagagacatacgatagtgaccattatacagcatgtgggaatcaatttatagccgtaatgatgtgtgaacgatggtctagatagccccagattagggaaagtgtcctcataatggcttgataagatagcaaaaatagtaacacttttgagaaaacggtttcgtgaagcgcattcacaaattagcgggtctagttgtaagaaattagaccgattaggggataaagttaaacaagggacgtattatggcggagaacttaaaacatggacgtaaattggtgatcaaaaacaggtagtttcagaatgatactgaaactacctgttataggtgctaaccaagagcttgttaagctgccaattagtctaagtttaattcgtaagcacgacgagcgttgtcgccgggttcggcaacgtgaatgatgccgcggtattggtagccaaaactagcggcaatagcttgcattcgcttgttcatattgtgggtgtcaatgcggaagttatggatgccagtttgataggcctgactgatcaggttagagaagaaatagtggctcaggtgttgaccagcaaaggccgaacttaaggcaatccgatgaatcgtggcataggtgtcggtggtattttgccaaccggtcccggtaatctcgtggtagtcagcgttgtcaccgaccacttgggcagcggtaccggcaacttgaccatcaacgattaataaccaactctgctgattgttgatatcagcggtaatcgcggcttcatcgggataaccatcttgccactggggactgccatcggcttttaagagcgctttggcattggcaataattggcatgatagtgggtaaatcagctagtgtggcctgtcttagatagatcaaactcatgagatgtcctcctagaaatacgtgttatgtcttagaataccactttcgcggctattgaaaaacgccgagccaatagcccgacgttttagaaatcagtaaaagctatgttcgaagtcttccaggtagcttccaatggagccaccaaggagactgccggcaataacgaaaagaatgaacaaggccaagcttaaagcaacttcggccaaaagaatggtataaaatttatccaaacgagttgtggttacatctgcaataatactgtagatatagccaaggtttaagataagtagtacgggcgagaagaatagtaacatgacattaaaactgccgaagttcccactactggttagtaagcagagtacgaacacaatgagattgaaaatcaaaatcagattggtcagactagcaaaacgattggtaaagtcccagtaagtttcggtgtggttaatatcaagcaatttacgaaaaccataggctaatgatacgtagatggcgcaccctagtaccaaaaagatgaaaagaaagaagctcgccttgaagatagtgccgccgaagttaacttgttggtcggttaaactcctcagggtactgtttgcggcgtaggctaagcggtgtgccagtgttgccaccgtaagaacggcaactagaatctcaagaagaaaggccgtgatcccgaagtagcgatgtgtgttagcttgcagggtcgctggttggcgaatcgtggctaaccaccatgagaaaaagttgccagagaagcgtttggcccgctcgagtgaggggttgggctgagtagaagtagctgacgatgttgtttggtcagttgggttcgcggttggttgtttgtcggaagtattttgcgagttggctgtcaatggttgaccacatttgggacaaaatttggcattagcctgaacttcattgccgcaatgcggacaaaacttggttgtattagtcattattcttgataaactcctttagtcgtcgtcgctactctttgaggtgtcactgatcttttgggcagcggaaatctttgtgattttattcgtattgccagagtcattatcactatctggtttgacagtggccgtgtaggcatatacctgaatgtgttcatcgtcatcgtggtagaaggtgtacttaacggtgtaggtgactaagctagattcatcagttccaggggccacatctttaacggtgatgtccatgtcaacggaatcaacgtcatcatccttatagtagccctcagccattttgacaagttcttggtactgactattgctagtaccgtccatgaagtaatcgggtaatgatgaatcgtcatcgctagtcacgctatcatcgtcgtcaccttcattagctaggtcatcaaccattgagaagacgtcactaatgagatcgtcggcagtatccttgtcgattagacctggatagttaagcgcaacgtcgtagccgtcgtcactttcggtaaggttagctgttttagtcttaatgaggctgtgcccaactttataagtcgcataggctttcatatcttgagaccaaggctcatctttcattgtcaataagccactactgtctgctacaccaagttttttaccgtttagataaacggttgagttggctagcgtcttgaaagtgacggaaattgtttttagactaaggtcgtaggtggcgttagtggtgatatggtagctggccttattggtaatctggtggccactgacagtgccgttggacgccaaggtatactggccgggaaccatggctggtaattttttggaataataatcactattagcagttgcgatttttttgccatcgagtttaatgacagtatccttgtgattagttgtgatggttggtcttaccggattaacggttaattgatacttagggaagaacagcagatgatgcccattttggccgtaagttagtgtttcatcactgcttacaccaccattttccaattcagctttcagggttgccaatgccttgggatgctgttggtaataacgtgacaaaggcttcattgaagagttcgtcagctttaaagcggaactattagtggtgactgatgttgtgagatttttcccggttctgagatgggttaccacccggttcaatgttgcttgccgagagtaataatgattaccccaaatgccaaagataaccagtaagaggataataatacttaatccccagccccaacgtttggttttcttcgtcatcggccgtcgctgagaacgttgcggcgttggggttttaggctgagccgttgccgtatgggcttcaggggttgcggttttaagattataaccacaattttcacagaaggtatcaccttcagccacgggatgaccacagttgggacagaattgatttggctgaccgccgggttggttatcagcgggcagagtaaaacgcgtgtgatgcatgaaaattcctccagtaagtcagattgcatgacagccttaatccatcgtcagcaactttttctgaaaaacggcgcttataaatatgtatcaataaaggttcagcaggtttagctatggtagaaagagatagtggactcggttgcatgatggattaaaacttcacataatgattattatacgctaaagctaagttaatcggcagaatattttggctagttggctgactggcaaaagtaagccattatcaattgctgccggacaccaccgtgctatcctgacagcggaggtgtgacgtatggggaaaaaattcaaccaccacttttaccggcgttggctattttggtttggcattgctttttggatagccgaggcgctctcatggtcatttgataactggtcggttaagctgttaggcgttgctatggggttgtttttaattatttggagtatggatggcgagtagttgtgcgtcgtgaaaacgcataaaaaaagcgctcgaaaatatcgcgcgctagaggtcattagtgattttgttgagcaaagtaggtttgggcggctgctaacatgtcagcagtttgctggtttaacaagggtggtaggtcatctagagggaagtactggaggtccagtgtctcatccgtggctgctgataggagatgcccgccaattggctttacccagtacagttgggagatcacttgggtgacgtcaccgtttggataggtcgtaaatccttggtcgaagattcccagtgactggataatctcaacatccaagccgctgtcttctttgacttcgcggatgcaggcggtcgcaaaggtctcgccgtattctaagtaaccaccgggcaagctccagttatgcgtatcggtccgtagattcagtaaagtctcgtgtcgctcgttggtcaccagaccaccagaggcattaagaatgatgggtttgtgaccgacgagttcgcgaatttccttgatgtaatttgccatagacgctgacctactttctactaagagttaggttcagtatacccgattttgggccgtagggttagcggggctgatgccaggtgtccgccaaaatgatagcgatcagcagtagcaggcacgtcaagaagaattcgataatgagggcccaaagtgcagttcctaaaaattggctggctgcccagtcgataacgaggcaggcaattaatgaaataataaatttgacccaccaatcaagattgttccttaaatttttcatctaaatctcccccataaaactagctactcttagcatatcaaggaccgaatcaaagaacaattattgatagacaattcgagattaaaagccgttatttaggcgataatcatgaacgttagtcagttgaacggtaaaacgcgtgcctcttttccactagaaaggggcacgcgttttaagtaaagttaagcttatttcttgatccgcttgtaattactgtcgaagtacttgccagcccggatgtcgtcgggcatgccggcgtatggggcttcgctaataacatcttcgttgtcttgaccagcgtcacccatgtacgtgatgttggcaaattcgggtacgactaacttaggataagtgtcatacttttcacgggattcttccattaaatcaatgtgttcgttttgataagttaccgtgatttcgggatgttcttcaacccacttagggaagaagatggtaccgtttagcttcttttcgttgggaacgaaatcaagcgcaacgtcggttcccgttggttctgtccaggcaactttgtagatgccgggaaccagcatcacaatgttggctgcttggtcagtaacccaccgcccagcgaccatgccaccatggattcggtaatcaacggtgtggtcattcttagcgtaccattcgtattcccagccgttgtcgtaggtgtagatgaagtgggtacctaaaaagtcgtctaatgttttgaattctttagtcatcataaagcgctcctttttaataacgaacatgtaattaattacatgtttttgtttatgtgattactgtaacgcgaaatttcggaaacgtcaataattttcttgcagtttttttatgaaactggttcaatgaagacaacagtcaggcaaggaggcggccattatcggtcagcgaaatcgattacaatatattatcttaggactgctcaatcagcggccacagacgggttatgacttgaccaaggcctttgaacatgagatcggtgagttttggcaggcgcaacacagccagatttatccgatgcttaaacgcttagaaaccgccggtgacattacccatgaggacaccgttagtggagaaaagctggctaaaaagcagtattcattaacgccgaccgggcatgataagttggttgcgtgggtgagcgagccatcgccagagttgacggcgaccaaggacgagtttattttaaagctctacttcattaagaccagcgatgatccccgtttgcagccaatgttgcaggagcaagcggctttacaccgggcgcaactggcccatctgcaagagcgccagcagacggtttttccggttcaaacggccattgaccaggcgtacgggcattatttgattttggatcatgccatcggccgtgagcgctactatgtcgagtggttggaaaaatacttgagttaaatgaatagacgaaaaaggttccgcaacgacggatatagtcgggttgcggaacctttttcgtgtctagcagaatgatgattgaggtggggtgttaccaacgtcaaagttaggatttatcctgctgaagcagtcccatcatggtagtttgctggaaagtagcgatgagatcgtgaatggtggtcaatgattcttgttgtccgcccaacaaccaatcccgccaaatggcgtagacaccagcactcataaaactaatccagtaggtctgctgagtcgatgtgatcccgtgccaggtcgcgttagtcgcatagaaggtccgcatattatcattgaagacctgacggataatgtgttcaaatccccggtctgcggagagtttgagggttgttgagaaactggtgaagaagtcgccaagtgcctgcaacttgtcggctgtcggtagcttggcgatatccgcaaagcgggctgtcatgatgggaccaaagtaagctgtgagcacgtcgtcaagggtattgaagttacgataaaaggccatgcgactaacgccagcccgcttcaccacttgagtgaccgttaagtcggctaaatctttggtggctaataattggaggagggcggtcgctaagtagtcttgtgaatcttgtttaatttgttgggcgtgtttggtcgctgccattacaattactccgttctgtcatagatgctcgtgattgccttgaattaggtctggggtcattgtatgctactttcacagacgttacaagtgaaacgaaagcgagcgtgaataatgatgaaaaaagaattagtcgttataaccggtggaagtggctttattgctatccatattattttacaattactccagcaggggtatgccgtgcgaacgacagtccggtcattgaaacggacagccttaattcatgagatgttagcaaccggtggtgtgactgatctaaccgacttggagattacggaagccgacttaaccagtgacgatcattgggcggcaacgatgacgggagcgacttacgtgattcatgtggcgtcaccgacccctaaccgggtttaccggaatgaagatgagatgattcgcccggctatcgacggggtcttgcgggtgttgacagctgcccgtgatgccggtgtttcgcgggtggtcttgacctccgcttatggggcgatctttgcgggccatcatcatcgaacgaccccctataccgaagcggactggtcggatgtgacggcgaagaaaattcacccttatcaaaaatccaagacattggctgaacaagcggcttggcaatttattaaaacggcaggacgagggatggagctagcggctgtaaatccagttggtgtgatgggtcctgtcttggcgagtgattactcccattctaatgtccagattcaacaattactggaggggcaggtgaaggccgttcccaacgttgattcgggatacgttgacgtgcgggatgtcgctagtctccacttgctagccatgacgcaaccgcaagcagctggtgaacggttcttagcgactaccggagaaacgttatctatgttagacgtcgcgaatattttacgggtagcctttccgcagtttgcatctaagttacccactaagacaatctctaatgcggcaattaaagcagcagctctggtaaaaccagatttgaagatgattgcttctatcgtgggtgaatacgcggaaactagtaatgctaaagcggtgaatctgttgggatggcagccacggtcggccaagacggccatcattgctacggcgcagtcgatgttagacttaggcatcgtacagggataggttgaaagttaattgtattgttgcttatgcaacaatatcgtggtacacttagccccagaaactaaaaggggtgatggccatgctgacagtcaagcagaccaatgaattgaccagtcaggaactggttcaggtgctaaaggagcgggttgccgtcttcgttgtggagcagaattgcccgtatcaagaagtggatgccaatgattttgatgaccttcacgtccagctaacggacgatgctggtcaattgcaggcgtacacgcggatcatggatcgcggtgattcggtgacctttggccgggtgttggtggttaaagcttatcgaggtactgggttgggccagcagatcgtgcaggcaacgttggacgcaatcgccaagcggtttccgggcaagcctattcagattcaggcgcaggcgtatttgcaaaagttttatgccggatttgggttcaaaccggtctcagcggtttatttggaggatgatatcccacacttagatatgcgtttggaggcgactcatgactgacgtgttacgggaagtgggcagtattgcgcgggcgttggattcgattgctaacgttgagttcaagcaatatcagctgacccgtggccagtacgcctatctggcgcggatatgtgaacaccccgggatcattcagggccagttggccgagctgattaggattgatcgcaccacaacggcgcacgcggttaagcgactgattgacggtggcttggtgtatcgcgaaccgctacctggtaaccagaagagtaaggtgttgtacccgactgaaaagggccaggccatctatcccatcttgaaacgtgaaaatgattattctaatcaagtggccctagcaggtttgtcggcagatgatgtggctacgttaaagcgaatcctaccggtgatgagtgccaatgtcacggcggattggcaacgagtgaaggccggcgaaaagcgagattactaaaatagaaacaccacgatgacaaccaatcgtggtgtttttttgtagatcaggcgattaaattggaataggttgtagtttaggaaaactgttatcagctagccagttttctttatttgtaacataggtcttcgtactaaataattgataatttatgtataattttgttaataataagtatatcataaggtatggataggtaagcggctgatcagcaccattggggaatggttttaatcatctatttggtagaagtttcatgtagctaaattcggtagcgctgaacctttaaactcttggaggagtaaatggttttctagcgtgaagaacacaacgccgggatgatcacgaattgcgtgatatctcggcgttatacataaataaagataggcaatagatgaatttcagaggacgattacaaaacacacttcacgtggcgtagcggaattaaaaattatcgaataattaagacgggtatccattaattagtatgattcggtggaggaagaaggctgttatgaaaaaaagaagaatcctcattgcgacatttttgattattgtagtttttactatttcgggaataacgggcgtgtgtcttttgatacccaacacaccgtaaaaggctgtgcgctttaccattctgaagaatggtcacccgattattgcattgacagagacgcctaagaaggtacccgggggtagcgtatatggctattccgggaaaagagcttggcggtattataaggttaagacagcgtttgatgcatcaaacggggagatcaatctaaatacattggcagttaataagcctaaagtaggatcaaagttttatcgggtacatgtggtttattctgtggcttagtaatttggtagaagtcctataagcccaatcatgctggagtcttaaatatgcataacatgtgggtaactttaagcttagggagatgaatggcatgcagattgccaagttgtatttaaaaggattggttccatttgttttgattatgttaattagcaattatgatgtggcgcaacaggcattacggttccaattgagttggtggaatgtttacctgatcgtgagctatatcgtcatttttccggccatttatttggtgacgcggcaccatattgagaactcgcgggattttgagggacaactcaatcagccacgaaagaatgcggaacaagaagcgatgtgactcggttcaagctatgccaatacgggcatgtttggtgtcaccagaatcggtgatgcgcagggcaaagagagctggctagttcgatggggaattgactttattacgcgtctctttttattattctgtggtgtattcgtgttggcctatcggttatggcaggatcgacggtaagtcatcccggtgtggccttgtggagcggggggatcgtgtgaaacgaatgctaatgataatctatcagcgatgtttgagcttgtttttcttaggcgttgtcatcgttggcgaggcgatcatgacatcgcaaaccacgatgaacgataccgctaccgggattgttaaagtcagcatagccagtacgttagtcgtggttgttctagcctacttcatgacgtttgtggtgtatggattggtagctggcggtgtttggctctggcagcgccggtcgagctatgaattgctggttaattttttctctaaaccagcacgggccgttaacttcgcggtaattattgggttgttattgctgggaagtgctaatgcctattttgaggactatttaccatcccagacagccgagaagtcagttaaccgggctatccagcgtaaccggctaagggaactaaccacatctgatcggttgtccgctgagttaaaacggggtcaggccgttgccataagcgaagaattaaccatgagcaatcaccagcacatctatttggccaaccttaagggcgacaactccggaattgagataacgttaacccgacaacgacgggacttactggggattgtggccagctaccgtgtcacgaagatctcggatgagaatggacgcggtatctaaagctacaagaagcccaatcagtattgatacgaatatgagaagggtcggggacaaaagtctcgggctctttttgcgttgccaaatattgagtgccgaaacgtgcgccaaaaggcagctggcgagcattagccaccttttgtcccccctcttttttgaacgccaattttgaatacatcgccagttacggtgcgaccatgtttgccaattaggaagtttttcttttatatataacacatgtgacatataatatatgtattgacctgataaggaagcgataacggtgcactatggtattttattattaacgtttttaagcgttaacttggatttctttttcatgctgatcttcttactcagacggtatccggtgatcaaagttgtgtggggttacctgctgggaaattgggtcttgctgattttaagctacctgcttggcaaggcactgctactagttttgccagaatggttactagggattttgggtttcctgccgatctatatggccttccatgatgaagacgatgcagatgggcataaaaccagtcggtcgccagtgtggagcgttctggtcacgtacctttccgtttgttcgggctgcaatctagcaatcttcttgccagtgttggtaggtgaaacgttgccgcattttatgcttgcattgggatttattagtctattaacggtgggggccgtcctgctggttaaaggcgtggctcaggttccagcggtggagacgctcatggcgcagcgcggtgagcagctgatgaaactgtgttatgtgttgatcggcctctatgttttttgggacagtggcttaatcagccatttgttcggttatttgccgtaatggaaaagccaaccgcattaattggttggctttttttgaacatacaggtaatcggctgctgataagttgacgattatttcttcgtgggccgtggtttccaagtagagaaaattcaggtcttcatcgcgacgaagcaaccaaagaggctggttaattgtgaggtgacagtgttgaaaataagccaccagactgggcgtttctaaatagctgaccagcttggttggggtgcgatcacttagctggctgaggggcatgacggtagcgtcattgagcaaatcagtcgtcatatccccaccaaaaggactttgctgaggatggtccagaaaggtcgctagggcggttacagttggtggttctaaagtgtcagccatttgccacgcctgttcgggaatttggcttaaaggtaggtgcaagtgctgggctaagaagacctcacagaggcgatatttataaagcaagcgcgttgctaattctcggccttggtcggttagcgtcacgccggtgtagcggtgacgattaaccaggccacacttttgaagttggcgcgtcatctcggtgacggtggctggcgagacgttagcgaaggctataatctgtttgttactcacccgtggtcgggcaaaattacattcagcaatgattttaagatatgtatggtgatttaacatggtggtcactccccccagagctaatgatgttaaaagccccaccaaaccgtcgctaacgggagcgctggtttggtggggcttttagcttaccggacgacgagaacggaaattggcgcgtacttcgccatgtaagcggcctgacttcccagatactttttgggtccttttttggccagcgagccgacaatgaggacttcgggcttgatacttggaatgaccgtgttcacgatctccttaccaggatcgccctcggcaataacggggaagacgttttcaacgcctgcttcatgcgcctgctggacgtattcgttgacgtgttcgactaattgggcacgttcaccgtgaataaagtccttacttagggcttcatagacgctgcggtcgtcgctttccaaaacggaaacaatgtagagttccgcgtcttctaagcgggcccgcttaatcgcatacttgaaggccaactgtgaatcagccgagtcatcgacccccacgaggattttggtaaaaatcttcttttcagtcatagatggagacactcctttcgtatagaagctggtatgtgcacttacttggcagaccaagcttcaggcggtttagacaatcgttgcaagttaaaccgtcttcttttttaatttctcactcctaacgaaacaagtcaagcaaaatccgtcttcttaaataaaattgttcggccatagtgggataaattcgattttttacaaaaaatattaagggatacagaactttaatatttaaatttcattagctgcctaagtccttgatattactgagttatagtcagatgataaaagtttttgaaagcaatttttttgcttaaataatggctgaataaacttttgtacgcctaaaaagtattttaaaatcataaattttaatgtacaatgggtcatggatttaaggaagggagtcttaaaattgagtgataatgttcaaaagaaacacaaattaatctcttatgccaacgggcgttcgttggaggagattaacggtagtgtggcagttcccaaaaatatcagcttctggaaagcgttgtttatgtattctggtccgggtgccctggtagcggtggggtatatggacccaggtaactggtccacgtcaattactgggggccagaatttccagtacttactaatgtccattatcttgatttcaagtttgatcgcgatgttattacaatacatggcggctaaacttgggatcgtgagtcaaatggacttggcccaggccatccgtgcccgaaccagtaaatcattggggattgtgttatggattatgacagagtttgcgattatggcgacggatattgccgaagtcattggggcagcgattgcgctgtatctgctattccatattccattagtgattgcggttttcattacagtatttgatgtcttgctattattgttgctaacaaagattggtttccgtaagattgaagccattgtggtctgcttgattttagttattttggtcgtctttgcttaccaagttgctttgtctaatcctgattggggtggtgtttttgccggcttgattccgagcccgaagacgattgcctcaactcctcaaatcggtggtcaaacgccaatttctggggcgctggggattatcggggccacggtaatgccccataatttatatttgcattcggcaatctcgcaaacgcggcaaatcaatcatgatgatgaggaagacgttgcccggacggttcggttctccagctgggattctaacattcagttgactttggccttctttgttaatgccttgctattaatcatgggggtggccgtcttcaagagtggtgcggttaaagatccatcgttcttcggcttattccaggccttatctgacaccaataccatgagtaacggggtgttggccggcgttgctaagacgggagccttatcaaccttgtttgcggtcgctctattagcttcgggtcaaaattccacgattactggaacgttgacgggtcaagttatcatggaaggtttcgttcacatgcggatgccactttggttacggcgattggttacgcgattaatctcggttattcccgtcttgatctgtgtcatgatgaccagtggtaagagtgctattgatgaacataccgcgttaaatgatttgatgaataactcgcaagtcttcttagccttcgcgttaccattctcgatgctaccgttattgatgatgacggatagtaagttggaaatgggcgagcggtttaagaattcggcttgggtgaagtggctcgggtggctttccgtcttgactttgaccgggttgaacttgtataacatgccggcctcgattcaaggtttttacggcgatgggatcacggctagtgaaacaatgaccgctgatgtgattgcttgggctctgaatgcggcgattattgcattgctaatctggacgatctatgaattgcataagggaaatcagcgtttgtccaaggccttggccgaaggtaaagttgatcagagtatttaaaccggaactaaagtatcaccaaaaaagcagtgccggcagaattcaaattctgtcggtactgcttttttagcgtgtaagaaaggtagattagtaattatcaccgtttaagatggagcttttaacaatgacgtaatccaccgtgcgaatgtccagcagattgcggccaccggcataggaaatggcagattgtaaatcctcttccatcgcggtgagcgtctggtcgatgtccccacggtaaggtaccagcatttgcttaccttcaacgttgcggtaggcgcccttttgtttttcagaagcggagccccagtattgtttgaaagtccgaccgtcaatcgttagtagactaccgggtgactgttcgtgaccagctaacatggagccaatcatgaccatgctggcaccgaagcgaatggacttggcaatgtcgccgttgtagcgaatcccgccatcagcgacaatcggtttccgggcagctttggcacataagcgcacggccgctaactgccatcccccggtgccaaagccagttttaagcttggtaatgcacgctttaccggggccaatcccaaccttagtggcatcggcgccggcattttccaattcacgaacggcttccggcgtgcccacattgccggcaattacaaagctattcggtaattgctgcttaatatggtgaatcatccgaattacggcatcgctgtgaccgtgggcaatgtcaatcgtgatgtattcgggcgttaagccggccgtagccagttcatcgatgaaggtaacttcttcgggcttgacgcccacactaatggacgcaaagagtgacttggcttgcatccgttcgatgaatccccggcgatcctcgggctggaagcgatgcataacgtagaaataatcgtgttcagctagccagaccgctaatggttcattgatgacggtttccatgttagcgggaaccacggggattttaaagcggcgggggccgaattcaatactggtatcggcttcactgcggctatcaatgatacatttgttgggaactagttgaatatcttcataatcaaatacttcagcagggtgcataggcaatcactctttcattaaagtttaggcgttccagacatcttgtaaaatgttcgtttgttcacggtcggggccgacagagagggtggcaatttccacaccgaccaattctgccagccgcttaacgtaggtttgggcattagctggtaattcggcgactgaccggcagtgggtgatatcttcgtcccaacctggaagttcttcatagactggttggcacgcgtcaaggtccactagactagcagggtaatggtaaatggtctcgccgtttagctggtaagccttgcagatcttaactgtcttgaggccggttaagacatctaaacagttgagtgatagggtcgtcaagccagagacccgcttggcatgccggagaaccacgctatcgaaccaaccgatccgccgtggtcgtttagtaaccgtcccgtattcgtgacccgtctcgcggatagtatcgccaatttcgtcaaagagttcggttgggaatggaccatcaccaacccgggaagtataggctttgcagacaccgaccacgtgatcgatcttagttggtccgacgccagaaccaatggttacgccaccagcaacggggtttgaggacgtaacgaagggatacgttccgtggtcaatatccaacatgaccccttgggccccttcgaaaagaacattcttgccggcatctagcgcgtcattgatgacaacggatgtatcagtcacgtagcccttgagctgttgccctaaagcgtagtaagtttcaaaaatatcgtcatagtttagtggttcttcatcatatagtttggtgagcaccttgtttttttcaatcaggttttggtgtagcttttccgcaaagatatcgtggtccaagagatccgctacccgaatgccaattcgttcagccttatccatgtaagcagggccgattcctttattggtggtgccaatcttgctggccttagccttttcttgcgcttggtccaataagatatggtatggcaagataacgtgagcacggtcagaaatccgtaaattatccgtggcaacgccattatcgtggaggtaggtgagttcttcaatcagcgattgcggattcaagacgaccccgttaccgataacactggttttgtcggcataaaaaataccggatggaattaagcgtaatttgaacgtttgaccattgaagacaatggtgtggcccgcattgtcaccgccttggtagcgggcaatgacatcagccttctcacttagaaaatccgtgatctttccttttccttcatcgccccattgactaccaactactactgttgatgacattgcaaacacctcatcgtttattattactgagccgaacacccagcaagaattagtgtaccaagttcggaatcaaaaatcaacctaaaagcgaactattttttgaattcagcgtcttaaagttctgataattgcggatagaaacaaataaaaccggaaacttacaccgatattaatagcaattgtgggatgttctatgttatgatatttaccggataatcatgataaataaccattaatgttcgctttttaatgcataattaggaggaaatcgtgatgttggaacggtatacacgaccagagatgggtcagatttggtcattagaaaatcaatacgcgtcctggttggcagttgagattgctattgacgaggcgtgggcaaagttgggagaggttccagttgccgatgcccagaagattcgggcaaatgcgcggtttgatgttgaacggattgcggatattgaggccgtaacgcaccatgatatggtagcttttacgcggaatgtttctgaatctttaggtgctgaacgaaagtggattcacttcggcgtgacgagtacggatgtcgttgatacggcacaagggtatcgtttaaagcaggctaatgccgttttacgagcagatatcgtgacgctaattgcgacacttaaaaatctggcattaacctataaagagacggtcatgattggtcgcacccatggcgttcaagcggaacccacgacttttggtttgaaaatcgctcggtggtatgccgagatgcaacggaatttagagcgatttgatcgggcagccgctggtgtggaaaccgggaaaatcagtggggccgtggggacgtttgcgaatgtaccaccggaagttgaagcggcggtctgtgagcaactgggaatcagtgcccagcccattgctagtcaagtgctgccacgagacttgcatgcggactacgtggcgaccttagccttaattggaacgagtattgaagaatttgcgacggagattcgtagccttcagcgttctgaaattcatgaagttgaagagcatttcaatcccggacaaaagggctcatcggcgatgcctcataaacgtaatccgattggctcggaaaatgttaccgggttggcgcgggtcttacggggcacggtcgtgacggcgtatgaaaatgttagcctttggcatgaacgcgacatttcgcattcatcagctgaacggatgatcttaccagaaagtacgacgctactggattacatgctcagtcgctttaatcggattttgaccaatctagatgtctttcctgagatgatgaaagctaacatgaatcggacctatggcctgatttatagtcaacgcttgttattgaagttgattgaaagcggattgagtcgggaagcggcttatgatttggtgcagccattgacagctcaagcgtgggatgaacagcggcaattccggccactggtggaagccaataccgagattactgcccgtctgacaccagcacagattgccgatgcgtttgattaccactatcacttgcgtcgcgtggatgagatttttaaacggctaggcctgctcgattaaatttgtgattagaaaattgaaaaacgcctgtacccagtgatgaccgggtacaggcgttttgggttaatcggcaattgtgtgggcatgatggtcgcccttaccgtcttgaaaaagatatgagtaaacaattaaagattcaagatgctgttgctgagattattctgactgaaggtgctgctagcgtatcaacgactaaggtggcccgacgagtgggtattgcccaatcgaacgtttatctctactttaaggataaacaggcgttactcgatagcgtctatgaacgggaaacgcaaaagattttggcaactaccgagatcgctagcctacaggatcagaaaataccattagaggagcgcgttcggctgtacattcaacaagtctatgatttttcattggccaatccggatagtctgacgttgattcaacaaatcaaatttttacggggccagtcacccgacttattgcccaatgaattgacgcctaataatacggttagtcagttacttcaggcggcgattgatgagggggtcttgaaagatttgccggtcagtctacacatgagtttggtatttgcgatcattaatcggcataccactaacttgcaattgggacgttatccggttgataagtatagcttcaaagagatctatcaatttatttgggatgcgatgaaacgctaattaacgaaaacacgctagtccagtggatgaaatccagggctagcgtgttttgattatgggacaataaaaaccgcactatccggggaagacggtgcggccatcatgaggagtgcattcgcataaggggggcgaatgcaatttagaggagtggttaggcttgagggaacctaaccaaggaatgattctcttagggggaagagaatctaaaagggattggatatagaatttgactagtaacagttattggctaattactatggttactaatatacccggattttgtgaacataaacggggcaagtcatgatgactttgcgataaattagtaaagaaaagctaaagtgtgaagaaaatggggcgaattacttaaagtaagtttgcagaaaggcggtcactcgttgttggtagcgttctgggttcatccagaagctctcagcgtgcgacgcatttttgacaatccaaagctgttttggcgcgtgagtcgccgcgtagttttcgtaagccatgcctacggggacataaacatccttttcgccgtgaataaaaagaatcggccgcgtattcttacgaagctgatcggttgacgttacgtcgccgagatagtaccccaagcggcgtttagagattgtgctgacgagcggttcgatcgggtacttgggtaagtgaaattggcgtttgagcagataggttaactcagcctcaatactggagtaaccacagtcggcgatgattgctttaacctgtgggggtaaagtttcaccagataacatttccatcgtggcaccgcccatactgacaccaaataataagatgttgacatcggcggttgagcggtcgatgacctgctgaatccattgtagataatccagtcgatcgagccacccaaagctgatgtattcacccgcgctttcgccgtgaccacggtcgtcgggtagtaagacgttgaagccgaggtgatgatacatttgcgcgaagttcgccatggtttcaccgttgcccttgtagccatgtgagatgatgaccgtttgttggctaggggttgcagccgggatgtattcggccaccattcggtttttggggtcatgttcgtgtaagtaccatttttctttcgtcacgtgctggtaccaatcgacgtaggcgtagtaggcgtctgcgtatttctgtttgtcagctgaggtttccggaacataattgacccgcttaaaggcaaagttgaagaggtgttcgctggcggctagggaagtggcggcgataccaataagtgggagcgttaaggtcaaggtacgtttcttcatcgataatcaggtcctttcataagggttggcggtaaaaaaccagactacccgcaaatacggttagtctggtcggattgcctaatccaaatagagttgctttaaattattcaagtcgttacgagatagcttcaacacgtcgtggaggtaatcttgcaccccaccatattgcgtgttaatcactttaatggcggcgtctagatagtcggcattgacggtcgaaagcgcccgaatgttggtgacaaaggtttcggtgtgcccgtctcgacgagcagcgtcactttgcgcctcaactttgggcatgacgttttgattggtcaacaagtaatctgttttgatcacttgggggtcgacattcaaggcacttaacgctaagaaagcgccaatgcccgtccggtccttaccagccgtacaatggaacaacacggattgttgcgccgtgtcgttagcggacaaagtcgcaaagaaatcatgataggcggcttgggcagaaggtaaggtgatcatcttttggtaaacatctaccatgtgacgataacccgcttggtcatcgccgttgaagcgctgctctagttcggcttctgttgccgaagcatcggtctgatcgtcagctgggaaaacgggtagaaaatggtaggttgcaccgaccggaacccgatccggggccattgtttgctcgtcttttgaccgaaaatcgacatcggccacgacaccatattgactgagatgttgctgatcttccggtgttaagcctgctagacctgctgtccgcaatagcttatgccatttgaccgtttgattgtctagcgtggggtagcctcctagttcacggaagtttaagccaccggtcacgtttagatttcggttatttgtcatgcgttttccctgccctttcattagcaactgtcacatacccttattctaacggttttgggataaattacctagtaattgattctctaagagcgtttttcacgcaaacgctgtatactggcaataagagttttcgagaattgacgctgagaataagtaaaagatagggtgataagtcgtgagtttgcgtgggaaatggttattattcaagacccagcacagtcagctcaagcaacagattcaacaggcatttttgcaacctagtcggcaaaatagggctgtcattcctgaaaaatttgcaacgtcaattgtgaccaaagaacggcaaatttttggtggccgattattgaccgcggccacgggggcaccgttaccccaacatgtattactgtttcatggcggggcttataccatgcaagggattgatagccatcgtgagttgatggaaacgttgatccaacaggccaatttacgggtaacatacgtcgactatccgctggtgccagaagccacggtagatgaaacggtggtctttgcgatgaacgcttatgattatttgcgcgcccagtaccctgacgatcagttcttcttgatgggtgattcggccgggggcggtctggcgttaacgttgcttcaacaactggcgaagcatcaagaaccaatgccagcgggcactattttggtgtcgccatggaccgatttgagtatgatgaaccccgaccttacgctggcggctaagcgagatccctacttgacgctagccacgttaaaaaagattggttttgactatgcgggcgaccacccggtgaccgatccggtggtcagccccatctatggtaacttcgacaatctgggacccgtgttattgtattatggcaccaatgaattgttggcggcggatgatgagcgactcttgcagaaactgcaagcggctagtggaacgccatttcaggcgcatcagatgccatcaatgctgcacgattatattttgtggcggaagttacccgagaccaagcagacgttggccgagattaagcagtttattttgacaggagaactttaaagtggagcgtatgacgttgattagaagtagtcaatgtcatacgtttttgttttagcaggtttatattgatttatctgcaaaaagatttagtggtgttgttttttgtgtaaagccccatgttaactagcgtataatatagccatcaggggggattacatttatgaaaaagatgggattaattgtgacgagtctggttgtcggactcatctgcttcggggggatacagggacaggcagccaagttggtgacagttgccacaccgtatcgccagagtcggctccaacacttgtaccacgtgaagaaagtggctaagaagaagacggtgtcgttggatattgtgttaaagccacggcaaactaaaacgcttagtcagctggctttggctgtgaacaccaccgatagtcagtcatttaaggggtacttaacaccgcagcaatttcgtgccaagttcggccaatccagtgcgactacgagtcgtttgacccgttattttcgggcctgccatttgcaagccacagcagccaataatggtctgttaatccgggttaagggtcatgtcgccacgattaataaagcctttgcggtaaacctcaagactgcgcggtatcacggcaaaaagatccagttttccaagcaggccccacggttgcctaagcaggtggcccaacccatccgggcagttgttggggtaacgaacttaatgattgccaagagtctgactacgaaatcgcctgctcaagtcaagcatttaaccgctaaacggtcacccactaagtttctgaaacagtatcacgcttcaaacttagcgaccagtggtcaacaaggggccggccaaacagtagggattattagttttggtcacgtgccgacggcggccattaaacacttttggcggcaagcgggggtacccacaacggggcgcttagaaaccaaaaccacgggtggcgctacggtcatggacaatggagacgatagtgatgatgaaacggcactggatgccgaacaggctggcacgattgcgccccgagcgaaggttcgggtttatacggccaagttcagtgatattgggtggctggacgcgttcaccacggcctttgctgagaatcgtgccagttccttgtcacttagttggggactttcagaaaatatcttacgggatttgaaccgcgaccatctgttaacgccgctatacggcgacatcatgaacaccttactggctcaaggagcaattcaggggatttcgacctttgtggcgagtggtgacacaggagcctatggtcaaaatttaagtgaatcatcagcgatgccgggaattgaagctgattttccagccgatagtccgtgggtgacggcaaccggtggtagtacgctgccaattaaaaagacatttgcaccaggaattagtgtgaatgttacccgcgaacggacgtggggtggcgatatcttctttaagggttatcatcagcaccccttgcagtttatcaaacaccccatcttactagaagagttgacggcggccagcggtggcggtatttcacgcctatacgggacaccgaaataccaacaaggtgttgccggcgtcaatacctataatgcacgcaagtatctcacggcggtgggccccaagtcaggtcccaagttgattcacggctatcgaagtggacggaactaccccgatgtggtggcgaatgccgatccgattacgggctatgatatctactcgaaaaacagtggctgggaattaatggggggaaccagtgcggttgcaccgcaatttgccgcgatggcagcggtcatgaacagtgatcgctcgcagcggatgggcctttggaatccccagctctacgctttggcgcaaaccgaccactcgccgtttactcggcttgatgcggcaactaataatgggaacttgtattatgtgggtcagccggggaaagtgtataatcaggcggctggtttgggaaccgttaattttgaaaaattagcccggtcttatcaataagcccggtcataaaaatagcgattacggtcaactaccgtagtcgctatttttatgacacatcaacatgatgttttagttgtggaaagacgtgggtatcggcccagcccatcacgatcccttgtgtaaccaaggcccaaaccgttccaaacccaatcgcgtgaagctgcccggtaaagagataggataagatgataataatcagtggcggcgtgtagctcgcccactgggcaatcacggccgacccgcgcaagtatttaaagcggagaatgtaggctaagtcatcgttagggtgcataatgatattgcagcggttataaatcgacacggcaaacgccacgccgaataggccgatgatatcgacaataacacgaccagttaggctcaactggccaacgcccagccaatcccagaaatagccaatccattcaacgaggtagctaaatggcacgatgtacagtaggttagacacgaagcggcgccgatcaaattggccaagcaagacctgattcaacagtgtaatgacgatgccgtataagaagagcgttgtacccagtggcacgtgaatccagttggcaaggttgacagatgatccggtccaaaccgcactccccaggttggtcgagattgtcagagcgttagcggcggaattcaggacaatggagaaccctaaaaagcgcattcgttgtccaaagtcctgcatcttcgccactgctgtcgcccactttcatttttgatattaagtctagtttagttgaagccgcccacaatgaaaagtgcttttaccagaaatttacatgcgcggcatccgcgctgctgatcgatccacaaaattttgaaagatctggcgcgattccgcatggtgcttgtacatgttttcgggatgccactggacggctaaaatttgatcactggccgtagattccagtgcttcaacgacttgatcgtctgcttgagccgttaccgtgagtgccggagcgacgcggttaacagcttggtgatggcgtgagttcacgtaaggtcgctcgcctgttaacgtggccaaagtactgccagaagtcaccgtgacgtgatggctaggttgattaccagcagcggcctggctgtgcttgatctgcgcagttggatcttcactaaggtcttgatacagcgtgccaccaaggccaacgttgattaactgcaagccgcggcaaatacctaagatagccttatcagccgctacggcttgttttaacaattcgatttcaaaaaggtcgcgtttccggtaggtcttccccaagcggacgtgcggttcttcgccgaaaaaggttgggtcaacatcgaagccgccgaggaaagccacaccatcaaagaggggcaaataatcggcaacatcggctgggtcaatactggggaggataacgggtaagccgccggtcttcacgatggcctcaatgacggggcggggggcgaaggcggcatttcgttcattaataatattcgtagcctcgtcgagtgtatcagcggggagagctatgcgtggacgcatggcgtcgcttcctttcagatataagtatgcctaagtatacgcgtgcgtgtcacctcttgtcacccaacgatctggtattttcgtgacgaaatagttcacaaatttccagaataactttacaataaagaggtaatctaataaatttaagcgaggtaaacgtgatgacagaacggcagttgattcaagaaattttgaattccgaagcggtggaatatagctttgaaaacgtcgatgaggattccaaggaatacacgcttttattgacccgacaggaccaagacgtgcgcgaggttgcaaccattaacaacgaaattaagaagtatttcgaaagcgctaactttgattatcaagaagaattgaacccagacggcgatgctgatattcgcctagtgattaaacgtaacgatcaataaatttatcaagtagtcggcgggttcttccgagagcccgttttttagtggcctttttggctcggactgggtaacatagaggtagatacgcattgaagaaaggacttatcgcagatgactgtggaggaactctatcacctaatggcggctgaaatgggcccacaaccgtggcttaggccagggacgccgtgggctgaaacgccggttgagatcatgttgggggcgattttagttcaaaataccaattggcgaaacgttgagccggcattactgaacttaaaacaggcgacggggtttgcaccagcagcactacggcagctgacagcggcggaactgatgcctttgattaagaccagcggcttttatcggcggaaaggggccgcaattttatcgttggccgcgtggctggggcaggccgatgatgatttggccgcgttggagcaacgggatggtcagcagttacgtcaggaattattggccattaccgggattggtcacgagaccgctgattatattttgatgtacacgctcgatcatggcacgtttatggtggatacgtatgcccgccggctgtttgactggctcggagctgcgatgcctaagacgtatcccgcatttcaaaagcgggtattgagtcagtttcccttggcattgaccgactgccaagaatttcacgcgttgattgatgaatttggcaagcaagtgaaaaccgatcgtgattttgcgacgtcctttttagcagggaaaaaactcgtggtataaagcttaagaaaccatcaaagcgccaaaagccgggagtaaaggttggcgtttttcacaagagtcgtgctatgataagtgcaacgattttggaaccggtttcgtcatgatggaattttggagggagtcaagcagatgggacttaaacaaccggaaaattatgtattggcgattgatcaaggtacgagtagtacacgggcattaatctttgatcacacgggccgcaaggtgatcgaagggtacaaggaagtgccgcagtattacccacatccaggctgggtcgaatctgacgcaaatgagatttggaacagtgtgttgtcggtgattgccagtgcgctaattgatgcgtcaattcaccccgaaaatatcgaagctattgggatcagtagccaacgggaaaccacgattgtgtgggacaagacgaccggggaacccatctatcatgccatcggctggcaaagtcagcagacggccagtctcgccaaagagttagtggcggctgggcgagcagaaacgattaaggaaaagaccgggctcgtggtggatgcctacttcagtgccacgaaggtgcggtgggttttagatcacgtccctggtgcccaggaacgcgctgagcggggcgagttgttatttggcacggttgatagctggttggcgtggaagctctcgggcggcaacattcacgtgactgactacagtaatgcgagtcggacgatgctgtttaacattcatacgctgcagtgggatgcagaaattctgcagtggctaaatattccggtcgcgatgttgccagaggtaaaatcgagttcagaagtttatggtgtgacccagaatttccaattttatggcgtggaagtcccaattgccggcatcatcggggaccaatcagctgcgttactgggacaattggcattaacacccggtacggtgaaaaacacgtacggggatggggcctttgtcgtgatgaacacggggcatgaaccacaattgtctaagcataatttattgacgaccattgcgtatggcctcgatggtgagattacgtatgccctagaagggtcaatccttgtcgcgggaacggcgttggcttggctgcatgaaagcatgcagattatcagtaatgtgccggaatcccggcaagcggctatggcgtcgatcaataacgatgaagtctatgtggtacccgcgtttaacggattaggggcaccttactgggatcctgatgcgaagggcgctgtctttggccttacccggggaacgaatcgcaatgattttgtgaaggcgaccttgcagtcgattgcctaccagacgcgcgatgtcttgcgcacgatgaagcaagataccggtattgaaatttcagaattgatggccgatgggggggcctcacggaatcgctacctcatgcagttccaggctgatattatcaacaccccagttcggcgtgcagccgatgaagagacgacggcgatgggggcggcaatcgtggccggattggctgtcggtttttggcagaacctggatgaggtcaaagcaattcataatgacggttgcttgtttacgccagatatgccagaagaccggcgtcagcagctatacgcgggctggcaacaggccgtggcggcgacacgggcgtttaagccagaaaattaagcagattaaaaccgtggaacacgccagcacgagtgctggtggtccacggttttttagttgtctttagtcaaaaagaccgaagattctcagtctgagaatcttcggcccaatgaccatgcttatttaattaaagacgcgcgcaataccagcgacattagagcgttggccgttcttgatgggttggaccatgatccgtggtggccagctttcgatgaccttacccttgcctaaataaagcgcaacgtgccagatggtgtgggtacctggttgatagtagaagaccaagtcgccacgttttttgtggctgtaggcaacgtgcttaaacttcttgctagcccacagattccgtgagttccattcatttccggggtaggcatgatgaatagagctgattggtgctgggttaatacccccggcgtagagggcttgcatgaccaagccagagcagtcggtaccataagcaggactcgtggaagagccaactagataaggattacccatgtatttgtaggcttgcttaatcatggcttcgatgtggtcttgacggccattccaagcgtgggcacccagtggggcaacataacgatcaatgctggtccaactggatttggagaagcctagcttcacccacgtcttttcgtcaacgttacccgtgacctttaggtgatgcttcttttgaaatgaacgaacggcgtagtaagttgcggtgttgtacttgttatagccgttggccgttcccaagcgtttcatgattttccaggtcttaatgccttcatagttgcgcttaacggtgtaacctaccttgccgtaaggcttgatctgggtgtaattgacttggtagtacttcttaggattttgataacccgcggttttggcaacgaaggctttgttggccgtcacgtatttgccagtattggttttgagcagtggagcgtggcccttaactgtcaccacttttataatcttggcatagtgattggccttgatggttgctgcttttttagtcttggcggcgttttggtagtagacgaccgtctttttggtacggataatgccgggattggcagtgtaatatttcgtgttagcttgggcaacaacagtgttactgccgagtcccaaactggttaaggctaaaatcaataaacctaattttttcatgagaagttccccttatgttagtaacttaatgcgcgataagcatcgtgcttgcggtgtgtctgtaagctggttaatgtcatattagtttttttcttggtccaagggtcgttgtaataggcccgcgtcttactgtagccggtgagggtgatcgcgtgattaacaaagccgtcaacgttagccacccagacaacaacgggatgtccgacattaatcttggcctttaattggttaaaggacgcaccagtcaaattggtagccgacccaacgtgctttttaaccagtggcatcaagcccttgggatagatccaccagccggatttggcataaggattaccaacgaaccccttattcggattggaactacggggcatttcattggctaatgaggtcttagtgaccttggccccagcatattgtagcatcatggtggtggcagttacttcacagcccgttggtaattgtggccgttgaccaattagtggcacctttaggtagcggtaagttttgaccgttccattacggtgaatccacccaacttgtttcgtcgttgttgtggtgaactttaaccagctaccatcggccatggtttcttcacgggtgatgtgaaccgactgattggcgtattgccgaccagtggcaatcggtttggcattcgctgcggatgatttggcgccgccagaacgataaaccttgtagttatgagtttgatttggcccaatcttagtatagtagttaacaaccttacgttgactgacgggacgatagacgggttgttgggtgacggtagacgaactttgggcatcgggtgtggtactggcggcggccccaatcgacccgctaagaattaggccgacgcctaacgccacgatgctactgatgaatcgtttcatgataaacggttcccccttagaatatgtatgataaatgaatgaccgagccaccaaaatgcgggcttagcgtcattcttattgtacacgttatgtttaagataaacaatgttgaatgggtaaacaaaaaagcggcagctaacgtggtgaagcacacgttaactgccgttttttatggttattgaatttgattagcgaggcgtaaaaattccttgagctgactcgcatcaatgccggctaattcggtaatgttaaataatcttagcacccaacaccgtttcaaaatggcgaagggcccaagtatgtccagttgcatcaaagctggcaacggcattctttggaaccaccaattgatagcccaagttgtaagcatcgacagccgtatgtaggacacagatgtcggtgcagacgcccgttaagactaacgtatcgacacggcgttcgcgtaagcgcaaatcaaggtcagtaccggcgaaggcgctgtagcgggtcttagcgaattgccagacattatctgccgactggttttgattaaaccagtctttgaccgggccatagagctcatgcccccaggtccccgcaacgttatgcgtcggaaataagcgactttcaggatgataagggtcatcgggggtatggacatcggttgggagtaacacccagtcgccagcttgctgggcttgttgggccagctccgtaatggtgggggctagcaactgtcccggctgaccacaggttaaggctcccgaatctgcaacaaagtcattagtgtagtcgatgattaacaaagcttgattagtcataatggtcctcacttccacgagattgattacagtatgttggccgctcaataaattgtcaatgaaagtggctatttatttttttatagatgcacattgacagatgatttttgtcgtcgtatattattagttaatctatattatacgtcgtatagtatcgaggaggaaaattaatggctattcaaattccaactgaactattagacggctgcgtcttgggcctgttgactcggggagattattacggttatacgctaacccaagaagtgcgccagcagattccaatttcagagtcaacgttgtatccggtcttgcgacggctgaaaaagaatggctggttaacaacctatgatgagccttttcaggggcgtaaccgacgctattatcagttaacggtatcgggtcgtacgcgcttaaccgagattcaaacggactgggcagcgtttcagccagcgattacgacgttattagggggaaacacacatgaatgattacttacaggcggtccatcgcctgatcggccaactaacgacggcggagcaacatgatgttgtggattattatcgagaatacttattagatgctaaccttgagacttaccagcaagcagttgatgagttggggacgccgcggtcattagcgcgcaagattttggcggattactcgatccgtttatcagaacaaggaggagatcagacttcaggacgaacacgttcctcggtacaggcaactaaagataatgttaaaacagtttggttaattattttggcactattatcgacgcctattacgattcccattttattggtagttggtgcgctatttattgcttttgccgctgttttatttggattagcggtcgcagccttagctgtttttgccagtgtcgtgattgtaggcgtcgtggccacgattgtggggatcgtgatgttatttcaagcaccgtggacgggggtcttctatctcggtgttggctgtctgtcattgggcgccagtctattaggctggttagtcatcaagtggctggggatcaaattgattagtggcttatcgtgggcggccaaggggatttatgaccgctttattccacgaagtcgcgcagaacgggggcgaaaactatgaagcgaagtttaatggtcagcggaggtcttttaattctaggggcgatcttgttaggctggggctggcaacatcgtggcgacaagccggttgtgtggaaccaccaagatcggcgatttgaagtgattcaacagaaaaaacaacgccagcggttagacagttatcgacgcattgtgattgatacgacagcgccggttacgattcgccaaggcgacacacgccaggtgacgctacataatttcagtagtgctaataatcggctccgcgcacgggtcagtcaggggacactgacagttaccgggggttcgacaacaatgaactatgttttaggctttgggagtgatggtggcggaattaactttagtagtaacggtgataaacgcggtgtcgtcatcacggtacctaaaacacagcggttagatagcatcatttctaagcgtgagggtggagagctatctttaaaaaagatgaccgtcaaacaaatttccgtcaagtccacagatgacgtcagttttaatgatgttcgcgtaacgaagaccttagccgtggatacgactgccggtgatattagtggtaaacaggtcaaagcagatcgcgtggatttaactgctgaggagggggacgttagcctcacgcagagccattttaaagcagtcaataaccgtgtaatcagtggagatggcgatgttcgcttagccacaacccaattgggcggtggtcacgtggtcgctagtgacggcgatattcagttacacgataatcgactaatggggactctaaaggcaacggcgactgatggcgatatttcagcgcgaattgcgccagccgcgggagctaaggtgacgaccacggatagcgatgatgaaattcatgtcgtgggtcactcgcggtctagtggttactggttgcggcgcgctgccagtgcgcaataccgattgtccacggatgatggggatattaccgtgacacaataagtggtggtcagacgagtaggggagaaaccagtaaaaaggcggtgactgcggttacggccttttttgctggtttctaagaccaaacgtgttaaaatgtaggaactgcgttaaaccggattaaacatcaaatttaagttatagaggagactttatcgtgcctgattcaacttattggcaacaaattgctgaccacgcgcgggcggaaaaccgacctttttttagtttggcgcccatggaggccgttaccaacgctatttttcggcgggtcgtcgcgagagctgcggcgccggatgtcttttttacggagttcaccaatgctattagcattacccatcccaaagccaagtttaccgtggctggccggctatacgttgcccctgaagaagcccacatgccagtcgcccaattgtgggggaatgatggtgaagcctttgctcgggctgcggtggcggtcaaggacttggggtatgaggccattgatatcaatatgggctgtcccgattcgacggttatcaaaaatcatggtggtagtgatctaatccgtaattttgatagtgcagcggcggtaattgcgggtgctaaaacggccggactaccagtcagtgtcaaaacacgactggggtacagccggttggatgaatggcgtgactggttaactttcttgttccaacaagatattccattattgacgattcatttgcggacgaaaaaagaaatgagtcgggtgccggcccattatgaaatgattgatgacatcgttaagttacgggatgagattgcgccggatacgttgcttcaattgaatggggatatcgaaaactatacggatggtgtggcactagcccaggcgcaccccggagttgatggtattatgattgggcgggggattttcactagcccctttgcgtttgaagcgacaccacaagaacatgacattaaagaactgttgggtctactaaattaccaattggacctctacgatgagtttgcccaacgatttgatacctcgcgttttgcatcattgaagcggttcttcaaaatttatgtgcgcaaccagcgtaatgcggcgagcctacgtaacgctatgatggagacgcatacgactgatgaagtccgtcagttgttagccgactccgatctgacgaagtaatcattgccaaaaataaatgaatttagcgcgtttcaccaaatgtttgattattggtggcgcgcttttttacgttagcagggtaaatctaccgctttttgcgaccaaagtggtaagttagaggaaataagtaaaaaggtgatgacatgatgacccacgtgcagttgactgaaaaaataacaggtaatgtggcgcggtctgtgaaccccttgggattacgagcaatgatgacccaacaaatgacagcgattacgaatcagggaacctatccgggaccccgccacgttttagttttgggcggttcatcgagttatggactagccagccgcttaacggcaacttttggcgccggggctgacacattatcagtcggctatgatcggccaccacaaggtgagtctttaggcagtgctggctggtggaatcaagtttactttaaacaagccgctgagcaggcgggccatatcgcccgcaacttgaatgcagatgttttttcgccggccacgaaacgggcagtgatcgaggagattcaaacgcactttggtggcgctatcgatctgctggtgtactcgatagctgcgcctaagcgcgtgaatccggtgaatcccaccgaggtctggcgctcagtgattaagccgctgggccgagccgtcacggatgcgacgctagatttggagcatgaaaaattagtgtcgacgactgtgcctccggccactgctaccgaactggccgccacaattcatgtcatggggggcgaggattgggaattatgggtccacgcgttacaggccgccggggtgttagctccccagtttaagacggttttatattcatatgaagggccaactgccacggcgccaatctatcatgatggtacactgggtcaggctaagcgggcagccgaagccagtgcccagcgcctgcaaacgttattagcgcccagtggtggtgaggccttgatcagcgttaatcggtcagtgacgaccaaagcttccatggtgatccccggtttttcacgttactgcatggcgttgtatcaagttgagcaagcaactgggggtcatgaagtccccgtccagcagattgaccgattaatgcggcaaatgatctacggcgatcaccgtgagctggatgcgcgggggcgcttacgtccagatgccgccgagttgtcgccagcagtgcaggcacaagtgatgcagttgttgccacaaataacgccagcaacctttacgacagatttacccggctaccagcaattacggcgcgaatttcggcaattaaatgggttcgcggtccccggggttaccaatacattggcggatggtgatttacaaggattgacttactaacaaggcaaaagccgtgctttgtctagtgcggccgcatgaataaccgagtaaactaaaattaaccgcgtgatatcagtgtctttatgcaagcggaatcagaaaaaaatcccccgaaattgcgtctttttactagggaatcttgccaaaaagggctataatacttagcagtttctagcgaaattgtgacaggcgctagtctattttgaacgaggagaccctaaattatgacgtcagcaattcaaattatttatgccagtcaatctggtcggaaccaagccattgccggacatttacaagcgcaattagcgtctaaagtccaaacggtggtcacagaaatctcacaagccgatgcgtttgcattatccgaatccgatgcgattattttagtgacgtatacgtaccatgatggtgacctgccggacgaggcccaagacttctttgaagatctaaaagaagttgatttggggcggacaaaatttgccgtgctaggttccagttccaaaacacacattcacttcggtcgcgcggtcgattatttgaccatgcagttaaattctagcaacggtgaacaggttgccgactccgtgaagatcgatcaggaccccgacgatgccgattggcaacgtgtcgatcagttggcccaacgtgtgttaaccagtttagcttagagaatttaatgacgaggtgaaggtaaaatgtacttacgtaaggcaaagattgaagaattggatttagtttgtgacattatcgaagatggcaagcaacagttagccgatgccgggattgatcaatggcaagacaactatcccaaccgtgacgtgattaaggatgacatcgccaatggtcgggccgtgatctacaatagtgatgaccacgaaacattaggggtggcggcgattgtgcaagcccctgatcattcctatgatacgttgcaaggtgaatggctaaagccaacggataaatacgtgacggttcaccgggtagccatcttctcccaccaccaaggccaaggctatgcgtctaaattattccaagatctgtttagctatattggtgaacaccatcctgaaagcgaaagtatccggattgatacccacaaagataacaagaagatgcaacacttgattgaaaagtttggctttcaaaaggtcggcgaaattgttggtgtttacaatccgtccgacatttgctttgtctacgaaaaattattaacgaagtaagcaaagtgatggcgtgtctcatgatgagatgcgctttttttatttttgaattgaagtggggtctgcccgcttgtcttaaagctcggccttatcctaagcgcaccaagaacgcgccctaaggataatgacggtactgagcccatttgccacttcccacagcgactcatatgagacacgtgtctggaaggcggatcaggtaggtaaacggctacaacgactcatataaaacgcatgtttagaagactggcggaaagaatcaaggattagcgagaaccattgaaagaatcccgattttgcggcatactgggtagggagttgggctggtttgtaatcaaaataggaaaaaacgattgcgaaaaacgtctaaatcaggtagcatttcctaataaagttttaatattttgaacagaaagagggaattggattgcaaagaagactgagcgcccgtcaaatgcagatgattgcactgggcggtacgattggcgttggactatttatggggtctggttccaccattaagtggacgggtccatccgtcctcattgcctatattatttcgggtgtttttctctatttgattatgcgagctctaggtgagatgttgtacgtgcaccctacaaccgggtcctttgccacgttcgcgtcggaatacatgcatccagtctttggatttctcacagcatggagtaatatttttcaatttattgtggtgggaatgagtgaaatgatcgcgttaggtggttatttccggttttggtggcccaacttaccggattggattccaggattagtggccattacgtttctctgtatcgccaatttgatttcggtgaaaatgtttggcgagctagaattttggtttgccttgattaaagtggttacgattattttaatgatcattgctggtttaggtctcattatatttggatttggtaacgggggtcacccaattggtatcagtaatttatggcgtaatggtggtttcttcactggcggtgccaagggctttatttacgcgctagccattgtgttggcatcgtatcaagggattgagttgattggcgtcacggctggtgaagcggaaaatccgcaacacaccttggtcgccgcaattcggtcgacggtggcccgcattttgatcttttacgtaggggctatctttgtgattgtcgccatctatccgtggaatcagctgaaccaaattgggtcaccgtttgttcagacgtttgcgaagatcgggattaccgcagcggcttccatcattaactttgtggtgatcacggcggcgttgtccggttctaactcggggatttacagtgccagtcggatggcctttaccctggcggagaagcatcaattaccgaagaagatgaccttgttaaatcgtcacggtgtgcctttttactccgtggtagcgatctccattgggattggtatcggcgtggtcttaaatgtggtcttgcccatgtacttcaaggatgccagtcaaatcttcgtgatggtttacagttccagcgtgttacccggcatggtgccatggttcgtgattttgattagtgagattgcctttcgtaagcaaaaccagcagcacatggcagaacatccatttaaaatgccgtttgcgccttggtctaactatattacgctagtatttttagcgattacgttgatcttcatgtttctgaatccagaaacccgggtctcaattctggtaggtgtggtgttcttagtggttatgaccatcatctacttcagaaagtatcaaccacgagaaaaagcaaacaagtcatgaaatggggttaaacgatgagtcgaccaggaaattatggtaagtcgagtcgcttaaaacaactccgacagcttaaacgaaagaaaagccaacaggccagtcgtaccattgcttgggatcaggttgaggacttcttgttggggcgctatcacttggtacaaggtaatcggttaccagcaactgtggatgccactgtccagcggttctttagcgaatggctacaaacggcgttggctcaaggagaaccacagcttcaatgggatattgcagcaattacggcgacgacgtttaaacgaatcggaaatcaggtgccgtggcagttttatgccgtcttgctggagcaggtcatggcgtggcaaaagttcttgttacgtgagggtccggtggtgccgctagtaataccgcggcagattatcaaaccgctgacagcgacggcttgggccgcgttagttgccgatcaattggcggtgaacttactaacgattatggcgacaccgattaccgctgagcaacgcgagcagctgactaaaagcttcttagcagatggtcacgttcagtggtcggcggttgctgcgctctttgcgccgttgggattcaccattcaagcatccgctgacgagtcagcgcatcagtggctaactgagttactagccttaacggtgagcgactttcatcactaaagcactaaatacgaaagaccggctaatagctggtcttttttgctatgaccgattactattcgggatgacacggagcggatattgatatctttcaaagctgctaacagatggttaaacgatttatgagtacagtcaggggaggtggaccgggtgagacagtatacgcccactcccaaatgggcattgaggattgtcgctagtacctgcatagttagcttgctggcattaccgactgtttcggcggcagatgttggccagaaaacggcaacctcggcaaccgtagccgcagctactgatgcggtgccgaccttagatacggtacctaatcttgattttggcgaaaatagtacgccgaacacccaatccggccgttattcggccaccacggtggatcagccattacaagtgaccaatcccgggctaatgagtggttgggcggttcagcttaaaagcgctggttttacggatcagttgggagacactttacgtggggcggtgttgtcacttggtgcgccggcgattatgtcactcaacactagcaattcatcaacaccgccaacggccaatcaagtcaacgtggatggatcgggtagcgatcaagtgatttggtcggcaccgcagaatggcggcttaggtcagtggtctgcaacttatgcggccaatactgttcaactggtcgtgccggctggacaattggctggacggtataccgcaaccttaacgtggcaattggacgatacaccgcaataattgggcaataagaatcagggaaaaagggggcgttaatagtgctaaaatggcgatggcgtgcggggttgattgcgctattgctagcttttggtgctagcagtgtcgcttggaccgatagtgattacaatcaagcattggcaacggctccgcagggaatttcgttgaataaagataatgcgattttaacggttgatacgtctggttatagctcatcagccattgtgaacgcgactaatccggcgacaccgggaacccagatcgccatggtgaataacaacacctaccaatttgggtcgatttggtcgacagatgagaactactttgatttaacacaggatgagacagcctccatgtggttatattttggcaatcaggggacccaggccgccgacggaatggcctttgttttgcaaaatgatcccagaggtgtggcggccataccggactacccaacgccggggaaggccattggcgaaaccctaggtgtctggggcgttgacatggctagacgtcaaggctcagttgataagttggcgcagactgctattcaagatagctgggctctcgagtttgataccaatcggaatgccagtaccggagggaaagctgctggctatgccaactcgtttgatattggcatgccacccgtccatatcgggtccaactatcccggcgccgggtcgtcgtatattcgccatgtcgaccacggccttcccgtgctaggtattattcagccagataactattattacggactcaaccatctcggggtcattgcggacgagtcccaaccgaatttcttatcaaacggtcaatggcaccatgtgactttatcttggaaagctgctactaagcagatgacgtatacgtttaatgataaggacccgcaaaccggtgctatgcagccgggggtaagccgaacggtcacgcttgatccggctaagattgacccgaacaataccggaaaaatacggtggggctttacaggagcgactggatcacgatatgagaataacttagtggtctttgaaagtgttcccggactggtagcggccagtactacggccacgatgacggatttgacccagaagcaaccggtggatagtgcgcatggtgtggtgagtcacgacaaactacaagtagattatcatcttgcgtataatggcggccggcagtcatggtcgagcattgagggtcatttgaaattacccgctaacatcagttacgagacggccaagattacctacgcaaatcaaccagcggaaacacttgatgcaagtcaaattagtcaacaaaagctaacggcagcgctccatcagtcattgaatcgagataatgatgcggcgactgtcagtctgattggagaggctgatgaggtcgctaaaagtacgacagtaccggcaactacgagcacctttgtctcgaatgcctacgtgggcaccgccgatacaccgagcttccagcttaatccgaatgttgatttgaatctgagtgtcacgagtgacaacccgttggcgctcaaaccagaaaccgatacggtagtgacgggtaacgtgcatttggccacgagtgccacaacacctccccgagtaaccattcaacccgtgttaaatgggacgcgtcttactgtcattaccccagcgactgatgggaccttttcattgccgctgaaagctagcgatttgcaggcgggaaccaataccttaacgttggtggcaacggctgatacgggtgatacctcgaacacggtgaccgtgcccatcaccgttgccggtgacttgaaatttagcgatgttgcagctgccagtcattttcagacggccaccctaactggtcaagatcagttggctaaacgaggagatgactggcgcctagctgtgagtgacacccgtggaaccgggcgtcaatgggtgctagacgttcaggctaccccatttgtggcagcggatgggacgaccttagctggtggcccagtgtatgttgatgcgtatggttcgctgactattgacgacacgcccaccgcgattgtttggcacaccacagatgaccgtgatcacgatggcgtttatgatgtcatggggaattggtctgccgaccaaggcctcttactagccgtcaatggtggtgctgtaagcggcaactacacgagtacaatcacttggacgttgggagatgttcccagttaaggcagtaaaaaagctttccccaatcagattgagggaagctttttgtgatggatatggaatgtgtttaagccaacaaacgtgtaatcatcttttcatagatggtgatgaaacggtgatacatgtctaggtcaacgtattcgttcacttggtgagctgtgatgtttcccgggccaaagaccacaacgtcgatatctggattaactgcaacgaaggacgatgcgtcagttccaccgggaacgccgataagtggtaaggcttgttgtaagtcagcctcaccgcattctttagctgctttaaccactggtgcatcatcggcagtgtgcacgggatacaggttactgtgaatatctaaggaaagttgttccccgttagcatttagctcgtcgatgagctgctggatatcagcggctaacttggtgttcggcacttccggaatggttctgattttaaccgaaatcgaggcactggctggaaccgtgttaatctgctcgccaccctgaatcagagtgacaacgggaaccgtggcccctaagaccggattcttcttatcggtgatagtcgcgaagtaggcctgttgtttttggtagaaggttagcagtgaatcaatggcatttttaccaatttctggcattgaactatgtgccgccacgccttgagcactcaccgtatacgtcaaagagcccttgtgcgctaactcaatgaagtgttgttcagtcgtttgattggcggccattaacttattggcgctgtcctggttaatttgcaacatctgttggatttgtggggtggccacggcttgtttaacgacaccgctgggttcaccaacaatgagggtgtctaggttcttagcataaccggcctcagctaactgccgggcgccgaattgaccatattcttcaccaacggttgccattaagcgtaatgtgccgtgtaggggaacattattttcttttaagtgaatcatcgcaaagacgccagccattaagccggacttcatatctgtggtgccacgaccaaacatcttgccgtcagcgattttggcagacaaggcatctgcatcccacttggcggcatcccccaaggcaacgatatcttcatggccgtcaaatcccacgacagggccgttaccgtcgccgatctcggccactaggctgacccgatcaggttcgtaagcgaccgccttactatcgataccatgcttggccaataagtcagctaagtagtcggcaacaatcttttcgttaccattaactgtgttgagcttgatgacgtcactgagtgcttgcacaacttcatccattttttccacctcattcatttaagttgaaacgcgatactgtaattggttaatgaaaataaccaagctcccaacttgattacagcactttttaggggactggtcaaggtaggcgttggatctgattagtaatgaaaatttgattcatgaaagcatgaatgattagggctatttttagataatggggtaccatttgtaaatccgtgaagagctttacaaagtaagtgacttataggaaagaaaattaggcataaggtcctgataaataaaggtgttgacatcatgtaagcgcttacgcataatgagaattgcctactagtaaaccattagacacaccattaaaccaatatcttgaggaaggaagttttcgtgatgaaagctgcagttgttcgtgatagtttagatgggtatgtagatattaaagaggtaccagtacgggaaattaaggccaatgaagccttagttgatgtggaatattgtggtttatgtcacactgatttacacgtcgctcaaggtgactttggtaacactgctggtcgagtgatcggccacgaaggggttggccgggttaaagaaattgggagtgacgtcaccagcttaaaggtgggggaccgagtatcaatcgcctggttctttgccgggtgtggtcactgtgaatactgtttgaccggccgtgaaacactgtgccggaacgttgaaaatgccgggttcaacgtggatggtgcgatggctgaacaggttatcgtgaaagctgattatgcggtcaaggtaccagaaaatcttgatcccgtgcaagccagttcgatcacgtgtgctggagtcaccacatataaagcattaaaagttgccaacttacatcctggcgaatgggtcaccatttatggttgtggtggtctcggaaatctagccattcaatgggcgaagaatgtctttaaggcccacgttattgcgatcgatatcaatgatgataaactagccagtgctaaaaaggtcggcgctgatttaaccttcaattctaagacagaagattctggcgcttgggtgcaagataaaatcggtggtgcccacgccgcagttgtcacggccgtatcacaaattgccttcgatcaggccattggctctgtgcgggctggtgctcgcgtcgttgctgtcgggttaccaaagggtgccatggaagtctccattgtgaaggtcgtcttagacggcattgaaattgcgggttctttagtgggcacgcgacaagacttagctgaagccttccagttatgcgcagaaggggatgtcaccccaatcgtagctactcggaagcttgaggaagttaacgatattattgatgaaatgaaagcggggaagattgaaggccggatggtcgtcaagttctaagggtttctcccaattgggagagaaccgcccacatcgaacagtatagtattgtagaaatatcaaatagcaattcaaaaagacgatggctaaagccaccgccttttttggctcatgagcagtgttgatactcaaaataactcgtcaatggcgtcgatgacgcgataagtcgctaccatacttagcgcttggaggaattgactcagtcgatgctgatcggggaaggccccctcaatgagatgggtaaagtcgccggtcgtttggtaatgatggcgaatgtcttgacgataggcttgaatcagttcacgataggctgattgttgctgggctgcaacggcaacctgaatgaagacttgtcgcatgaagcccatcttttccaggtcgacttcgatggtgtaacgcttaatgatgccagcatcttccaagcgttgaatgcgtgccgcaacggctgggggtgttaggtgaacgagttgggctagttgggtcaccttaatccggcaattgtgattcagttccttaataatctgtaagtctgtgggatcactcacggtaaacacctttttttatcaaattttttcgggtaaagactttctttttaatattaacagttaggcgaaataaatgtaaagtaggggctattgccgttcaatagggcgagtccttttcttaggtaaataacgaaatattagtataatgaaatcgtacaggcccatgatggtaatcgggcaaaacgatagaggtttggaggttcccaatgatagagtttaaacaggttagcaaacaatacacggaacaattggcattggatgatctgaatttgacgattccaaccggggattttttcgtattggtgggacctagtgggagtggtaaaaccaccacactgaagatgcttaatcggttgattgaaccaaccgatggggatatttattttgataatcaacggttaatcgactataagctacgtgatttgcggttacaaatggggtatgtcttacaaaacattgcattattcccgaatctaaccattcaagaaaatattgcgattcaagcggaatctttggggtggccccgaaaagaacgggtggcccgggcccgagcgttgctagaacaagtcgatttggacccggatcaatatgccacgcgaatgccgagtgaactctccggtggcgaacagcagcgggtgggaattattcgggcattagcgattaagcccaaggttgttttgatggacgaacccttcagtgccctagatcccttgtcacgcaagcaattacaggacttggtgttgcaactacatcgcgaactcaagatgacttttgtctttgtcacccatgatatgcatgaagcattacgcctgggtcaacacattgcggtcatgcggttaggtcacattcagcaggttggcacgggtgaagagattatgcaccatccagctaacgagttcgtacgcggcttttttgaaaatgaacatacaccccggccggcgacagtccaggtattggtgaatcaggggtatggtgcaaccaccacaacggccgctacgttaccggtaacggctacggtcaatgaactagcggcggccttaaagaaagggccagttatcgttggcaccgcgtcagggaatcggacattgacgaccgctgatttattagactatttggcacaaacggaggtggagtagcgtgcaacaaatttggcatatcttacacacgcagggcggtgaaatcgtccagtccatcggccaacatatcggcttatcgttgatatcgttactcattgcggcagtcattgcgattccactcgcgattattttgatgaatcaccaacggctggctaaggtgatgctccagatcactagcatcttacagacgattccaagtctggcattgttaggaattttaattccactggtggggattggaacggtgccatcgattattgcgttggtgatttacgcggtcatgcccattttccagaatacgtattcggggttaacgaccattgaccccagtttggaggaagcagcgacagcgtttgggttgtcacggcggatgaagctactgcggattgagttgccgttagctttgccgatgattatttcagggattcggattgccatggtcatgatcattggaacggccactttggccgctttgattggggctggcggactgggaacctatattctgttggggattgaaaccaataacaatgcgctcctaattattggggccgtcttgtcggcgatactggcactggtttttggggcaggaatcgattggttaggtcggttgacctttaaaaaggcggggattgtgttagcaacactggttgtgttgattggcggctttgcgggttatcgccaagtaacaaactcacaaacgacactcaccgttgccggtaagttgggcagtgagcccgagattctgattaatatgtataaggacctgatcgaacatgatcacccgaatattaaggtgaatacgaaggctaattttggagcgacatcatttttgtttaaggcattgcaatcgggttctattgatatttatcccgaatttaccggaacggtattagaatcgctggtgaaaaccaagcaatcggccagtcatagtccggctaaaacctatcaactggccaagtcagccttgaagtcacaataccagatggcttatttgaaacccatggcctaccaaaatggttatgatttggccgtcacgcgccagtttgcgaagaagtatcacgttaagacgatttcggacttaattcaggttgagaatcgggttcacgcggggtttgacccggactttaatcaacaaaaggatggctatcccggattgcggcaggcttacgggttgaaatttgccagtattaagacgatggaaccctcgattcgctataaagcaattgccaacggcaaggtgaacttggtggatggctataccaccgatccggaggttcaagcgtatcatttagtggtcttaaaagatgatcgcaacttcttccccccataccaaggcgcaccgttgatgtccgagaagctattgacggatcatcctgaattacgaacgacgctgaataagttagctgggaaggtgacgaccacggatatgcaaaaaatgaactatcaagtatccgtgaagcaccaaaaggcggcggtcgttgcgcgggattacctcagaagtcatggcttactggattagccactgggcttgacaataatgagaaacacgcctaggattatcattaatttctaattggcctgtcataaataaagctcggagaagagtagtggattccgtgttgtgcagtgagcccgaacagtgagaacgggtcaaccacggtatcatgaagatgaactcctaatagctattgagcgattcacgttgctcagtcggtaggaaccgttaactttccgggtatcaactggtaccgttgaggcaaggtctgtgaggatcttgtgaatttagggtggtaaaacgacgcgttcgtcccttgagcttagacatgagttcgggggacgaacgcgttttttggtgattgacaggcaggccgtcagacttttaggaggttattcaaatgacagtaacggcaacgaagtttccataccggtatgatgtcgtcgggagcttattacgaccggcagttttaaaggacgctcgggcccagtttgcggccggaaagattgatgcagagcagctacaaactgtccagcgagctgaaacgaagcgcgtcgtcgaccagcaggtggcattgggtctcaaggcagtcactgatggtgagtttaatcgaagctggtggcatttggactttctgtggggcctaactggcgtgggacactatgattatcatcaaagctataaattccacggaagccaaacacgaacggataatgctgagctgattgggaaagtagcctgtaacccggatcatccctttttcaccagtttccagtatttacagagtttggtgccagccggagtgacggtaaagcagacgattccctcgccgaccatgctatttcgagataaccgtagtgacaactgggccacgtactatgacacttggtcagattatctggatgatttagcccaggcttatcacgacacaatccagcatttttatgacctcggctgtcgttatatccagcttgacgacaccacatgggcatttctgattagcaagctcaatgaaacagcgacagatgcagcggcccaccagaaatacgttacgctagcgacggatgccgtgcgggtaatcaatcaactattagcggggttgccagatgatttaacggtaacgacgcacatctgtcgggggaacttcaagtcaacgtatctcttttccggtggttatgatgacgtggcggattatctaggtcaattgcattatgacggcctttttcttgagtacgatagtgatcgtgccggtgatttcacgccgctgcggaaaatctggcatggtgatccggataagtgcttagtcttaggcctgatcacatcaaaattcgcggaattggaagatccagcggtaattaaggcgcggattcaggctgcggctcagcaagtgccgttagccaacttggccttgtcaacgcaatgtggctttgcctcgacggaagaaggcaacacgttaaccgaagatcagcagtgggcaaaactcaagctagtcaaacagattgctacagacgtttgggaggcttaagctgacaacgataaaaatgtgtttccgtggacgctaaaagtctacgggaacacattttagtctagtcagctaaccgatgaacaaattcggcgcctaattgttgtgcgtaaaattggtaaggcgccaaggcttgttgggcgtcgataaattgttcgttttcagtcagatcggtcttctttaatgtcagttggaggttagtactcatgagctgcatcttcaagccacggacaaccaattgcatgcccagtgcggcttgaaagccaccatggccaccgtaagagaccaggctgactggcttgccgcgccattcagtgtatagataatccagggcattcttgaggggtgccggatacccccaattgtattggggaaagagaaggacgaatccatcgtagctttgaattaattgactccacgccttcgtgtgtgccagctcgtaatgaccatctgaaggttgagcgacttcgtctaagaagggcaactgaatgtcagcgaggtcaatgagatcgatctgaaggtcggattggtccatcgccgtttgtaaccaagtggcaatgctcatactgattcggttgggtcgagttgagccgataatgataccaatttttttagtcatgaaaagctccttaaatgtgtcattaattcgtgcattatgcacacatcttagcacgcttctgttataatcacaatatggataatgatatttttgaagcattgtttgaaattgtcacgttttttaatcaaccccagcaggatcgtcagttactgaagcaggctaatttgacgttagaaccggcagccttgcccatcattgttagaattggtcggcagccggagattagcatcggtgaattggctaatcagattgggcgaaatcattcgtcaatcagtcgtcaggtcgataagttggtcacagcgggatggctcgtggaggtcgagcgacgggatcaacggattcggcaattaaccttaagcgatcagggtaaacgcgctttattacaaattaaggttgcccgcgaggccgggttacgtcagcatttggcagactattccaattcggaacggatcgaattactgcaagtcttacaacgattggctaaaacattaaccacacctgacgatccggatgataatcagtaaaatgactgccgcagtcatcattgcggcagtcattttgggcaaaaaaaattaacctcattgaatcgaactgggatttagtctgattcaataaggttaattattcaattggacacagtgactaacggtgcattttccgggtacaccgccgactgttaccaaaaaagctttagtttgtcgtcagtttgttaagcaattgttttacgacatctttataataacaaagaaatcaagggctgcgggcgattttggcaatttgtaatattacaattttacgggccgattttaaatatcacagatattgtaaatgacttgtactgagagggttactgttgaattttaaaggtaaaaatcagcgtatatttattcatgaggtgtccgctaagcatgatgagcaactagcggaggttgatacgccaatcttcgcaaggattgcctaattatgaccattagcgatttaccccattgctaaattttgattgcagacgaccaaaacagatgcaaagctgaccaaaacttggtaaaattcaatcaacgactaaaaagatttggaggtggacgtcttgtaccgcttgtacgctgcattaccaattccagaccgctaatttaaaatttgttaaacgaagggaagaccattattcatggcacaagaatcaaagataacggcaacaaccactgaaacagagaccaccgaccccggacccagccagcagccgcctttatggcaacgctcgactgagtccttacttgttgattttaaaaccgacgagacgcaagggttaacaactactgaggccaagcgacgacttacagagaatggtcctaacgaactgaccgccaaaaagcaatcgaacctgttgcgcttcttgaagcaatttaacaactcgattatttatattttggctgcggcggccttgatcacttttcttatgcaccactattccgattcgattgtgattgggctggtgattattgccaacgcgttcattggctatttccaggaacgctcggccgataatgccttggaccggataaaggcgttgttggtttctgaagccgtcgtcattcgtgacggtcaaaaagtcaccttaccagcacgagagctggtagctggtgatcttgtgcaactggaagcgggagatacggttccagccgatatgcggctgatcaacgcagacaacttgaagattcaagagtccgcgttgaccggggaaaccgattcagtggaaaaaggagaagatccgttgtcagcggcgaccttaccattggctgaacggtctaatcaggcattcgcttcaacggcggtaaccagtggatcggcgcgaggtatcgtgaccacgacaggttcagcaactgaaatcggaagtatccagcaaaatgtggctgatgtgaaacagcaggccactccactgatgaagaacctgaatagcttaggtttagggttatccatcgccattttaattgcggctgtgctgttatttatcttgggaatgatgacccacgtttacagtctgccagtcttgttggtggccgtcattacgatggtcgttgggtcgatgcccgaaggtttgccagctagcacctcagtggtgttagcgatggggacgcaggcgatgacgaaacaaaatgtgatcgtcaagacgttgcccgcggtagaaacgttgggtgcagtggatattgtcaataccgataagaccgggaccttgaccaaaaatgaaatgaccgtcaccgatatattaacgactcaggatacgtataccgtgtctggcgtgggctacgatgctaccgggcaagtcgaaaatgatgagggccaacgggtcgcttggcaagaagatcctgacttagagtggctagtccagattgctgggcaaacttctgatgcagaattccatgaggaagatggtcagtgggtgttgacgggtgagccaaccgatggggcgttgacggcgctttatcacaagttggtgggccatgatccagccccacaagagattgattcacagccgtttgactcagccacccgttactctgcgcgactggttgacttcaaggatcagcggtggttattggttaaaggtgccccccaaaccctgatccgccagatgaaagaacagggcgacaccgttgatgaagcggcttggcaggcccgactatcacagctaacccgccaaggtaagcgggtcgtggcgttgggttaccaaccagtggctggtgatattgcggatgtcgaagacttgacaattgggcaagattttcatttggccggcatggcggggattattgatccaccccgtcctggtgtggccgatgctgtccggcagctgcggtacgccggtatcaaggtcaaaatgattaccggggatgacccggaaacagctgcggcgattgccgaacagttgaatttgtcagaacaggctaaggcgattactgggccagaactggcacagctaagtgatgatgagctggcgaaaaagattgaccaatataccgtcttcgcgcggacaacgccggctgataagctccgaattgtgaaggctcaacagagtcgcgggcacgtcgtttccatgactggtgacggggtgaacgatgcgccggcccttaagcaggcggatattggtgtagcaatggggattcggggaaccgatgttgccaaagactccgctgatatggtgttagccgatgatgactttacgtccttgctcggtgctgtgcgagaaggtcgacacgtctttgataatattcgtaagacgattcgcttcctgttaccaacgagttttgccgaaggcttaattgtggtgatgagtattctgatggatcaatcactgccgttattcccaacgcaactgttgtggattaacatggtatcggcactgacgattcagtttgcgtttatctttgaaccggcagaaagcggtattatgaagcggggaccccgggacgtcacgcaggggattctctcaaagtatgacgtgtttgaggttacctacgtgtccttattgatctctggactagggatgttggcttatgacctcctgacagcgcaaggcttatctaccgtggtcgggagtaccatgacgttaaatgtgatcatctttggtaagattttctacctgtttaacttacaaaacgaccatccagtattctctaagtatttcttcagaaataagatgagctttgctattgtggccctgttgattgcgttacaggccgtgattatttactggccggcgatgcaaggcgtcttccacaccacgagtgcgaacttccactacggctgggggattccaatcttggcgggaatcgttgttttaatcgttacggagattgccaaatggttgcgtcaccgctacgatgccaagatggtggctcgagaacagcgtaatttctaatgactgacgggtgtgacgtgtattaagcgtcaggcgttagtcatcaaataataaccagcagctcccttggaatttgattcctgagggagctgcttttttggtggtttttaagggtcattgtttccagaaagacggtctatttgttataaagttcgatgttagattatgccgagaaagttaacgtacttatggtttaacacaagcctaaaggagtggtacctttaggatggataatcaagaaattattctgggggggtataagcatgtatattttaagagttctaaaaacatggcaattttggctagcaatatttctattgcccgatttacggtatgcctttatgaacaccccgtttcaatttgattggatgctaaacctacttctgggtggcggagcaatccttgttttaatttcggttttttatgatgctatcaatggtattaaccccaatcatgcgaattttgacggaacattgaaggaaaaacgttgagtatccaaaagcttatggtgtgtttatttaaatgactatctgggtggtaagttttcagtgcttaccacccaattttattgtgattaggttatgtatatcgagccaccacctgaattgacgaatcaagaaaagctaggggccaattgaggtgtaattagttttgaacggaattaatgtgtatggatttctgaatcgtctttccacggattaacatttcccacaaatttcgctagctcttagcccatgagactcctatactggacttacaaaggggggcggaacaacaaatgatgaaaaaaagttccgattgtaccgagattttagtgggtaaagccgccagtatggacggttccacgattgtagcacgtaacgaggatggctatgggccaattaaccccattaaatttgtggtgcacccagccgttgaccaaactggcgcgtcatttacgtcagccgtaacgggggtggaagtgcccttacccgatcacgcgtaccgctatacggggaccccgcaggccgaccaaagtgatggtcagtacgaagaggccgggattaacgagctaaacgttgggatgagtgccactgagaccacggcaacgaatgcccgcgtcttgggctatgaccccttggtggacgatggcattaacgaagaagccatgattacgctagtcctaccttacattaaaagtgccaaggaaggcgccgcacgattaggcgctctgattgaaaaatacgggacaggcgaaagcaacagcattgcgtttaacgatcaaaatgatgtgtggtacttagaaacagccggtgggcaccattgggcggctatgcggctaccagaagatacttatgccattgcgccgaaccaaacgctgatgcaaacggtggatttgcaagacactgataatttcttagttgccagtgatctagtggactttgttgcgcaacaccacttgaatccgacaccggacacgtttaatttccgggaaatttttgggacacatggtgaagacgatgcctactacaatacgccgcggacttggtacggtcagaagttattcaatccggaaatcaccgatcaacaaccaacggatcaagacatgccgtttaccagaaagccagccaagaaactggcgattgaagacgtgcaattcttcttatcatcccactacaacgggacgccttatgatccctttggcacttatgcctcagggtcgccagccgatcagcgtaagtaccggccgattgctatggatcgtaaccaatgttcgtcgattcttcaaattagaaatgacgttcccaccgatcatgcggccattcagtggattgcgatgggcttctttgcatacgcgccatatgtgccattctttaccaacattacagacacgccagctgactatcaaaacacgacagcagcagttgatgtggccaatgtttattggttaaataagacgttatccgtgttgattgaaccccattttcacgactatgttgaggctgttaacgcctttcgtgatgggtgccagtcatatgcgcggtcgcgcgtagcggcaacggatgaggcggttagtagtaacgtatctgccttcctcacgcaaagtaatcagatcactgctggtgagatttctaaacgcacgcgggagttatttgacacgattgtcaagcatggcctgttattatcaaagacggcttgggaaaaggggcaaaacttataaattagtccgggggacataaggggggagaaccaacatgaaatggatgaagttagcattcttagccggtctaagtctaagtctgtggggaacgacaacggctcaggcggctaagcggactatcttacccaagtatccgcggcaacgcctatttacgtttaagacccagcggactaaggtgtacagctatccgcgagcggcgtatgcccgtagcaaggtgctgggcgttaataagagcacgaaaaagcagtggacggttgataaggtcgtgacggttaacggcaaacgctacgtgcgtttggcggcagtcagtgcccaaccgttgcatcacggcacggttgccccactgcctgctaagcgcaatcagttggcgggaggatacgtggccttgcgacaattacgcagtcactcagtgattcggcagttaaaagccattaagaaaacggcctactggacgccaacgaccgaccatgattattgggatatgccggcgcgaacgatcgggacgacggctgccgttcattacggtacgacttatggttaccgaacgttgtatgcgaccgagtcgttgacgacaacccgtcagaaacattatctgtatctcaccacggcaaatggcaaagggattggttggctaccagccaatgcggtgattaagggcacttaccccaacttattgcagcgtgaggtgaatcggcagttaacggggatcactgccacgaccacgacagttgatgcggcagcccacgtcaaggtgggtgtggcgatggcggccgggatggtacaacgggttgtcttgcttcgccaagatagtacgacggtgacgtctgactttgttactgggcgggcggtgatcgccaccacgcggtcggcaacggggaaagttgttaagactgcgaaggttaagcaaaccgcgcctatctttagctttaccgcccgtgcagattttgacattcatgggtatacctatcgcgtcaaagtagcgccaactggcgccgtaacgattctcggaaccggtggctggatcgcctaaactaacttcgtttactgactaagttaactaaaagatctggttagtgatcagctaagggatgcgctacactaccagtgagccacgcggtagcggccgcgtggctcagttataaaacgggaagctgtgggacgtctaccatcaaagaagtcccaaccgagcgtaaataaaaaacgaatctgagaatactcaggttcgttttttatttacgctcggttgggatgttttggcggatgactcgggcagggttaccagcaatgacgacgttatcgccaaaggatttggtgacggtcgagttggcaccaaccaccacattgttacctaaagtcacgccgggcaaaatgaccgatccgccaccgacccaaacggaatcgcctaaggttaccggcttacctaggccaatgaacttgtcgcgaccgcgggggtccagcgggtgataggccgcatagatttgtacgtggggcgccaacatacagtgattaccaatggtcactggtgcaatatctaagatgacattgtcataattacacataaagttatcgccaacgtgaatgttatagccaaaatcgcaacggaaattgggttgaatccatgggcttttaccaacagagccaaagagctggcggatggtgtggtccttttcagcagcggcggtgtcgtccagttcattgataatcttgcataaacgacgggctttggtctcctcagcagctaactcgggatccatgatgttataaggttcgcccgcaagaaatttttctttttctgttttcaaatgaaaccgcctccagcgttgttttgtttattgtagcatagtttgcagaatatttatacggataaatatagggatcaaaaattggttcgtcaacttttgaccggttgctatttgggatgaagttcggtatacttacagccgctttagccaaattaggctaaaattaaggagatgatcaacgatgatggcatcgttattcgtacggaaaagtgctgctagttagcgacacttttctgcgagaccctttcagagaagtgtcaggattgtcaatctgaaaggaatttaatatcatggaaccaacaattactgcctatgagtatagtgacatcaaacaacacgttaacgccttagtaagtgcctatttagccgtcaatgatcgccatatgcgatcgattattcgggctgagacaattgcctatgtgacaccattcttaccggagggcgcccccttaacgcaagcatttctggctgggttacagccggatcgcctcagtcgtaaggaagcggcgaagttgttaccgttactagaacccgctgtgattccctttccgcagttcagtaccaaacaactgggaaagctgttccgcaaggtgaaaaagctaaaacaaccagcgtgggccagtttgaatctgcatgaattaacctatcttggttggaacgatgggggcagtcagaagaaatacctggttataccagaccacgagcgggttatcggtatccgcggtgatctggcaccacaaactatcaaaggggtttgtgccatctgtcagacgattggtaacgtgtcgttgtttgtctcaacgacgaaaacctctggactcgggacatatacgcgcaacggcaattatatttgtcgtgatagtgcacaatgtaatcggcaattgactgatccacaagccctacaggacttcttagcggtcgtccggccgcaacgttaactgaataatccactgagcgcgacgattttagtcgggctctttttatttatggaaaggccgatgcaagattagttccgatggttcaaaccggcgaccagacgcgattaaccagccattaaaaagaaaccgctttagcaattaaattcggaaaaaattggacaaaggggcctagattgccggtcattatctgctataatggttagtactttgtgaaatttgatgagtaagagggattgacatgttaatgaagttaaggattgatgggaagtggtgtcaatgacccgccaacaccatttacgaggcgtgctattggcgagcattgcctgcatgctgtgggggatttctggggttgctgcgagcacgttgtttacgttaaatcatcacgtgaccgctctgtggctgacccagattcgaatgattagcgctggggccattctgttgatttggggtcaactaattcacgcccagccatttcaaatttggcgtcaaagagccaccggactacgtgtcattagctacggtctactgggactggtcccagttcagctatgttactttgaagcggtgaagtttggtaacgcgcccattgcgacaatcattcagttcttaggcccctttattattagtatttattatttcctgtttaagcacatgacgccgactcgtcccgaaggcattgggatggtgatggccttcgtggggaccttgttgattgtgacgcatggacacttgactagcctagcgatttcaccagtggtgctcatctggggcggcttatcggcaatcggtgtggcgacgaacaccttgatcccacgccccttgttacctaaatttggggctatggcggtaaccggttggggcttgttcgtggccgggatttgtttaaatgtctttggcccgttgtggcgagtacatgtcacgctaaccgcggctgaatgggggctggttttactgattattatctttgggacggtcattccattcttaatgtttgcccacgccttaggttatatcttaccaacaacggcgagtctattagatgcctttgaacccttatcggcgacggtgttctcggtcatctttttaaatgtgcaactgacaactttcgatttagttggtggtgctttaattattttagccgtcatggtcttatctttgaacggtcgtaagatgatgaactttttccgccgtcgacgcgcagaaacttagcaaaacccaaaagatcggtctactcaggacttaaacagctgagtggaccgatcttttttatagtgcaggtaagctatccggtagacagtcaccgtgttatttgacaggtttgagttttaaggtcatcgcgttaattgccacaatcacggtgctaagtgacatgatgacggcaccaaccatgggatcaagcatgaaaccaatgggggctaagatcccagctgccagtggaatcgcgattaagttgtagccagctccccaccagaggttttcggtcatcttccgtgtcgtcgcgcgcgctaagtctaggaattgaatgacgtcggctggatcactggcgactaagataatgtctgccgattcaatcgcgacatcggtaccagagccaattgccatcccgatatctgctcgggccaagcttggggcatcgttgaccccatcgccgataaagaggactttaccagaggcttggtactgttgaacgagacgttccttgtcttctggcaataagcgagcttgtacatcctcaatcccgacagcgtgagcgaccttattcgccgtttcttgattatcacccgtcagcatgacgggggtaatcccttggcgctttaattcactgacgaggtgctgggcgtttggtttgatctgatcaccttcagcgactaaccccaagacccggtcacctgtgacgagatagctgagtgaattgccttcagcggctaaggtcttgaattgggcttgatcgtaagttaagtggtgttgctccaaataggaaacggcaacgacaccataagtgatgtcatcgatggtaccaaactggcccatcccagtttcttgatgcgtgtcagtagcagctgtataggtaatttgttgtgccttagcagcgctaagaatcccggttgctagtggatgactagagccgctttccaggctagctagtaagcgtaaaatggtttcttcactgtagtcttggtctaagctaatcaaatggttcacttgaaaatgccccatagtcaaagttcccgttttatccatcagcgcaaattttaagtgtttgacatcttccatggcattgcgattacggatgagtaagccattttgagcggctagtgctgtactccgtgcgacaactagtgggacagccaagcccaatgcgtgcgggcaggcgatgacgaagacggccaccgctacgggaagtgccacggctaggttggccaccgttaaccaaatgaggaaagccagaataccaacgaataaagcggcgtagaataaccagccagccacgcgatcagccaaattttctgaggttgattttgcattcttggcattttggatcaagtccatgacttgagcgagataaccggaatcaccagttccggtgactttagccgtaaatgttccggtgccattcacggaaccgccgatgacttggtcgcccgtaacctttttgacggcagcagcttcaccagtgactagggattcattaactgcggaggtcccagttacaatcgtcgcatccgcgggaatttgctcaccagcacgaacaaccactatctggccaacttgtaggtcatttagggaaacgtcgtgggtggtgccagcgtcatcaacgacgtgggcagtttgtgggagtagcttgcctaaggcatccacggctgacccagcattcatgacggtgttcatttcaatccagtgtcctaatagcatgatgacaattaaagtggaaagttcccagaagaaattgttgaccatcggggtgacatggaataagtcgttagcgatgacggcataaatactgtagatgtaagccacaccaacgcccatcgtgatgagcgtcatcattgccggttgtttcatttggagttcggccttggcaccgctgaagaagggggcaccaccgtaaatgaagagaatcgtgcctaagatggcgacgacccaatcactaccgggaaaggttaactggaagggcagggtgacacccatcattggtgacatgagaataatggggatggtcagaatcagggaaacccagaacttacgctttaagttgcccatgtgcatcatatggccatcgcccatgtccatatccatatcgttcatattcatgtgatcgccatgagccatatccatttggtccatgtgatcgtgggtcatcatttcgtgttctttcatgattcacagctcccttcacaatctgctggtaaacagtcacagtcgaccatttgaggcgcctgtggtagcttctgggttagtgtcccaattaactgttgaatatccgtttgactcagttcagtttgttctaatacgtgggtcaaagctttgccgcggtgcatcgcacacatctgatcaagctcggtttgtagggccgtgtccatggccgtttgttcatcgataagtggtgtgtagatatattgacggccttgtttggtggttgccaaggcgccttttttgaccagacgtccaattaaggtcttaatcgtcggggctttccagtcgtgttggcgctcaagaagttcaatgatggtatgactatcggcctgatttaacgtccacacaatccgcatgacccgccattcggcgtcggaaatggagacggttaatgttgtatttgacataagtgactccccccttagactacaaatgtaatctttaataactgacttgagtctacatctgtagtcatgatgtgtcaagcaggagacttttttacaaatgtgctaataataaattaaagtttcggcaaaaatagtttagcactatgcctttttaaagattatttttgtataatacgagttacgtcaatcaaaaaaagataaacgattaaaaaaattgtgttacggaaaggggcgtttaacacgtgaagatgttaaaacgctggttacggtggggggccgtactgggccttatcggtagcctacttggtggtggaccaaccgctagtgctgcggcaaccaagacggtatctaaggtggctgcgcgggcggcctacgtcatggatgcgcagagcggtcaggtactttaccaacaaaatgccaataaaaagtatccgattgcctcactgtccaagttgctgaccgtttacttaacagtgaaggccattaatgatgggcaaattaaatggacggataacgtgcccatgagtcaagacttgttaaagctcagtcatagctatacgtattcgtcattgcggatgaaaaagggtgaaagctttacggttcgtcagttagtagcggcggcgatgattgcatcgtccaatagcgcggctacggctttaggcgagtacgttgccggaagtaatgcaaaatttattcagttaatgaatcaacagagtcgagactggggaatcgatgcccattttatcagttcatcgggcctggataatacggatttgaaggattatcatttggtattagctggaactggaaaaaaggaagagaacttggtctctgcgaaagccatcaccgtggtggcccaacacttactggctgctgacccaacgataacagcggttgctagcaagacgcaggccactattaatggcaccaaaatttataatgagaatagttgtttgcccggtaaatcacagtacaaaaaggcgagtcacattgatgggctgaagaccggctatactgagaatgcgaagttatgttttacggcgacctataccgtgaatgggcagcggatgattgccaccattctgggtggtgacacaactttctcagcaatgaacaagttaattaaacaactcaaacagagctatcgactggagactaccgcgctaaccagtcggcagattcagctaggcaatggtttggcaacgaccgtcactgcggcaccaacttcccagcaggcaggggtgtggtatcggacgcaagctggtggcttgaccacagcggtgcaaacccgattaacggcacaacaactacgtcggggagtggtatcggcgggtgatcctgttgcgcaagcgaccgtcaccgaccggcaagccggtgtgcagcaacaaatcacgtatcaagcggctcaaacagccacattatttgctgatcgggtcgtgtttcaacaaactgatcagaccgatccgttattaacggtcttggttaaaccgatggctcagatttttacgacctaatctacaaggactcagggactggaaataaccagtccttttttgataagtagatgttttgagttgccttcgtgtgggacgaagggggtaagatggcattatgaacgattaaaggaggacttttggatgacaacaattacagaaacctttgcgttgaacaatggtctagagatgcccaaggttggttttgggacgtggcaaacgaagccgggtcaagaaacctatgaagcggttagtcgcgcattaacagctggctatcgatttattgatacggcgaaggcttatcgcaatgaagcgagcgttggtgaggcaattcgtgacagtgatgtcgcccgagaagacctctttattcagacaaaattacccgctgaatccaagacttatgatgaaacgttagccgatttcgaaagtagcttagctgcgttagacttagactatgttgattcttacattattcatgcgccgtggccgtgggcccaaatgggttccaaccatgatgctgaaaatcgtgaggtttggcgtgcgatgcagacgatttatcagagcggtcgagctaaagcaattggggtgtctaactttaattcccatgacctcaacaatttgctgacctgggatggcttaacggttaagcccgctgttgatcaaattcaatactatgtcggttacactcaggcctcaattgtcgatacagcaacggcaaatgagattgtcgttcaagcttattcacccttggcaacgggtggtttggtggatagtccagagctagaacgggtagctggtaactatggggtctcgattccacaattagcgttacggtttgtcattcaaaatggggtggcaccactccctaaggcccggtcaatggctcatgtacaagctaatgcgcagttggactttacgattaatgaacaggatatggcgttcttaaatcgcctgactgataataacggttggcatccagtcggtgattaactaagattgcctaaattttaagcaaaccgcataaagtgataaaaaaagaccccccgcagttactgggcatcatcgccagtaactgcggggggtcttcgtttattaagcaccactgatagtggtcgtgagcttagatcgatttaacaagacggagcttgccacgacggataaggagctaaacgccattgctagaccagccagttcaggactgagtgataagccaatcgcgaagaagacacctgccgccacgggaataccaaggacgttatagatgaaggcccagaagaggtttagtttaatacgactaaacgttttttggctcaacgccaaggccttatcgacgtcacgtaagtcgtttttgactaagacaatgccaccagaatcaatggcaatatctgtgccggaccccattgcaataccgacgtcggctgtcgtcagtgctggcgcatcgttgataccatcaccgacaaaggccactttgccatcatgttggaattgcttaatctgggcggccttatcgcctggtaagacatcggcaatcacttcatcaatcccaatttgttgcgcgacagcctgggctacccgttgattatctcctgttagcatgacggttcttagaccacgtgcacgtaaggctgcaatggcctcttttgaggttggtttaggggcatcttgaatggcgatcaacccgataatgcggtcatccagacccacaaataccacggttttggcctcgttttgcagtcgggtttcctgttgttgtaactgcttgttaaaggtcagatcgcctaagagtttctggttacccacgactccttgttgaccactaatggttgcggcaactcccttaccctcaatcgcagtgaagttctcaaccggaagcgtggagatgttgtcagctttagccttagctaaaattgctgctgccaatgggtgttctgatgagtcctctagactagcagcaattcgaaggacctgctttgaatccccaatgatatcggtgacttggggcttgccgacagtgagtgtgcctgtcttgtcaaaaacaacggtctgaacgtcgttaacggcttccagaacctccccatttttgataagaatccccattttagcgccgcgtcctgtgccaaccattaaggccgtgggcgtcgctaaacccagcgcacatgggcaggcaataacgacaacggagactgcaaagatcagtgcattagcgaggctggcattcaacagaacgtaccaggcgaggaacgtagcaattgccagaatcaagacaaccggcacaaagatgtcggagaccttatccgttaatttttggatgggggcgtgactattttgggccttttttaccaggtcgacaatttgcgatagtagggtttgatccccaattttatctgccttaaaccagaaggtaccggtgttgtttagtgtcgagtcgatgacaggatcggataccgttttggtaacgggcatactttcccccgtcaccattgattcgtcaacgctggagctgcccttaacgatcgtcccatcaaccgggatcttttggccgggtttcacgcgaatggtgtcacctaatttgacagcagcgaggggcaccttgacaaagtgatcgccacggcgtacctcagcgtctttggcttgcaagttaaccagtttttcaacggcattagaggcattgtgccgcattttttcctcaaagacttgtccgagaagaacaaacgttgtgacaaaagcagcactttcaaaaaagacggcttggtgggtcaccatcgcatagatactgtaaaagtaggccgttgccgttccaatagcgactagtgtatccatgttagcgtggtgcttggtgaacgaggcccaagcgctttgaataaaggggccggccgatagtagcatgatgacagtggttaacccaagttgggtccaagccccgcctggcagcatccagccgaatggcattaaaatcataccagccaacatcggcaaggagaagatgagtgaaatccaaaaacggttagtgattgacaaccgtggccaactcctttttatttgatcgttaagttaccgtggaacatatccataccacaagcccattgaaagttaccaggcttactagtatcaatgtgaatgacttccttttgatgacgtggaagttcttggttaatgccaaaatcggcgaagatgacgtggtccaaacaactggacgcgtcttgacgaacaaaacttagcgtcgccgggataccttgtttgagcacgatattttcgggcgagtagccaccattgacttcaatatcgatattttgggtttgcccatgggtggcggcagtgacggtagtggcgtggtggggaccaaagaaccaccaaagaataaaaccaataattaagagaccaacaatgagtacagttagtttgagcatgataaaccagtcctttcagtctagataagtatgaggaagacgataagtgacactaaaaatggcggtaatcacctaatgacttaattcggtcgaatcgctaaacgactaaaccaagtttcttgtttacaaatgtaatcctaatcaacgaaattagtatatcgccatcgtttacatctgtcaacgataaaaatctgaagccaggtggctgattggttacttatcttcagtgcaggggtaattaaaaagcgatccgttcagcttcaatacctgctgaatggatcgcgacgatctattattatttatgactgaacttaaccccgaaacataaagatcccccgaatgatttccgcaccaattaacacgatcattgctgaccaagtcactaacgttactatgctccccatggaaaagacctccttgtgtatggtttaactacctctattgtacgctgaaccgcatcatgtcacaataggtaccgcttacatttttatgctgaaataaccagcggctaccaaaaaaccccgaacaatcgtcggggtcattaggaagcttatgaatgatgaacgttaatcaacgtcgcaaaggtggccgtactgatccccggtgttacgcgtagccgggatagattatagcgaccttcatgtaagcttgccaagccttcttgcgttgttaacgccagttgataccctgccggtttagctaatttatgagtagccgcgttggcgcgaccggcggggtaacataagagggtggtcgtttggtggaggtgctgatccagccatgatttggagttaattatttccgttcgttgctgggccgttgttaaggcattgaggtcgaggtgatgaacggtgtggctaccaaaatcaactaggccggttgctttcatctgtttaagttgggccaatgacagatgattggttttgtgggtgaagctagtgatgacattgatggtcgcgtgaaaatgatcctttttcagggttgccataatttttgtattgtctttatacgcatcatctaaggttagccagacgactttcttttgcggaatggtattggtctttaaagcccgaattgcttcggtcgcagtgagggtgcggtagtgatgctgttttaaatacgttagttcttgaacgaactgttgcttgggcacgcgtaaattattgccgctagagatactgtgatacatcagaattggtaactgaagtggtcgtttaagtttgatccacggtttagtcgtggcaacgtgagttgttttaacgtgactggtttgtgtaaccggacgatgggcagttgctggtgtcacttgatgggtagatcgttgacgaagtccaacccccacgatgatggcaatgatgagtaccaaacaaccacctaaatacccgaattttttttgcatgatagtgtcccccaataatttcattataaggggatcactttcaaaaaggaaaattaatcggcacgttgggccaatcgacgataataatcgatcgaatccggtggcagatgcagggcggcaatgacctcctgatcagttttttgggggttacgccgaagatagttaattaaataaccttggtataaaacggtgggactcaaagaaaagccaataatcgcttcatctggtcgtaaatacttatgcaaaccaggtagcgttaaatggggatcggccgctgcgcgttgtttcaaaaaccaatcggggcactggaaccgttgttgtaagggaataatgaaggcctgaaatcgcttgagaaactgacgggcagctggcgaccagttagtaggctgtagttgagcggtcatgccgggctttaagaaagcctgttccggatagccttgggcaattaataagagggtcaatcgggtgtatacgtggaggcgttcatcacgcaaaaaggtttcaaggttgtcgacccattgataattaattggttgagcgggttgcttgggtttgcttttaaggtccagtgtgggcaaataaggggtccattgatgagaaaaaagaaatttgaagtagacgttgagatgggaaagaatcttattgtaagtttgatttttaatttgacgagccgttaccaacatacttaaatactgctggacgtcggttgtttgcagctgattgacttgatgggtacgttgataagttggattgaagttttctaagtagtggaaaaagtcctttaatgttgccgtgtactcatcatgagtggccgtagccatgtcacgctggtcgagtagacgatcaaaggcatcctgatagggatagtcgacagacattggtttacctcactttcaagcatgtttagcctgattatagcaaatctaagacagtagttaaaaatgaaaaactgaccgctagccctcactgatgagagcagcggtcagtctgttgttttttactatgcttggctcaccgtacttgcagcggcccgcacgcgttcacggagtttttctttagccggatcgttgagaaaggcaccgtcgatagcattgagggtcaactgctccagtaaagaccagttaagaccgaattcatcgtgcattcgcatgatttcactggtgagcgtgacatcagaaacggtgcgatcatccgtatttaaggtgacttttaatccggcactgagaaattcagctagcggaaaggcggcataatcggcaaccgctttagtttggacattactggtgggacacatttcaatggtggcaccagctcgtttggcttggttgatcgttgccgggaaaccgctcatgtgaacgccatgtccaattcgtcgcgcaccgagcgttagtgagaccgccacattgtccacgggaccggcttctccagcatgaagggtaaatggcaggccagtggctaacccagccttcactgcgggtgccaagtcaatggcgggatggttggcttcatcgccagcaaagtctaggccaacaacgccttggtcggcaaaatcggctgccgtcttaaagaccgcgatacagtccgctaggggttgatcgcgcatggcacaaacgattgcgttgactgggatgccgaattctcgagtaccagcatgcaaaccatcgagtgtggcggcgatggcttctttaacggttaaaccttgtgcggtaaaaattgctggggcaaagcgagcctctaagtaaataagtccatcttcggccgcggtctgaaccatatcgtaaccagcaattcgcaattgttcaggcgtttgcatcaggtcagtaaccacttggaatcgctgcaagtaatcaatcaggctagtcgtttctagcggggccgtgaccaattggcggaggtcggcgtcatcggctggtagggggctgttcgttacggccgccatttgccggattgctgaaagtgagatggaaccatcaaggtggcagtgtaactccaccttgggataatggcggacattttctggggtaaagggcttaacgttagacattactgaactcctccttcgattaaacacttgtccctagtatatcatgaaagcggttaaccgccagctaggatcgataatttgtcgggatttaaggctgacctcgttgtttcccattctaaagttaagcaattgaccaaactaaccgaattgggcgattatgactgaacaagtgaataacgccgaattgttggaagtgagcctaaccgactggcaaattttacaatttataaagatagtggaaaatcgttgtttcacttgactaaacattatatgatgggagtacttaatagaaatttgatttgtagccgtgatttatgatagaaaaatcatgaggtgctacaagattggttgttagtctggttatgaacacactaaaataaataacgcggcttaaaaattggcgaacgaccatttgggggagtgtcaccaaaagcttagtaatcggtttggtggaaaaaggagtaatggatatggaacaatcttacacgcgactaacgcgggaagcagtccggcgtcagcatgcgggcaagcggcgttatattacgggatttgacggcattcggacgttggcagtcttaggggttattatctatcatttagcgccgtcaacacttcaaggggggtacttaggtgttccgattttcttcgtggtttcgggctatctgattacatatttactgattcaagagtgggataagacccaaggcatcaatattcttggcttctacggcagacggctaaaacgactttacccggcactggtcaccatgttactggggaccacggcctacattacgctatttcagcggagtctgttgttaaatattcgtggtacggtgctgacaaatctcatttatgggtacaattggtttgagattaagcacggacaatcctacttcgatcggtttagtggggagtcgccattcacacatttatggtcactgtcgattgaaggacaattttatctcgtttggccctttgtggtactgggcttgctcttattcttacgtaagcgactacgagcagccgctattttattgggcgtagccattctgtcggccgtgttgatggccattctatacgatccggccaatacgaaccgggtttattatggtactgatacgcggatgtttgcgattttgattggcacggcgatggccttcttgtggccggctcacaagctcaatccgcaagtgacttccgcccaccgattaattttggatattgccggtggcttgtcactgctcatgctgatctggatgttcttcaatatgagcggccaagcagccagcacttatcgtggtgggatgttctggtttacgttattgtcaggaattctagtggcaacggtagcgcatcccggcagtgatttgaatcgcgtgttgacgaatccggtcttcagctatattgggcagcgaagctacggcatttacttgtatcaatttcccgttatgattttttatgaggcccgggttaatattggtaatcacccgttactaaattcgctgattgagctggccttgattatgttggtcacggagttgagttaccggttaattgagaatccaatgcgccattaccattatgggcaacttacgcaggatgtggtgcagtatttccatcaacctagtcgccatcgttgggcgagcggattaggggtggttgctgccttactgtttagtttatcggctgtgggtttcgttcaacaaccagctagcgcacaaccgacagcgttacaaaagacgattacggcaagacaagcagcggctaagaaaaagaatgccgcggcggccaagaaacaacgtgctttggcaaaagcggcctcgcaacgaaagcatgataaggctgcggctttagcgaagttatccaaagcggataaaaagattgcgaaaacgtacttcttatcggttgatgaactacgaattagcaaacagacaccgttaacggcggtcggcgattccgtgttgctggacgactctggtgacttgcaacaagtctttccgggggcggttgtagatggggccgttggtcggcaagctgatgcggttccgggagtcattcacagccttgctcagcggggtgaactagccaagaatgtcttagtgaatattgggactaatggttatgtgacgcctcagcaggctgatgatattgtgcacgcaattggtaccgatcaccaaatcttctgggtgacggcgcacgtcccaacccgtgaatggcaagattcagtaaataaccgaattgcaaaaacggcggctaagtataaaaatgtccacgttattgattggtacacaactgcgaagacacatagtagttggtttgtgagtgatcatgttcacccgaataatcagggtaatcgttactttacatcactaattgccaaagcgattgctaaggaaacgaaagcgtgagattaaaagcgtaagtgctaagatatttagcatctacgcttttttagtgggcgcactcatttggggaagtcaaggtttgttgcctgaatttactagtggatcagtgtttttgcacattcaggacgactttcgagtagtcaagtcggttgtccgaggagagatgtgctatgatatctgtgaattcagagatgggttcggacatataatctacggggggtaattgttatgatgaagaaagttgcaatgattgctgcagcggcagccatggtattaccattaggtgtaggggcgattgcaccaactaacgggagcgcaacagctttagcagcgacaaagaccgcggctaagaaaaccacattaacgttggttagctcaaagagtatgaaaaaagcggctttccacgttaagagtggcagtccagcactgtatagtgccgcattcgctgcagataaagctaaagtaactatggcgaagaaaggctcattgactgggcaaaagacgtactacgcaacgaagaagattgtggttaagaccaaggcagctaagacagccaaggctaagaatgtaacgtatgtttacgtgaagacatccaatggcaagaccaagggctgggttgctttgtctaagttgaccaagggaatctttaaggcagctgacggtaagaaagttaccaagaaagctgcagataaggttgctggcaagacctacacattggttagcgcaacaagtcttaagaaatcagctttccactacaagggtaacggtagcgtggctttctttaccggcaagtttgctgcagacaaggctaaggtaaccttgacgaagaaggggactttagctggtggcaagacttactacgcaactaagaagatcacggttaaagaaaacaagaagaacgtgaactacctgtacgtttctagcaaaggttgggttgtggcttcacaattaacggccggcaagttcgtacctgcagactaaattaaaatgtgagttatttgaaaacggctgccaagtggtggccgttttttgcgtggaggagggggcaattaagcagtgcaaatagttacaacatgacctgttgtaatccccgccagattaaggattcttaatgttttgtggtgtccgaagtaaccgctttacaatctttgacaaagcacgcataatgggtgtgtaaaatgcagtcaagaatctacggaggtgttttttgatggtaaagacaaaagcagtaatgattggtgcgggtttagcaaacatggccgcagcagtttatctgattcaagaaggccattggcgtggcgatcagattactttttatggcatcgatatgcacgggtccaatgatggtggggaagcacacgacttcacggatgaatactggaataagaatcatccattagataaccagaccgggtatgtggctcggggtggtcggatgttaaactaccggacctacgttgatttaatggacttactggaccggatcccgtcaaccacggagccaggaatgacagcggccgaagatacgcgtgactttgatgcacatcaccggacgttcgataaagcccgtttactccaagggggtaaggggatcattgatggtggcaagctgggtctgaacaataaggatcgggtgctgttatccaagctggttttgatgccagatgacgaagaaacaaagttggataatgtcacgatcgccgaatactttaaggacgacccgcacatgttccagactaacttttggtatatgtgggaaacgactttcgcctttcgggtagaaagttcagcgcaggaactgcgccgttacatgcaccaaatgatttatgaatttacgcaaattgaacatttagtcggagttaaccggacgcggtacaatcagttcgaaagcatgatgctaccactgattaattacctgaaaggtcaaggtgtcacctttattggtaaccggattgtcactgattgggaatttgccgatagtccgatgcaagatgagattacagttaccgggattcacgtgaagaataccacggatgacaccgaagaattggtactaattgacgatgacaccgccgttatcttcacaaacgggtccattacggattccactagcatgggggattacaacactccggctgtggaaaatatggaatacgggattagtgccgcactgtggaagaaagccacggaacgtttctataatctaggcacgccagataagttctttaacgaccggaagaattccgaatggaccagctttacgctgaccactaagaatcacttgttgttaaacgaaattacacggatcaccacacagatgcctgggaatgccctgaattccttcctgtctacgacgccaatcactaagctggggcaaaaggatgttaatatgtcgattgtggtgcaccatcaaccacatttcacgacgcaaaagcctaatgaaacagttatttggggatacttcctttacccacgacggactggagagtttgtccacaaacagtacattaagatgactgggaaagaaatggcacaagagttgattggtcaattgtctaaagttgacccaggacctgataatattaagcacaaggaagcagaaattttagacagtattattaataatattccagtgcacatgccatatgcctcggccttatttaataatcgggctaagaccgatcggccggaagtgattccagcacactcgaccaatcttgcctttacgggtgagtttgcagaacaaccgtatcagatgattttcacggagcaaagtgcggttcgttcaggtgaaattgctgcctatcactttgcgggtatttccatggatcatttggtcaagacgccgcgttatgataaagatccgaagacgttgttgaaggccacgcgccggatgtttagctaaacgctagactagcgagttgcggtcaaaaaaaataggacctccctagaatctgtctgattctggggaagccctatttttttgacccaggaattaactagccatggtgttaatgttagttcgatgttgacgagttccggtccaaaatggcaccttgacgacgcccatcactttgttagcatcaacgtaaccccaagcgcgactatcctcggaaatactgcgatggtcacctaagacgaagtagtgtccctgaggaacggtgttgccgcggtaagtccaatggttcttcttagcaagactggcgagggtccagttgccggtcccacccgtacgttcggcctgactgatgaaaggctgattgattttttggttgttaacgtaaatatagccgttcttgctgaccaccttgtcaccgggcagaccaatcacccgtttgacgtagttagtgttgggggcggcagccgggtcttcaccataggcgtcaaagacaatgacactgagtcgttttaactttaatggcttgatgacaaccatgcgttcgttgttggttagattgggttccatagagccaccagaaaccttaacgacttcaaatagataagtacgaacaagtaggacaatgacgaccgcgaccacgatcggcaccacccaactaagaatgttacggaggactttcataagtcagacgatctcccttgtttactagacttgattggtgtcattctagcatagcttatcctaacgtttgcctgtttggtgaaaaattaaccaaatgactagaaataacgatctagtggtagcgctttcggttaaactgtgtcacaataaagggtgtaaactgattgacctaaaaggaggccgtaacatggcagaacaacaagaattactaacggttgcaacggcaatgctcgataaggcttataccccgtattctcattttcacgtgggtgcggcggctgtgggtgccagtggtaagatttatggtggatgcaacattgaaaacgcctcgtttggtgccactaactgtgccgaacgaacggctatcttctcgggaattgctgccggggagacacactttacggcgttattggtaactggcaacacggacggccccattgccccttgtggcatctgtcgccaggtcattgctgaattctttgatgccgacgcgccaatctacttaactaaccagaaaggggcttttacggcgaccacggtagccgcaattttgcctggcgcctttactgatttgaactagatagcgtaggtttatcttaaataagattattagcacgtccagatcctgatttctggaggtgctattttttagcccagaactgataaagcgaggtaaactggttggcttaacaaaggaaaatcagcatctatgataggctaccaatcgtttatatccccctatgaatggttggtaggatattttaactggcaatcaaaccctgcatgggagtaggctcttatccaattaaccaatcattctatgtaacttttcgattgttaccagtcgttgcaaattggggtcactttttcagggctaggcgcggtataatttaactagactaggactaatttaaatgcgtgtttttgttaggtgtttcgtgagaatcccgctaagcatgttttagacaacgcttgcagagaattaccttggaagcattaacgatctgctaaagaccctttattttttggggaagagaggcgatactaataaagggaactagctagagtgttcgtaaagatgccaccaagattgtaattggtgtagttgaacatgcgtaatatctgccagtggaatttttaaggaacgaccagcagttaagccaagatagacagtggaatcgctgataaaatcgatggttcccgtgtatgtggccgctttgagggtgagcgttgtaacttggttattttggtaggcattttggagtagatgcctaatttgtggactgttcgggtacatgatgggcacatcctttgtggtaagcacttcgtacattattatagaacaaacgttcgacttttgaaaccagtttgcgaaacattatcggataacttaatttcatggtaaaatgtacgcagggttattcacctgataagcttgttgtcagatgatagacctagagggtatgcatgcggtcccgtagccgtacgcaaagttgggtgaaaaaaggcagcggatacgctgaacaaaggagtaatggacgaataatgacagagacagctagtgaagaagtaacggaagcacaattaaaaaaggaattcgatgatctctacatgcatatttttaagtacattggggacttcgtttccattccgacgcaaaagtacaatttgactttcgaagcattcatggtcatggataacgtggcacggagcaagaatggtcaaacgttggtggaattagctaaattggagggcgtttcgaagagtgcaattgcgcgccaagtaaacgttctgttaaaggaaaattatgtgatgcaaaaggttgaccctaacgaccgccgtgtcaaatatattacgttaacggcggctggtagccgggttcaacggaacttatcccaggcaacggatgaacggttccaccgttggctagaattctttggtggtaaagaagaagctgaacggtttatcaaggtcttacacaaagccaacgaacgggctattgcggcgggcttcgttggattcgatagcttacatgataagcgccggaattccaaccgtagccggaacagtcatggccgtacggctgaatagcttaagattgatcttaacgaggaagtagcgcggaacggaggtttcgggctacttttgggttaaagcgaatggatgatacacgtggcaattaacacggattcagacgcgtttaataaaagaagccgagttctcaggacgaaagatcttctgagaactcggcttcttttaatcacggtcactttgctgatcaagggtgagctttaagcgacgttcattgtagaacaacaaggtaacaaacatgacgatgtataacagtagtggcaaccaagcataatttaaaataatcatgtgttgtgttgcagtattttgcgggtgattagccacgtatccggacaagtgaaacaatccggccgttactaaaccaccaaggcctaaaccgacattaaccccaaagtcatcagttgacgccaagatgccctcggcttgaatccccaaagccatcccataacgaatggtatcggcaatcataatggaaactagaccgataatcaaaccgttaccaactgaattgattagaatacccgcgaataagggaactaattgattgaacaagacccctagcgttaagatcagttgaccaccggcggccaaggcgatcccacccaacattgtttgttttttaccccaaacgtgagccgcacgaacaatcagcaagacaccaattagtgcggcaaaagtaaagctgttggcccacggaaccagtgcctcactatgttggatatatttgaagtagtaaatcgtcgtttggttcttaatggctgtggttagccaatataacaagatgaccacagagatgattaaccacggttggttacgtcgtagcatccgaccgacagctcgccacgattggtgagcatgttctggattggtaaagcgctcacgaacgtggaaaaaggtattccagattaatgccagtgagatggcgccaaacaaaatgattgtgagtaaaaatccacgttgctgattgccgtggccgaaccaagcaaccagtggcaatgtgaagacggccacgataatttgcaccgagctaccaccgaattgacggatgacccctaggagcgttagttcagattcgttttgggtcatggtcggtaggattgaagtaatgggtaggttaaccgcggtgtaaaagaaacccaggcccaggtaagtcacgtatgcccaaataagttttccttgggcaccgaatggcggggtgacgaaggtcagcacggcaaacaatacgtacggcaaggcgtaccagaggaaaaaggggcgactcttgccccatttagaatgcgtgtgatcaatcatcacaccgatgagcaggctttcaaccacatcagccagccgcgcaacgataaataaaatagcggcggcactagctgacaggccataaatatcagtataaaagaacaggagatacgtggtcatgatttgaaagaccaagttatcggctgcatcactcaggccatagctaatacgttcaggccactttgtttgccaaggagagttcaacgggttacctccgtgccactaatggcgatgactttgttgcgttaaccgccgataaacgtcggtaccaaccagatcgttggtaaccatccagacgatatggccgagggcctcggaaatgtgttcgtcttttggctgttctttagcggtgggaacggtgcccatggcgggcatgatgccgagatggaaggctacccagatggctagtccaaaccaagtaccggcatcctttttgatggcgggtaccttttcaccgagaatttggtatagcaccgcgaaagtggttgaaaagccaaagtggatgacaaagccagcccaaggaatctcgtgtccggagtagtgatagctagcgtttaagatgctatctggaatgccaacctgtttcattaaggtttctggtggattgacggcgtctcgttttgcggttcgggggggcaacacattctcccaaccgagcttaacgaagccagaaatgataccagccgcgccgcccgcaatgatcgctgcgggtaaatttaaatgacgatgatcaaataaggtcacgatgactacctcctttaagtaagtacactattgagtataccggtcttaccagaatttagggggaaatttgcttgaagcgtgaggccatctggatggttttagatatgttaagctgataagagagtcatgaaggaattgttactgtcaattgagtgagagaggagcgcggcatggcaaacatgtttgagcaaggttatattgagattcaagacgccacccaaaataatttgaagcacgttaatttacgagtacctaagtaccaaacaacggtctttgtgggcctatccggctcgggaaaatcatcattagttttcgataccattgcggccgcctcgcgtcgcgaattgaatgaaactttcccgagttttacccagcaatatctgccgaagtttggtcaaccccacgtgggacaaattgcacatttacccgtggcgattgtgattgaacaacagcgattgggaaaaaatgcgcggtcaacgttggcaacatatacggggatttactcgttgctacggctactattttcgcgaattgggcagccatttattggctactctgatagcttttcgtttaacttaccacaggggatgtgtcccacgtgtcagggattgggctacgttgatgacattgatgaaagtaagctgattgacccggagaagtcgttaaatgaaggtgccattaccttcgtcagctttgatccgggcacctggcgctggcgacgatatgggacgagcgggctatttgataacgataagccgttgaaagactatacgccggccgaatatgaactcttgatgcatgcgccccagcagcgattagcgcatccaggagctggttttccgcggacagcattatatgaaggtgtcgttccgcggattcgccgatcgattattggtaaaaaagaggcggcacatcatagagaagcaattgcggcgattgtgacgcgcaaaccctgtcccacgtgtcagggaacgcgcctaaaaccagaagtgttgaaaaaccgaattaacgggcaaaatattgcgcaggtcagtgcaatggatttacgccacgtgttagcgttcttacaacaaattacagtcccactggcggccgacgtcgtgcgtgaattaacgacgaagattcagtcattagtggcgattggtctgggatatctaaccttggatcgggggacgagttcgctatctggtggtgaggcccaacggataaaaattgcgaagtatctgaccagttccttggttgatatggtctatattttagatgaacccagcgtggggttgcacccgcatgatattcagctgattaagcaggccctaacgaagctgaaggataaggggaataccgtgctagtggttgagcacaatccggctatgattgcgtttgccgattatgttgttgaaatgggaccacaagctggtcaaggtggtggtaccgtaacgtttactggtagttacgcagacctactggcgtcagatacgttaacggggaagtggctgcgtgaaccccatcactggggacccgaacggcaacccacgggacaattagcgctcagaaagatcacccaaaataatttacaagatgtgaatatcgatgtgccactgggcgtgatgacggtcatttctggtgtcgccggttcgggtaagtcctccctggtgacggccattaaggcgcatctgcaggatgactatattgatttggcgcaagcaccggtagggattaacattcgttcgacgccagcaacttatctagggattttggatgatattcgtaagctctttagccaagctaacggtcgggtaggtacgagcctctttagttataatggtaaaggcgcttgtccccggtgtaagggtaaaggggtcaccattactaacatggccttcatggacccggttgtccaaacgtgtgagctgtgccacgggaaacgttatagtgacacagcgttacagtaccactatcaagataaaaacattgcggaggttctccaaatgtccgtgacagctgcggccacattttttgcggatacaccagcgattgccaagaagttagccaacttggatcgggtcggtctggggtacttgacgttggcacaaccgttgactactttatcgggtggtgagctacaacgtttaaagctggcggttgaattgggtaagcaagggacggtgtatcttttagatgaacccaccgctgggttgcatttgcaggatacggcacggttattgaaattgtttaatgaattggtagaagctggcaactcattaatcattattgagcataacttggccgtgatcagtcaggctgactggttaatcgacgtaggtcctgatgcgggtcgttatggtggtcgcattcagtacagtggaacgccacgacagtccgtgacagttgctgattcgaaaacaggtgttgctttgaaacagtggcaacaggatacgaaaggatgatgggttatgccattaatgcgagttgatatgattcgtggccgtagtaaagcggagattcgtcagattttggatattgcttatcaggtagcctctgaggaatttcatttgttgccccgtgaccgttatcaggtcgtcacacaacatgagccagaagaaatggtgattgaagacgtcggattgggactcccacgatcgaccaagtttttattgttcagcttaacttctagcccgcgtgcggaggctgataaagaacggttctatgcgcgattggttcaggagctaagtacgcacacagatgtggcccccagtgatattatgattaatctggtcaccaatactaaggccgattggagtttcggcaacggggaagcacagtttttgaatggtaaattatgataaaagaggcggccggttggtcgtctttttttgctgctaattaaacgtacgttccccatttttgtcgaattatggtagactgaaagaacatgatttttgaggatggaggaaatggcttaatggcaaccacaattttaacgccagctgagaatcgtttcttacagctgagtcagccagcactacaattaacggagctgacgcgggttatgccacttttgcgtgatcacccaaccattaaagacagtagtgattttctgtcgcggtctactcggcaactcttactggatcaacgagtgaactggttggttcaaggcagtgatgtttggaagttgttagcgcggttaccgtatgccattaatgcgagtgatcgacgcgcagactggcaccattgtgcgttgtgccataagccggtgcgctacgagtaccatgtggtgttgcgaacggatggacatgagattttggtggggtcggagtgcgtcaagaagttcatgagtgatgagatgcaatacttgatgaccattacaacggaggataactttcacgcagtggcccagtatgatgacctgacggcacagtatccccaggttcctgaaatactatgggatcaacaggccttgccccacttaccacaacagcatcgccgacgtcagcattgggtgaagaatgggacgaagacaacggtcaccggttatttaaagcaccgccaacagacattgccagaaacccaattatcgccttatttggcagaatatacgcaattgcaggcggttgatcgccaaatggctgaacggcaacaagtccaacaacaacacgccgttcaacagcaggcccaactggctgaaaaagaagcggcagctgcctggcaggcggccgatcaagcgcagctcacggcagaacaacagttgcgtgcgtcaactagctatcagacctatttacaggcagtagccgccttaatggtgcaacatttacccttgcctcaatttaaacagcgtttgcgtggaatcaccatgccaccagcactcggccaattggtaaattcttatcaactcggcgtgatggcaactgaatttgcacgggcgggccaaatcacggctacgcggcttcaaattgtgccccgttacctagtcgctgatctgaatcggttcagccggcagttggccgcgcagcgccagcgggattgggatgatgacgtctttaatgcagcactagggtttgaactgacagctgaccagcggcgacaacgattgacgcagctgcgggattgctgggagggccggcaattatccgatgcctgttatgcgacgctattgaggttacgggaatcttggcagcagtctccagttattccggcaacgtggcccgaaaagctgagacaagcttttcaagtgcggttggccgaacaacctgccactggttgggtaccggccaagaaaaatcacgtgacgcccagccaacttcggcaattgataacgtcacaagcagactttgcgacagttgtcgcgcagtatcatcggctgtacgccttgccaaccgctacagaagcggtgacgctgtcggccttacatcgttattacttagttaaagcggatcaacgggccggtcgggccaaggcaacggctaagctggtaacggagttgttgaaagaaactgtggatgactgatggttatgtgtattagccagtaggtaatcaaaaaatgagatcatccatcaggatggtctcatttttagttaaatatgctgaggttcatgacggatatttcccaatgaaattcccagcgatatcagaataagcggccagttcaaggcgacattgtacaaccagaaatggtcggcatttgtggggctaaagaatgccagcaatggctgggccataatggcacttacggcgactaacaggccgaacatggtcagttgacctaataagccaccataagttgagaagcggtatttatgaacgatagcaagatcgtgatcaatatccgtggcttcataaagggtcgtattgatggtggggttatcgtagccgatataaagcgtaatcagtaagagggccacgaggtagcttagccgccaaggaatgagcaataagaggtgtcccacgatgagactgccctgactgagacgctgggccaaagccgtttggtgtttggcgagtacttggaaaacggcatagccggcttcaaaacccagtaaatacaacccgaagacgaggtacatgccgatgcttccccaataaaaataggcaaaaaagctgttgaacagtagaacaaaactaattaagaagccccgatttaacaggcgcatcttgtaatcggggagtacatggcgatcgctatacaactctattgagaagacgatcaaagcgatggcaataatggttaacgttacccaacttgggagatttaaatgtgctttgcgtaaagtggttaatacggcgatgccggcaaagccaatcaaggacagtaaccagcgccagatgtgatgtagtcgatgaatcttgtgcgaacgatgttggtagaaatcgttgacgaagttccccagtaagacaccaccggggatggcgccgagataaagtaaggccagaacactgaaagtcagggtataactgaggcctaaggacaaatcgattgccagcatgatgcctaataaggcaaagaccaaccagtagagacgtttcattttgaagctggtggtatgggtcaggtgaagcttgatcgtcaaaaagtagggccagatcgtagcagcgctgtatccccataagaggctcccgatgatgagccaaccgacactagaactgagggcaaatagcaagctccccagtgcacctaaaatcagggtgaccagtagatacgtcgtcgaattaagatttaaccgcttggtgtaaaagatgctggctgctcgtgaaatataaaaggcgactagagcaatcagaaacgtggtactttgggtttgctgatagcgcaacaaaattaaaatgtagggcaacatgatccccacgttagctagaaagtttagtgtaccaatagaaaaatcaataccggtttgccggaaacgggccaccgtcatcagctcctcaaaattatttagtcctagtatagcaaattccctggatgggatgcttaatgtagggtcataaggtcacctaaataagccatgtcgccagaacttgaagttttgacaacatggcttatttaccagtaataacgaatgaattaacgttccgaagaggtcttaggcgttaatcgcttttcaataaaggataacaccaaatcggtaatgatggccatcaaggcggttggtaacgcccccgctaagataatagctccaccatcagttgcgttagttccccggacaatgatgtcaccaagaccaccagaaccgatgaaggaaccgataacggtaatcccgataccgataactaaggcgttacgaatcccggcgataatgacggataaggaaagggggagccgaatggttttcatgatttgaaagccggtcatccccatcccctttccggcatctaagacgtcgcggtcaacgctcaacatcccggtgtaggtatttttaataatcgggaggagtgagtaaagaaagaccgtgacgataaccgtcgtttggcccaatcccagtcctagcatcaagatcgatagcatggctaacgaggggatagtttgaatcacattggcaatcccgataatgacgggggataaccgccgatattgggagatccaaatgcctaatggaatcccgacaattgcacccaacagcaccccataaatcgaaacgaggaacgtttggttaaattgactgagcacgtacatcccgttgtggctaaagtaatagaccaactggctaaacagacccatgtctttcatgttagttgttccctccttcgaagtagtggtgttgtttcaaataattcatggcaactgtctgcggttcttcaagttcgtcgtcaaccttgtagttcagttcctgcatggtcttcaacgagatcttaccctcgagtttttctaagacgggtttcagttccggatgctttttcaaaatggcgttagtggccactggactggcatcgtatggtgggaagaaatgcttatcatccttcagtaacttcagatgataactggcaacccgaccatcagtggagtagccaagaatggcatccattttattagccgataaggcatcatagagcagtccagtctgcatcggataaacggtgccaaagctataaccatacattttttggaacgatggatacccgtcgccttggcggttttgccaaatttggtcgatgccgaccttcatcttaggcgctaattttttcatatcactgacggtctttaagtgatgctgcttggcatacttttgggtgaccatccacgcgtaagtatccgcgaagccatacgtcttaaagtaggtcatgtgataccgatcttgaaaccctttcgtcaccgttgccttaactttggccgggtctcgttcgaatttctcgttaagaatcgtggtaaggtcggtcccatagaaacgaatggcggaaatatcggcgttgccattctttaacgcgttaaaactaacatttccggacccgaggttattgatgatcgatgtttttaagtttgtgtcatgttcaatcatgcccgcaatcatataggccatgatttgttgctcagtcgtattttgcgaggcaattcgtattgtatcattacctgaaccagctagacctggtaaggaacagccacccagtggtaagaggatgacagcggccaaaagtccagcgagccattttcgtaagtgtttgcgcataacgagcctcctatcgtaattgccgtggtgtcacggctgtttccagtttacccaataagtaatcgacgattagtgccaacaggataaccggaattgacccgcccaagattaagtcggaacggtagaggttcaaaccattgaaaatgaagtcacctaggccaccagcaccgatataagatgccaacgttgcccaagcaatcacataggttgctgagagccgaataccggccataatcacgggagctgctaagggaatttcggctcgcagcatcatttgccaccaagtcatgcccatgcctttagcggcatcacgaacggttggtgagaccccttgcatccccaaataggtgttccgcaagatgggaagtagtgagtagatgaatagggcgacgatggctggtgtcgatccaatcccaaagatgggaatcatcatggctaataatgccatggcaggaatcgtttgaaggacaccagctaacgtaatcacaaaattcgcgccgtgtttcattcgcgtcagtaaaattcccagcggaacggctacgataacgcccagagcgagtgccgctgccgaaatgtagagatgttggccggtcttactgatcagctgtgtcccataagtcgctagaaaatgtatcatttctcggtgtcgcccccttcatgagtggctgctgcgtgaatatcagcattgattggggaagcgggagtttcatcagcttctggtgctccacgcaaagcgtcatacacgatatcaaccaatgcggtccgtgtgacgatcccgacgagccgtttttgtttatcaacgactggaacgtttttaaccccctgtttgagaatccgatcaacggtatcaccgattagcgagtcagctttgacataaaagaccttttcgttcgtcagctcactgattggcgtatgtggatcagtcgtccggttaatatcgtctaagtcaatgtagccttgtaagaccccattggcatctgtaaccagcaaggtatccactcgacgatcatgcatgacgtcaatggcatcgtctaacgtcttatccggcgtaatagcaacagggttctttaacatgatttgactaacggacaggatatttggttgggcgcgaatcaagcgttcttcaccaatcaagttcgtaacgaattcgttggccgggtgacgcaagatgttttcgggcgtatccacttgaacctgcttaccttgactcataatgaccaccttggttgctaggtggagggcttcatccatatcatgcgtcacaaagataaaggttttacccaagtcctcttgtaaatgtttgactaaatcctgtaatgattcccgcgtgattgggtccaaggcaccaaagggttcatccattagaatgatttcttggtcagcggccaaggcacgtacgaccccaatccgttgttgttgcccaccggataattcaccagggtagcgttgcagcatctcatcggggagttgagccagttcaatcattttatgggcttgtttagcccgtttttctttagaccagcccagcaatttagggacgatttcaatattttcttgaatcgtcatgtggggcattaacccgatattttgaatgacataaccgattgaacgacggagcttgacggggtccatcttcgagatgtccttgtcgttgatcttaatggtaccagaagtttggttgagcatacggttaatcatccgcatggtcgtggtcttcccggaaccagaggtcccaataaaagcaataaattcaccgcggtcgacttcaaggttgaagtcgtcaacggcaactttaccgttgggatattctttacgtagatgttccattgaaagtagcatagattaacctcctgagtaatgatgttactgaaccggcaaagtgccggaaataaaaagacgatcggtgtgccgggagcacacgtcagagcgggagcaacctggggaccggtcgtatttgatttttcggcttacgattaaacctattgtacacgatttaccagtaatttccaaacggatacaattcctggtgttgataatcatgtcatgtaaatgactgaacaacccggtcaaaacgctgtacctatcggcttgggtggcgatagtcaaaatctgttttttgataagaaaattcttattaagaggagtggattttttacccaaaaaagggttgccttcgacctgctcgaaccctgtatactccataacatcaacaaaaccgaaagggagttacgatcttgaaacgaatcctgcttgctggcgcaatggatgcgaccagccaaacctttgtccgacaactaagtgaaaatgatcagcttcagctgacggtgtacacccctagtgcagtgaccctcccccaaacggtaaccgcattaactgaggaaacactcgacgaaggtggtttgacggctgctatgatggatcaagacatcgtggtggctttgatcccaaccattaagttagctaatactgtgacgacattaattacggccgctcaggctaccggaacgtcacaggtgattgtgagtcggaccgatgacattgttgaattgccgggacaaatccgcgatgcccggcgccgattaatgacggcgcatttaaacttcgacttggttgatggacttgctggcgtaagcacgttgctggcggttaatccagcaccaacggcggtttttgaccccgaaacgtcttttcccattgaacaaatgatgagttaaagaaaacgcgttgcccatcaggacaacgcgtttttttatgcggcttgggttttagagcggcgaatttcaggaactagccaccaaaccagtaacaggttaatcagcatgagcagagcggttgagataaagacggcgttgtaattaaagacaccggcaatccaaccacccagcagtgaccccagcatattaccgattgactgaaaggactgattccaactgaagaccgtcgacgtcagttcgactggcgagtttttggtcagtagggtttggatttctgggaacaatgccccgtcagagatgccaatcatgaagcgcagaatccctaacatccagacgctggtgacaaagccctgcggtaaatacatgagaaaggcaaagacgtagccgaagatcaagacttttcccgagccgtgttgatcgccgtaacgacctaatcggggtgaggcaaaaatgtttgaaatccccggtaatgcggcaattatcccagcaactaccgtaatgggaccgatgttatgcatgagttccttgacgtacaagctaataatgggggagatggagatattcccaaattgaacaatgagcgttgaggataacaagaccagaattaatttgggattagggaaggctgccagtggattatgacttttagccgccccaggttgcttgacgacgggcttgaactgttcttcaacgaagacccaacttaaaataaacgttgagaagagcaataaggctgtgataaaaaaggtcaatcgaatggagaagacctgggccaaaaccccaccgatgaccggacctagtagcatgccactcgtgacaccggtcattaatgtgctgagggaagccccactgtgtttacggggtgtttgcgaggcgactaacgcctgggcattagaaatgaatccggcaaagacaccctgtaatgcccgtaaggccactaactgccaaacgctggtggcaaagcccattaaggccatggctacggccgtacctaatgaagcgcgcattaacatgagcttacgaccattgcgatcggcaaccattccccaaaggggggaagcaatggcactgacaaagaagtcagcagcgtacacgaggccactatacatggtgacttgtgacttggtgtaatcgccaagactactaatatataacgataaaaatggcatgatctcactaaatgccatgccggcaacgaacgtacagaaccagagaacccgcagattacgccgccaaggcccgcgctctctttcggcttcgtccaaaatatgtcaactcctataacttgaattaattgatcaggttaccctaggtaacgcgaaccaattgtgtcttatccgtaatggtaactttactaagatacgcccatagccgcggaaggtcaacgttaacgactcatttgtatgcgctcgcaatggtttaaataaggggctaccactcaatgaaattaagtttaggttacggttgaaaataaaaaacgcctagggccagagtcctagacgtttcgggtttccaaatagtgattaattcaatgtggatcaactaatggtcgttcatgccactcattagagactagtcttgtgggaaatacgcaccatcggcaatcttttctaagagtcgccgcgatgggatgaagaaggccgccccagtaataggggtgctgaagtccagtaggcgatcgctttggctaaacatgttggttaacatgcgttgcgtcacggtaaagtgccgtgcgtagccaataaagtaagttccaacgatccctttacccggttcagcgtagggcacattcatgcggacaatcttgtgttcaatatcaccatcgttgtcttgcgaggcaatgttatgggcattcggtagcttttcgtcatcgtctagttcccgatcactgaatttgtggcgaccaatcgccttttcttgatcctcggtgtgcaggccattccacgcgtccatattgtgggtgtacttctgagcaaaggcgtaagaaccattaataaattcaggatcctcatcgccgatcaatgcgtactgcgtggcatcctgaccagcgggattttcggttccatcgatgaagccgatgattgctcggccctcaaaataccggaaccccggtgtttcatcgacaacggtggtccaatcacgtaagaactcacgggcttgatcgagcacttcgtagacgacggccatcgttttggcccggacgtgtaggaataggtcagccggagttgccggtgcgctgtatttaggtccggttacgccggtgaaatcaacgagttctttcggtcggttggctgtaggaaaaagaagccgccaagccgttgcgccaataccgaaagcaacttttaaatcagcatctggatagcgaattgccatactacgctcaattgcggccaaacggtcggcaaattcggccaatgcttcacggtcgcctgataggtcatcacggttaattagatacgtggtaaacatgatattatcgccggcgtcacggtagacatcttgcgcgtcagctggattgattgacataagaacatccccctaattctaataatcgattttagtatagcatgatctcagcgttagacggtgaataagttatcgagtgataatggttacgaaataatgatacataaaaagagcctaagctatagcttaagctcaaagatttaagcctgttcaaactgatggatgcccgccgccagacgattcaagccgtcttgtaagcgagctgggggacaagccacattgatacggacgaagtcgtgaccgtcaccgccgtagaccgcaccggcagagatgaacaagccggttgtttgccgaattgccgagcacagggcctgagtatcatgggtgacatcgcgacagtcaatccagaccagataggtggcgtgaccagcaatcacgtgtagctctggtagttgttgccgtacgaacgtcgtgagagtctgcttattagccgtaattgttgcgtttaattcatgaacccactgtgagccagttgtataggccgcaatcgagccagggatggcaaaagcgttgggttccgccagttcgtcggtattgatcccccggtcgacttggttgcgtaagttctcgttgggaatgatcagagtcgcagcgtgtaaggcagcgacattaaaggtcttgctaggagataccgccgtcacactaagattagccgccaagtcacttacagcggcaaatggcgtatagccatgaccgtcatccgtgatgtcaccgtgaatctcatcactaaagacggtgacgtgatgggtggccgccagttccgcgatatgttgcagatccgccgatgtccagaccttaccgactggattgtgggggttacagaggatcatcatggtcgtgaggggttctgccatctttgccgcgagatcgtcccagtcaatagtataggcgcccgcgtgaaattgcaggtcactagataagacgtgccgaccgttattgacgatcgaattatagaagatattgtagacgggcgcttgcaccaagacgttatcgccgacgtgactcaaacggcggacagctgaagagagtgcaggcacaacaccagtcacaaaacgcatccaatccgtattaggggcccagttatgttccgtggcgtaccagtgttgtacggcttcaaagtaagctgcgggaacctcttcgtaaccaaagatgccgccgtccgccttttgtttgatagcgctgatgatgccgggggcggtccggaagtccatatctgctacccacatggggagctcgttgtcttggacgtcccacttaactgagtcagtatggcgccggtcgatcatttctgaaaaatcatactgcattacggtaatgcctccttggtagttgtaatggtggtacggtgttcgtcaatggcgggatcatcgaagattacctgaccaattgcgggtgcggtgatttggccgttaaccggatttttcacgctatcaattgccgtattgatggtggcgtcgatatccgtgcagtactcgaaggccaagtcggtattgataagcgaacagtttttgagcgtgagatgatccacgtaacacaggccttgatcgctttcaagccaacagttgacgaaggtaatgttcttggtgttccacgctaaatactcgccgataatggtggaatcataaacagtgacgttgtcacaattccagaaggcgtcatgggtaattaacgtagaatgatgaacctcgacatttttactaccgtcaaaggcatagttcccggtgatttttaggtgatcagcatagacattttcactattcatgccgaagtaatcacccgttgccgtcacgttacgcaaatcaacgtcttggcaccaccaaagggtttcaccagcgtccgcaaaagttacatcgtccagctggagatgactagcatgccgaaaggttttagtggcccgaatcaagctgtgctgcatggtgagatcgtctgtgtaccaaataccagcgtgagcgtctggctgccacgtcgtgtgcgttagattagcgcgatgggcgtaccataacgggtacttccatttgaagatagtgtgatcaatggcgacattacgcgcgtgctttaatggggattcaccatcgacgaaggtgctattggtaatgtggagatcgtgaccttgaaacaaggcccgttcgccagttaaagtttgttgattaatttctgtagtcaagtgtgttgtcgactccttttatccgttgaagttactagaattggtgaggcgtactcgctcactagtaactagtctagtcccttcgagtggctttaaggcaagtcatttagttaaaaattttaaatttgacgtcgataccagtagaaacgatcgacaatcagcaggccactgagccacataccaccgaataacaaccagaatttaccatttgataagacgggggccacactttgttgttgaacacggaactgaagatactgattggcgtggccgatgattgcttggggtaataaacgataggtcgctggcgcggtgacgagctgtagtggttgggtgctacgattggtcacacttaacgtgtaatgccctgccatttggggtgggaagttccaagttaaacgtggtcgttgtccccgcgattgccagaccactttaccgtgagcatcacgtaagattaaccggcccgtcagtcgtcgctgcccctgattaatgatgatttgatcgaaaggaagactggcagtaaagggttgtgtcagtgtgtgatggggggcaaccgtcaatcggtgattttggtaataccgtccctcattttgactaacgacactgaccggttcgctgttagaatgcaccatcaaaccggcgttttgccacgccgcaatgcctaagagcaccgtgaaggcagcaccaacacctaggggtaaccagcgtgatcgtaatgaataacgcaagacatttaccggttgacgataaccggcggccgtaccagcgagtagcaaggggagtagtgggagtgcatagcgttcttcagcctcccagaagataatgtgaaagcaggctaagccaatgaaagccaagccccccaatagataggtagcggttaaatgacatcgtcgaagctgctgaattccccagcctaggttgaccaagaggagggttagataggtgatttgacaccagctggcaagaaaccaatcactggtggctcggtgctggcgataccagttaggcgcccggtcaaaggcgggattaacttgaaaactatcaaaggtcccattggctaaaaagagtcgggccttttgatagaggtgctcgctaatgccagctggtcctaacgtgtccagccggtgcgttagagtggttttagcccacgcttgtttagcagattgtgttggctgttggcgaatgtgcgtgacatctggccgattgtattgccccgaatagtcgggattccagctcatggcgacccagctaagtgccggtaaggcctggtcggggttaaggcgataaccgttggcccgctgccaattgtgagttagtccggtgccagcaattaaggttgctagcaagatgagggtgaataggcaccgggtgacactttgatgaggcgcctgatttggtcggagccacagagtaagcaaggtggcaatcaataggacgaccagattagcttttaacaagtaggcggcgactaaaaagagactgagtaacagactacggcccacgatttgttgccaggtttcagcttgctgaagccgataaaatgtcacgacggcgagcatgattaaaggcaagacgtagacatcagtgtaggtattgagcgcatacgcatagagtggaacggccgtgatgacgagacttaagaagagattggcacgggcaggattatgttggcgcaagacgtgccacacagcgactagaccacagtccaaccagataaactgaatcagattaagggttacgccagttccgagatgcatgagggtacttaataggagcgtaaaggtgacattgttggggtacgtatagaagtaggctgcccagtgatggctaccctgtagcaaatccaaggcctgttggtgaacaaagtacagatcagctcggggagcggccacccatgcggtggccacccagagttgaatgagcaacaatagcacccacagcccgccggttacccaccagtcaaaccgttttggtaagcgatggaggtagcgaaataacagtccgatgccccctaaatacaggccactggcgatgattaatgcgagcggtttcaaccaatcatgatctacgcgaatggtgactggaaataaggctagtaaccaagttagcagtaacccaaggctaatcagcccccctaagccaaccgttaatgtgtgtcgaattttcatgaatagactccttaataaatgtggtggtcttcacttggacttatcttatctgaatgcgatgaggtaaatgccggtgagtaggtatccgtctggatgatgaaccgcggtcggtgtttaacttccgtaaacgtgcgaccaatatattcaccgatcatgctgatcgcaaccagctggaaccctcccagaagccagagtgaggccataatggatgaccacccggttacaaccgtcccataaaggtgactgatcaagatccagagtaacacgaacagtgatccgccacaaatggtcaaaccaacgtatagtaccgcgcgaatgggcgcaattgaaaatgaaagaatgccatctaacgcaaaacgaagcatcttacgcaagggatatttagagacaccagcttgacgaggttggcgtttgtaaaataacttcgtggcaggaaagcctaattgcgggatgagcccccgaataaaggggcgactttcttggcaacgcatgagctcggtgacgacgcgatgagtcaacaaccgaaagtcagaatggttgggaatcaagttcacccctagttttcccattaaccagtagaagctttgggcagtggttcgtttgaaccaagtatccgtggagcggtcgttgcggacgccgtagacgatgtcataaccgtcttgcgcttgggcaatcatggctggaataatggttgggtcatcttgaagatcggcatcaatagtgataatgagatctgaatactgattggcgacttgcatgccggccatcagcgctgcctcctgaccataattgcgactgaactgtaatccggtgaagagtggatcttggtggtggagctgggtgatgagtgcccaggtctggtcttgactaccatcgtccacaaatagaagtttactgtcagtggtgatttgctgattgtcgattaggtgttgaagtaatgtttgcaagataggcgcgctattaggcaacaccggttcttcgttgtagcacggcacaacgattgtgagccgtggtagttgattgtttttcatgataacgacctccccataagtagagcatcctgaaattcccctaactattatcataggccgatctaacagatgtgcataaatcatgtatcaaacttaagggattctttcgggagattaactttgcttgatctaacggctctttttatgtcattaagatccagttattagtcggtttgagcaattctcatcaatgaaatgggtcacctgtatcacaaggccaaagggactagctgatgaacttttagactgccgtaagatgttagttattgttgatttaacaggcattccattataaatataactgtaaaatccggtaactgaactgcaatcgccttgttactgaatgcacacttaaaagggctatggtaaggaaggtttatgaagcgaggtgaatcaaaccggaggatgagaccggtgctgggggctaatcagggcatcgcaagtgagtaggggatcatcaatttacgaagaggaagtgccaatcagatgttgcatcaacaacagtgggccaaacgattaacccaagcagtggttgccgcaagtgcgcttatcggtcttgcgtggggtagccagtcagtggtccatgcaagcacccttgccattccagatatttctgaatggcaaggtaagttaacgtcaagtcaggtagccaacttgaagagtcaagtttcttttgtgattaaccggcggcagtacggatcgtcgtaccaagatttatatgcgactaataatacggcgctttacgtgaaatatgggattccgtttggtgaatatgactatgcacgcttcacgagtgccgccagcgctaaggcggaggccaaagacttttacaatcggtctaataaaaatgcgcaattctacgttctggattttgaagaaaatgacgtcacttcagggaccactaacgccgctgttaaggcgtggtatgaggaaatgagtgctttaacgagtaagaagttaatcttctattcctaccaatcatttgcgacaagttatgccaatacggcgcgccagaactttgatgcgcagtggattgcgaactattctacgacgcccaccatttcctatgcgctttggcaatatacagataataactatctatcagcattaggtgagtatacggataatagtcaagcagtgacgtcagttcatcctatttcttggtggatggacagtgtgacaacggcattatcacacgtcacttacgcatacagtagttataaggctggacaacatatctacctacataaaggggcaactaaatatgtggatggtacagcaatctcgactgcggatcggcagaaattttatgccatttccaaagtgaagagtttgacccaatctaaatcaaagcaggcattgtatatcagttcactgggcaaatgggttttgtcacaggatgcgaccggcttttgggttggtcagcacggctcatatacgctacgtcaaaaattaaatatttactcgaacgcagcattgacgaagaaaacaggaagtagctatgcttcaggcactactgtggcaggaacggtcgttaaggcgccaagcggtaagtcttatcgtatcaagaccagtaaggggtatatttctgctaatacgcagtactcgaatcatgcttactatgaatctctaggctcggcgaagaccattacaaccaagaaaaaggtgtatgaatatagcaaatcaatattcaagcaagctaatcgggcctcggcggtgactaagggaaccaaattgacggttacggccgttaagaaacggtcgacagggtctcgctactttgtcttgagtaatggcaaatatgttacggctttgcaaagctatgttaccgaatagggaggttaaaccatgcaacgaaaaacaaaaatcgtgacggcagtgactgccgctctagcgatgttaacattgggatcggggacaatcttacagattcatgcggctaacgatgtcagctcagttgggcagacggctgcaccgaccaccgcgacggccgctggcactaaattgacggcgacacgtgccagcggtaatcagcagaattatcgcgtggcctatacaggaacccgtgatcaatcagcaacgtttcaaaagaaaacgtatgggtcaactagtaccgccgctagtcaggtggccaacgttggtcacacaaatggtgctacggttaaattgaatagtgcgaccaccgcagttgttcagggtaccatgggccacacctacgtgcactggaacaagggtgattggtcagtcacggcagttacgaataacgcggatacgactggcaccccggcgcaatttgccaagcaagtcaatcgtcaattgacgcgtgcgagcttaccgagtcaggctaaaactggcgcgattacggtttacagtcaagatgacgacgatcagacgaactcagtgacgtggcaacagggcaaacaggtctatcaggtcagtggtacgacggctgcggccaccgttaaggttgcacagaatgcggataactagttgagagaatgcagttaggctaggcgacttaactgaaataggtgttcgtgattgtttgctggtcactttttggcggcaaggctgagtctgggacaaaagtctcaggctctttgtgcgtttctgactagctgacgtcgaaacgggtaccagctagtcgtcagttgtcccactcttttttgtaatctcccctagtcagaaacagttgggagccgtaaactaagacttagtgactaattcttgagtcgtgttggaaaaccgatacttatcaagaggagaaagtgatcaattgggaggcgtcgctgtgaagaacttgcgtcaaccagaatcaggcttttcctggttctatcaacggtttttgaataaccacattacgattctgctattaaatatttttctgttattgttagtgttaaacgaactaatgcaaaatgcgtggcttttagccccggtctggcaatttattgggatcgccatgccggctgtcgtggtggccggtattctcttctatgtattggatcctttggtacacttgatggaacggcggttacatttacgacagggcctcgccattgcgatcgcaatgatcgcaaccgcggcaattattgtcattatttttctcaatctgattccctttctaaccaagcagacgactgggatcatttcagcgttaccgcagtttgccaatgatatgctgcataacttgaatcacttgaatcagcagcatcactggctatcgaacaagaatttggcggatattaatgagcgtgtgtcaacgtatttctctaaacgggggttaaacttgctaacgggaacgttgagttcactgggtaatgtggtcaccacagttagtgactggattattacgattatcacggccccgctagtcttgttcttcatgttaaaggatggaacgcggtttccacattacatcagtcaagtcgtaccaaccgcctatcgcagtcgattcgtggtcatgttagaccagatgaatgtgaaggtgagttcctatgtgcgtggtcaattaacggttgccctatgtgtgttgattatcttcacaactggttactcaattattggcctacggtatgcgctgttaattggtttgctagcgggaccattgaatttgattccgtactttggttcggcgatcgccttagtcccagcattaatcatgggggttgtgaccagtccatcgatgttgttgggcgttgtgattgtttatctgattgaatgggtcttagaaacacaagtcttgtcaccgctgattatgggaaatagtctggcgatgcacccgattaccattgtttttgtcctgctggctgggggcaagatgttcgggttagtcggggttattttcggtgtacccggctttgctgttcttaaggtcttagcaacaaccgcttttcagtggtaccaggaatattcggcactgtatccggatgttttaccgccggataagttgtctcagccttaacggtttattaagcgagttcaaaaatttaaaatggcgctaccctttgggcggcgccattttttacgtggatggagaaaaagacgagtggtctgaaatgatgaactttaagtttacgacaagccgggtttggcataatcgtttacatgttatgaaatggaggcgaccctaatgaattttttcaaacgggcctggttaaatgtatgggcgaagaaaggccgatcaattctgttgattttggtctcatcggccatcctaatgtttgtcttgaccggtctactgattcgcagtgcagcggttaaggctaccaatcaagccaaggaagaggttggggcaactgtgacgctgtcagccaatcgacaggcggcatttaagaagatgcaaagcagtagttcgagtagcaagtctagtcggccaaagctaacgttgacgccagtgaagttgagcgatgcgacgaagattgctaagctcagcaatatcagtagttacaacgttacgagtagtacctcagttaatgcctcatcctatgatacggtgtcgaccagtagtgggatgggtggcaacagtagcagtggcggtcctggtggtggcatgaaatcctcgaccagttcaggtgacacccagatcgatggggtcacggcaacgagcctaactagcgtctttagtgatagccaaagtaagattaccaagggtcgtgggattaccaccgccgataagaacacgaatcatgtagtggttgaaaaggaattagcgagtcaaaatgacttatccgttggtgatacgataaccgttaagaaaactacgggtagcaagtctaaagtgaaactgaaaattgtcgggatttataaagcaagcgctactagttcgagtagcagtccgatgagtacggatacgtcaaatacaatgtacacctcttacacgttggccaatactttcaaaggtaataagtacgctgggacggcggattctgtgacctttaacgtgaagaatccagcgaaagtcagcagtgtgaaaacagctggcaaaaagctaattaataccagtaagtatgccctaagtacggatgactctagctatcaaacagtcaaggcctcaatggataacgtggaaagctttgccaataagattgtttggttagtcgcgattgctggaacgattatcttggccttgattgtcattttgatgatccgagaacgccgatttgaaatcggggtgttgctgtctcttggagaagcgcgctggaagattatcgcccaattctttacggaaatgctgatggtgattgtgattgccgtcgcgattgcgggcgccggtgggaaatttgtcggtgatcaattagggtcgcaactggtttcgcaaagtaccacgacgacgcagacgtcaaccagcagttcaacgggacaacccggcggtggcggtcaacctggcggaagcggcagtggcatgaagggtggcaacggtggcccaggtaacgtgggacaatctagcagcgccacgaagcaggccgatgcagatctcaatatcagtgtcagtgcggttgatttggccgaactgggtggctttggcttagccattacattcctgtcaattatgatcgcttcgggtggtattttacggctagaaccaaagaaggtacttatttcttaaggaggcacgcacatgttaaaaactgaaggtctaggctattggtatcaggataaagaccaaccgttatttcaagacattaacttagagttttatatcgggcagtcctacgccattcttggtcattccggaaccgggaaaacaacgtttctgtcgttgattgccggactggataaacccaaggaaggggacatcttgttaggagatcggtctttaaaaaagattggcctgactaactatcggcggaaagatgtttcgattgtctttcaagcctataacctctttacctacatgtcaccgttaaataatttaatgacggcgatggcgattacaggcgctaaacatgccggtgacaaggtttacgcaaagcaaattttaaatgacttcggtattagtgaagaattagccttgcgtaacgtgcaacacctttccggtgggcaacagcaacgggtcgcaattgctcgcaccatggcatgtgacgcccagttggtggttgctgacgagccaactggaaacctagacgaagacaataccagagacgtgattgcccaatttcaaaagattgcccatgaacagcaaaagtgtgtgattattgtgacccacgaaccagatgtggccgatcaatgtgatcaccaattccgtttggaaaataagcagtttacgcaattggcttagtctatcgataaaaagggttagtctccttcagctctgaggggactaacccttttgtgatgtcgggctgcgagtcgcttatggttttgtctcctattaggactttgcggcgctttttcaggtggaaactagattttttgggaaatcagccgacaaacgcttaaaaacttgttacaattgtatgcgaatacaatcgcgtaaaaccgctaggacaaccggttgcgatttgagacgaaaggacgacaatcatggcggacacacagtggtggcaacacgcagttggataccaaatttatccacggagcttttttgacagtaaccacgacggtgtgggcgatctgccagggattttaactaaaattgattatttacagtcactcggaattgatttcgtctggctgtcagcgttttacccctctggaaatgtggatagtggatatgacgttacgaattatcgcgatgtggcatcccaatatggaacactagcggactttgatcggttagtgacagcctttcacgaggcggggattaaggtggtcattgatctggcgttgaatcatacctcagatcaacatccgtggttccaagcggctttagccgatccgcagggtccttatcgtgattactatctatggcaaccggcaaccgcaaccgtccagccaaacaattggcaatctgtttttggcgattcggcgtggacttatgtggctgatcaacaggccgcttatctccacacctttgcggctgaacagcctgacttaaattggagaaacccagccgttcgtcatgaaatggtacagattatacagtggtgggctgatcgtggtgttgatgggtttcgtttcgctggtgttacacatcttaagaagcgcacggattttgctgatgtgacgccagctaccgcgtattacgaagatgtggcggatacggtcacgttactagcggatttaaaacccgtattggtgaaaaatcacttattggccatcggtgaggccgggggaattgaccccagtaccgcacaacgctggctagatccggcaaccggtttttttgacttgctgttagaatttgaccatgttcatttctgggaacaggccacgcctaagctcccagttgcggcgctacgggcgactttatctaggtggcagcaaagtcttgaaggaaccgggtggaatacactgtttattgaaaatcatgatctcccgcgggccgtttcttattatggtaacgatcaaggtgagtatcgacgccgatcggctaaagcgttgggaatgttgtacctattgatgaaagggacaccgttcatttaccaaggtcaggaattaggcttacctaatgctggctttaccaaaattgcggattatcgtgatttagatagccggcgttattatcagcgacaacgtgctgccggtgtggctgagccacagattctttcacaattggcattgcggagccgggataacgcgcggacgccaatgccgtggacacatcagcagtatggcggcttttccgatcatgagccctggctccagatggcccctggtgtagcgcaaattaatgttgagcgtgaaagtcacgatccacatgcggtacttccattctatcagcagctcattcggataaaaaaatcagtaccagcactgcgatcaggacgatatgaactgatagatacaggagataatcagctgtacgtctatcgtcgtaccctgaatggggataactggttggtcgtggtcaatatgagtgatcagccagcaactactcaaaattttgacttaacaactagcgagttgattttaaccaacctaccagttgatgcggcttctgatgataggcagatccagccttgggaggcccgattatatcattggcggcgattagaataggctgaaatcggggctattcatcggtggcctgaaatgtctacggggtgagaaattttctctccccatttttataccgtaaacttttcttaaataaacgttttggcttgcattttatacggttcttcattattattaaatgtatagatatttctacggggtcaacgattttgcatattgctaaatgtgttaattatcttgccggttagtaaatgataaggatatgatgagaatgaagagtagggacgtacatgcggagagtttttttgagtcctttatggaacttaagcgtgaattagaaaaggcagcaactcggtttcagcgaacaatgggaatttcagtggatcaatatgccattctccacaacatcttagaaaatcccggtaagttaacgtccgcaacagttgcagatagtcgtgggatttctcgagcggcggtgtcgcggggaatttcccaactgattcggcgcggatacgtggaacagagttataagagtactgatcgacgggttcggccgttatcgttgacgacaagtggcaaacaactggaaattgattgtcatgaggcgttagaaaaagccgcacgagtaatgagtacagcacaattagctactgatcatgagaccatcacagtaggtgaattgacgcaaatgttagccgcgttgaccaccaaagatgatactgaggtcgattaacaattgagattagacagaaaagaggtgtgcccgcgggtacacctctttttgctttgccgccaaaataaataaagtgtgcggatatatgcgccagcaacacgttgtttcacgactggcttaattgaattgaaagcgctttatgtgcaatttttcggtgtgaaacaatattctacaatggcggcaatgtcagtaaaaatcatgctataatcatttccgttgtccaaaaaggacaccacaatatattgtgttatagactcgcttatcgataagctcgtactaaatatagaaaaataaaattaagggagtttatcgcaatgacccattatctacaatttttgtcccaccaacttaaagggtggccgcagcaaaactattatctttttttcttcagtctgggttgtcaggtgatgacattagttaatgctcccatcacatggttgacatgtttaacgtttgtgggcacgactttaggtgttttgtgcgtgttagccattaatgctgccaagtcagtcaatggctggcttggcgtcatatctgcaatttgttttgtggtgaccggcttggctgctaaaaattatttgagtattttcgaacaaattgcctatgtgatcaccttggatattccagtattacttagtgcgagctggaatgtaaatatggctgctaagattcgtcgattcactggtcggagttgggttatagcggtatcggcgactttgataatttatctggtatccggctgggccattggcacgtttacagatgatccacggccatgggttgacgcgatcagttttgccattagtttaaccgcaggggttatttgtttcttacggtttaacaatcaatatgtgtggtggattgcttctggtttagcgcaaatggttttatggtttatttcgttccgccaaggctccgcgacgctagctatgttcattaatagctcgatatatttgatgaatgatgtgctggctttcaccatttcgccttggtacaatgccaaagaacggcagcgattgattaagcaagaagcgatctatgcgactgaggttgctcacgtgcactaggccaaatattttcaacattatcgggcgaatttcattcgtagacgtggtacacttaatctactaatgaagagaagaggaacgtccatgattgttgaacataagattggggccggggatcaagacctcatctgggtcatggcgatgattgaagaagactcagaccgggaagacttgcaggttaagtacggactgactgatgagattttgacctatgtaaccgatgaaaacgagcgatcacactatgatcgggatgagtatttaaatacgcaattgtttattctgcacgtaccggtcgttgttgatcaggtcgcacaacgttatattacacggccggtggctttcttgttgaaggggaaccgtgtattttcaattacgacgaagcggacccagtgggtgaatcagacgttgagcgagcggatgaaattaacgcagatttcagacaccaacgaattcatgttgattggcctatttattttatttgaccaatttattccgccaattcggaaaattaatgcggaacagaatcggttggataagcaactaaatcaagcatcagataataaagatctgattgcattgtccaatctacagcagagtctggcttatttcgtcagcgccacgcggaacaatgcgatgatggtggttaacctcagcagtacgccgttcggcaaacaattgtcagataagaatgcggaacatttggcggatgctgtcattgaagcgcgccagacttccgaaatgacatcgattgaagctgacgtggtcgatcgtatttccaacacatttaataatgttctaaataataacttgaacgatactatgaaatttctcacaatctggtcgttggtgctcacgattccaacgatcattacgggattctatggcatgaacgtgcgcttgccctttgctagtgatgccatttcgtggatttttacggtattgctcatgcttggattaatggggatcgtggcaataatgttacgccatcgccatttttggtaaaagtcagacggttgcggtcgccttttggggtgctgcagtcgtcttttttgatgagatattgaaagcgtgaacaaattcactaacaaaaagtaagtaaaaatactggcattctgatttaaaaggagctatgataacgacaatcaatcattacggggcgcaatagtagtcgtatgtgacccgccatatgaacttaaaggagcgcgattgacatgacaaagatgattgctggacaagccttagttaaagtactggaagcgtgggatattgaccacatttatggaattccgggtggatcgattaatcacaccgtggaaggactttatttggaaaaagagcacatcaactatattcaggtccgtcatgaagaagttggcgcactggcagccgcggctgatgccaagtttacgggaaagatcggtgtggctttcggttcagctgggcctggtgcgacccatctatttaacggcttatacgatgctaagatggatcatgtgccaatgttggccattgtaggccaagttccccaatcaaccatgaacacgaactatttccaggaaatggatgaaacgccaatgtttagtgatgtagcggtttacaaccgaacggcaacaacagcagaacagttgccatatgtcattaatcaagcgattcgggaagcctaccggcaaaagggaccagccgttgtcattattccggaagacttatcggccacagagattgattatgaacccgttaagacgcctaatgtagtggcgaatacttttactcaagttgttgatccgcaagcggttaaggcaacgctggagttactaaaagcggctaaacatccgttaatctatgctggtcgagggttattaggtgcccgggctgaactggttaagttcagtgaacaatttaatattcccgtcattaatacggttcctgcaactggtgtgattccaaccaatcatccgaatgcgttgggaacgtttggccgcttgggctccaagtcaggctttgaggccctacagcacacggatttaatcttattcctcgggtccgaatttcctttcgcccagttctggccaaaagatattaaaattattcaagttaataacagtgcctttgatattggcaaagtggtaccgattgattatgcagtcattagcgatgcgaagagttacttgcaagccatgattgcgactggtgaaacgttacccgaaaccacttggttaaccgctaaccggcaaaataagcaaaactggcaggcgtggttggctcaattggctgctgatgatagtcagggattggcaccagaagccgtcacaaagaagattgctgaactagcaggtcctaaggatacctatggtgttgataccgggaacgtctctgaatgggcggtccggggactaccgatggatcaagaccagcgttttgccatttcgggactctttgccacaatgggttatggcttaccagctgggatggctggcgcgttaagcgttccggatgcccaagcttggtcactatctggtgatgggggctttgcaatggtggcaccggatattattaccgaagcccgttatggcttgccagttatcaacgtggtcttcagtaaccagcggtttggctttatctaccgtgaacaagtggatacgaaacaacacctgtatggggtcgatctaacagatgctgattgggctaaggttgctgaaggcttgggtggtattggcttcaccgttacgaacaaccaagaagtggcccaagtctttgaccagattaaggcgttgcaagcccaaggaaaccgcaagccaattgtggtcaacgcggttattaaaaatgatgaccctattggaacggcctttatgccactcgatccacaactctatggtgaagagacggtcgctgcctatgctaaggaaaatcatattgatcggcagcagcaaccagcattgggagagcttctccgggcacaaggcgacacgctttaaacgttaaagatgaaacaggcgttataaattttaaagagtctaaacagcacttagctaaaagtaaggaggcactctcggattttgagaatgcctccttgcttttgcctgtcacgtttaatcaaaaattaacggtcgctggttgaccgcgttggtagcgctactatcctaaccttagggagcagcgttattttattttaaatcgactcgtgctaaacttcatgaccaagcaaggtcacttaagcaaagaaacgaggcgactcacatgaaatttgactggcgatatgcgtttcattctttttggtttttgatggtactcatggtgttgttgagtttgacaacggctgttgatcaagttcatggcgtgcgaattgcgctaggtgtaattctggggttcctgattgtagatagtttgtggacgtggcagtatccgtacttcaatcggttagaccgtcaaggggtgaccgcgttgattaacttaggtttgtttgtggtgattgcggcctttacgttagctctcaaaacggcgtggtctgcgagtgtttgggggtttatgagtttttggctggctagtattggtgggacgctggatggctacttggcacgacccactaaagtcttggttcaccaaacccgcggtgacttacgcaagaaggctgaaattttgcgaaattccacacattaggtgaaattgtggggagtctgggacaaacgtctcggactctttttgtgtattagcaaacaagaaacgagtcatagcagtcgctataactcgtggtttattaatttttatacggttattcggcggcataagtccaatcgtatgagagaagttggtggaatcgttcaccgattgggacccagagcttggccttggcaatattagtaatcgattcccaaaacaaggggtcatgccgttcttggtcacttaagttaatgttgacgtacttcccagcttccgtttttgcgataacgtagggataaaataccttcgtaatccgggcgggagtaatggtatgaatttgcgggttgtcatcaatcagcatattgaacgcttcctttcacttgatgaattcagtataccggcgaaatgctcagacaaccagtggttttagttaaggattaactgagaaattcttagttttcgttagcgctgggtaaactaatgataaaacaagcaccatgtggcggattatccgtgatggtaattgtccccttactaagccgaacgagctgtgcaacgatggctaagcctaagccactgccttcgatcttattggaacgggattcatcgacgcgataaaagcgttcaaagatatgggggcgatcggcagttgagattcctgggccgtggtcagcaacactgagtgtgacgtgctgggcttgttttgcaaccgtgacgtcaatggattggtcgggagcaccatacttgtgggcattgtcgagcagggctgtcagtacttgatggagtatgtcagtatcggctaagaccattgtcggggttgcgggtccatcataggtgatgggctggtcaatcaacggctgataatgggcgataacggattggaccaggggatcaatatcgacgggatgcaggctgatctccgctcggtctgcccgtgacaagtgtaggaggttttcgatcaagtgttgcatgcgtaatgactcctgatcgataaatcccagcgattcgggaataatttcgggatgttgttttccgcggcgttcaattaatttaaggttaccccgaatcgtggcgatgggggtccggagttcatgggaagcgtctgaaatgaattgacgttcacgttgtagccggccattttgtgcggcgaggagttgattgaagtcgctagccagttgaccaatctccacgggttcacttggctgtggcagttctggctgggtagcttcggaattagccgcggcttgtttggctacctgggctagtgtgagtgtcggggcactcaagcgcttggccagtcggcgaacgtagagtaggccgatcagcaaactgagtccgatcgcgataatcaagacagaaattaagacgtgaaggttgccgattaaaacgtgcatgccgataaacaaggcgtaagtccggctaccagttcttaaagtttccgagaagaacaggccccagcctttaatatagactaaatgggtaaagggaacggaccacgtgttggctttggctagttgttgcgcatgggggagtaatgaagtcgtggtgccgttggcgttcttaatcaacacaaacgtattatgggaatttaggccactgctccggttaatggttagccaatctttaaagttgctcacttgggtcgtctgaagactagcactaagcttggccgcctggtcctgtgcccgcacaagctggtcgatagttaaggtgatactgacggtgatgacgatgatgaccccaatcgttagtaacagactagtgatagaatgacggataatgtcggcataagttcgcggtggggttttagtgctcatgggcctcatcttctttcaggctgtagccaacaccgcgaacggtgtgaaataaatgtggggcggcagctacgtcaattttatttcttaaataaccaatataaacgtcaacaacattttgttggccgagaaagtcgacgccccagacgttatcgagcaactcgtcacgggtgaagacctgaccgggatgctgcatgagaaataacaatagatcgtattcacgctgagtgagttgaatggtgtccccggcacgatcgacttggcgcgtcttggtcactaaggttaaatcacccaaatgataggtttgatcgaggccactttggtgggccgttcgtcgttgaatcacgcgaatacgggctagtagttcttcgatttcaaagggcttagtaatgtagtcatcggcaccattgtcgagaccggtcaccttatcgcccaggtaatctcgagcagtcatcataatgacaggtaactcatcgtgtttgcgaatccggcgtaagacttccatcccatccattttaggcagcatccagtcgagtaaaaccaataataggcgatcttttttctgctgatagatttcccaggcggcagcaccgtcagtggctgttagaacgtcaaagtcttcaaacgttaattctttggctacataactagcgagaccctcttcgtcttcaactaatagaatggtgttcttcatgtaggttgctccttagtgtgacgtgatttgttggcataataccataatttggcaagtgaaaaataagaaattcatagataaagcttaacgtcatttcaagattgtttggcgttgtgatggtataactagattatcgaatgacaacagctaatccaaaatttgaggagtggttaaaatgactaaagtgaaagcaatggtgaccaaaatgatgttaggcgcgatgacggtagcaacgttgatggcaacctccgcaggggcttctgccgcaacagtgacgtctaatgtgacggcaccagaaatggcggtagcaacgacggttaagctggacacacacgctaataccgagattcaaccgactaagattcatttgaagcgggtaactaccaaagccatttctaatcaagtacaaacggccgtagacgcaagtgcgttgaatttggatcaacagcatcgcgatcggcaactaaagtaagcataccgaatcaagcttaacggcaaccaaacagaatagaagctaattgaccagtagtggcgagaccgctactgattttttagttagatttattttagcataatggtagtgctgttaacggactattaaaaatggtaccctcagaaattaactatctgagggtaccatttttcctgtcagtcatacacgtttatatgcgaataagcgactaacgtaaggcctcggcaacaggcgtgttaccattgactagttcaataatttgtttaggttggggatgcttgaccacggcaaccacggcagcggcgacatcacgacgggtgatctttttcgtgtcactggtggcgggatctaatgagatctgaccggttggggcatcgttggttaaagcgcctggacgcaaaatagtgtaatctaagtctgttcggtggcgtaaccactggtcggcatagtatttggcaacgtaatatggtcgaataccggattgattccagaaagcgcgatcgtccgttccgagcgcgctaatgagaatgaagcgtttgatatcagccaattcagtggcgtgcatagccttgacagcgccatccaaatcaatattgagcgtcatgtcatcaccggtactgccaccagagccagcagcaaaaacgaccgtatcaacaccggccatagcgggcaccatatcttcagcggtccctaacagatcaatggtccgtggttgaccaccaagttgcgtgatcgtatcggcttgttcagcgttgcgaataccgccatagacggtttccccagttgctgcgagttgcttaacgatgtgttggccaacttgaccatgggcgccaataattaatgttgtcatccaaaaagcctcctatacaaaaataactttactaacccatacgataacggtttttaaaaataaagtcagctattgtgacttaatcagcctgagacgttgttaaatcggcaattaaattgtgtgcagttgtcttgtgaaaaagattacgatgctttcagactggtttttcacccgataagccgtataatagaagtaaatcatctctagcaattagttcacccactagttccgatggggggagtggtggtgcttagccgaaattgtaaccggttaactggttaaacggttgcgaactaattgaacgtgagaagaactttattagaaaaggggtcgtttattatggcaacgattttagttctcggtggcggttatgcaggcatgcgggccatcaagttcttacagcgggaggttccaagtgacgatcagattattctggtcgacaagacgagcacgcacacggaaaaaaccaatttacacgaggtggccgcaggaacaattgcacctgatcggatcacttatgaaattaatgatgttattggcaagcgggtcacatttattcaagatgaagtgactaatgtggacgtggacagcaagcaggttacactggtcgatcatgatccaatcacgtatgattatctaatcctggcgttaggctttcaatccgaaacctttggcttaaagggtgcggttgaaaatgccttgccaatggatgacttgcagacgtcagagacggtttatcaacatattgaagccaaggctaagggttatgctgaaagtcaagatccgaatgacttaacgatcgcagtgtgtggggccggctttacgggaattgaactgttgggtgaattaagccaatcgttaccaaagctccaaacgcggtacaatacgccggcatttaaagttatctgcttagaaatgggtaagaccattttgccaatgtttgataaatccttggcagattacgccatgaaatttatggcaaagcacaatatcgaaatgaagttaggcgcagccattacggaaatcaaaccgggggcagtggtctacaaggacaagaacacggatgatgaacaggagcatgaagttgctgctaataccattgtctggacggtgggggtcagtggctcacacgtgatggctgattctggttttgaacaacgacgaaaccgggtagtggtcaaggacgatttgagtctagaaggccatccagaagtttacgtgattggtgacgttgccgcagtgatggacccgcaaagtaatcgaccatatccaacgactgcccagattgcactggcttgtggggcgcatgcggccaagaacattggcctgatgttacgtggtcatgagacccgtccatttgtttacaaatccagcggtacggttgcttccttgagcgatcgtgacgggattggtgaaatcttcagtagcaataaaaaggtgcacggttacctagcctcagccttgaagaaggtcattaccgaccgttcactgatggaaagtgcgcacttgagcacgacgttagctaaaggccgtttcgatctgtatcactaaaaaaactaacagaatagaagcaatatcgatacgattaattgtaaagatcagcccctcgaaatcaaacagattttcgaggggctttttggtgtttaattaggaggagatttgtgatggtctttagcaccgatagagggggatactgaactcaataattaatgatggtcgggcagtttataatctgtacacggtcggcaaacaggcttattacgcgtagttgagattaatttacgcttacggtttgattttgttccagtggcggtttaatggtaaaatacagagaaaaaggggggggagcgggatgctacaaaagcaattaacgacgccactagggccagttaccgcgatgtcagatgggctatccttgatgggcctgtggtttaccgatcaaaagtattatggtagcaccttgcctaaactaacggttattagtgaccgaccgatttttacccgggtgcaaacgtggctggatgcctattttgcgggtgatcagccagccattgattttccagtccgtctacagggaacgccgtttcgccaagcggtctggcagcaattacgggaaattccttatggtacggtgctgacttatggtcagttagcgacccaacttagcgagcagttaggccactttgtcgggggccaagctattggcggggcagttggacataatccgattagtctagtgattccctgtcatcgggtagtggcgagcgatggggcattaacggggtatgccggcggcttggaccgtaagcgagcgctgttgcaattagaaggcagcttagcggctggttatgagcaagttccgctggcttaaggaaaaatattaagtttgggaaataataattaattgtgtgcaaaactatggcacaattttggggctaattgtgctataatcaaggctgttcaagggccgataaagacgattatcaacatgcataatcggtcaatgattaaacgagttttttcacaaaaggggtttcttctctcgctgaaacgcgtataattttagtcagcttaggacgttagttaagattactagcttctggggggaaactagtggtttttaacgctaaatatacgatggtgtatgaatgattggaggtatcacgatggctgcatcagaaactaaggagcggattgcggaggccttggcttcgttgctgaaccacaatacgtttgataagatcacggttcgtgaaattgcggacgaggctgaagttcatcgaaagacgttttattactatttcgccgataagtatgaactactggcatttgtatacgagcacttcatagtggagtcacctcgacgcgaacaaccagttgccttgaccttagagaattggcgtccagcagtaattcaattactggaacggatcgctgataattcaaagattttcttaaatgcttacccttatgatgatggggtttggcggcaatcaacgaatgaatttgtggcagcacgattatccattttgcttcacgcaatgccagagtatcgttatttaaaagaagatgtgattgaaacgtcggcagagtttattgctgctggggcgttaggcatcattaataaatgggccaatgataacttcacggcgagtccgcggacggtcttggaccaaattaccaccgctaatcgattattcaatggtattttggaccgttggaagttaagttagtcaaaacgagttgtcaggaaactgacaactttttttgtggtttatttttgccaaaatgcaaccggttgaaaacggttaaataagctagtttcactaattatttgaactaattatcacaaacaaaacggtggtatttgggcgatttgactagtatagtcatgtctgtaaggggcatcttgtgaaactggcgggccccattaaggaggaaataaacgatggcatatcaaacgaccaatccttatacgaatgaagtggtaaagacctatgaaaatgcgaccgctgacgagattgaagcgagtctggcacaagcacaaaaactttataaacaatggcgtaatgacccagttagcagtcggattcccgtgttgcggaaattagcacaaattttccgcgatgaaacggacgatctggcgaaagtgttgaccacagagatgggcaaactattcgttgaagcgcagggtgaagtccaattatgtgcgatgattgcggactactacgcagagcacgctgaagatttattaaaaccacggaaaattgagtcaatttccggtgacgcacagcttgagaatcatccgttgggtgtattgatggccgtcgagccatggaatttcccatactaccaaatgatgcggatcttcgcgcctaactttgcggttggcgatccgattgtgtataagcatgcggcaatcacgccagctgcggctttggcgtttgaagacgcagtcaagcgcgctggtgcgccggccggtgcgctaaagaacttgttcttatcctatgatcaagtatcaacggtggtggctgataaacgggttcaaggtgtcgctttaaccggttcagaacgtggtggtgttgccgtagccgaagaggctggtaagcatttgaaaaagacaacaatggagcttggtggggtagatgcgttcatcgtcgctcacgatgccaatatggacgatgttaaggcaattgcgcctcgggcacggttatataatgctgggcaagtctgcacgtcatctaagcgctttatcgttaccgctaaccactatgatgaattcctagaatccttaaaggcagcctttgcttccgttaagatgggtgacccgatggatcccaaaacaaccttggcgccgatgaattcacgtaaggcaaaagaaaagttacagaagcaagttgatgaggcattgacgaacggtgcaaccgcctattacgttcatgaaccgattgacagtgacgggcaattctttatgccaacgattttgacggacatcaccaaagataaccccgcctatggtaaagaaatgtttggaccggtcgcccaggtctacaaggtcgctgatgatgacgaagcagtggctttggcaaatgatgcggactacggcttaggtggcattgtctttgcgggtagtgcagaagctggtgctgaattggcttcacgaattgaaacaggcatggtctttgtcaatacgttcttcagttccttaccagaactagaatttggcggtgtgaagagatctggttttggccgcgaattgggtcagacggggatctccagctttgttaaccaagagttagtggttaaacgtgagcatcctaatgataatgaagccggcggattagttctgccacataagttttagcgagtaaaaaagccgctagcataaaagtgctggcggctttttttgacgttatagggattgcacaatactggcctgcgcgattttagcaaggtcaataaaagtggcttgccgctctggcgacatgcgatatttcggtgtggtgattgaaaaggcgccatataggtgattagccttgactaaggcaaatccaatacaatacacgtcgggttcgttttcctcattatcaatcgagtaaccgcgttgacgaatacgcgtgagatcttgtttcaaagcagtctctgacgtaatcgtattgggaccaatctgttgtagtggtcgtacctgatctaaataatccgcgagcgcactgtcatccagagttgcaagcatcgctttacccatggaagaagaataaaggttcatactaccgccgatatgtgatttgagattgacactttgggggctttcgtacttttccactagcgttacttgatgatgggcaatgacccccaagttaatggtttctgaagtctgatcgcgtaattttgaaaggggaccacgagccatatcacgaatatcgaaatcttcggcaacccgttgaccatagcgaaaaagttccatgcctaactgatagtttttaccatcgccagttcgggtaacgaacccgagaacatccagggtcgttaaaatctttaacaccgtcgagctggtcatatcgatcccctgactgatttctttcaaagtgggattagtttctgattgtgcaataaagtccatgatttcttttgcccgtacaaggaccgtaccatataatttggtttctggcatactggttcactccataatttccgaataagaaatgcttatgacctaatattacgcattttgcgattaaaagtaaatggaagcgttatgaagacgctagaagtgccaaaattggtgagccgagcgctagtgataatcgctcagaagcgcaataccatgttggatttcagtagttgtagccggatactctaaggcgacgggaacatcatttggtagcttttgaagtgcctgctgccagtcgataataccacggtctaaggcaaccaccgtggctgcacccgatgatttaagttgaacatttttaacgtggatatagcgggtaaattcgctgagcttatcggccacgaccaactcgtcttcattaacgaatcgccagttacctaagtcaaaaacaaattgaatattaacaccagcggcgttggcggcagttaggaaagtgagaatattttgagaacttccgttagcaattgtctggtcattttcaacgttaaattcaacttctgagttagcatagggggataaagccgttgttagatcaccagtaaatgctgcaaaatgaccaatattcattttgagggcgtgaacccccatggcttgggcctcagcaaaatatgtagggagattggggttaagtgtcccagcggaatcaaagattttttccggaacactataaaataacgttaagtggttttcgcggacaaagtccttaattgcaggcgcctctttgagtggatcagagaaaaattcgcggcgaacctctgcttgggcaattcccaaatgaacgatccgttgtagcatgttaagttgtgattcgccagccaggtgctgttggttaaaaacgagtgtattgagaacaatctgttgtttattcatgaaaaacacctccacttttttaaaagcacgcttatcgtaatcgcttacaattcaatctgtcaaattaaaaaagcactgattaaccatcaattgtgaagccaatcattgatgagatcagtgtttttgtgtcggaaaaattatttttttaagggactaaagtccgagcgttgtgaaaccaaccgtagaaattctttcatcgacaggtcttcgactttcttactggcatcatcgaggaattcgctagcttcagatgtattgaattgttcaattaaaacataggcagttaagtatgcgaatagctgttcttttgccttagtctgcatatttgccttggatacgtcacctttactgattgagtcaacaaagtgataggcaaattcctgcgggtcaatgtgaatcttttttgaattcatcgtattatctcctaacgtcttagctctgtaagtattacagcaattatcggctaggtcaatattgccagatggtgcacaaaatgccatcgcattattaatgccgtgcttggcggctttcaattgttcggagtgactcaaaaaaattaatttgtaatgtgttgagcgataggaaatgatatgtccaataaagaaaaaataaagtatggactaaaccctgctacaacgggattcttgaaaacgttttctaaaaacatgctagttggcccttgatttttttgctgaaggggcatatattgaaattgtcaaaaaggaaatatgatttctaaataagaaaaccggagggaacacacatggcatttaatatggtaacgaaatatgcacatagtcctaaggatattgatcattacaatacggatgaattacgtgatcagttcttaatggaaaagatttttaatccgggtgatatcttactgacctatacttataacgaccggatgatctttggtggtgtgacgccaaccgatcaaccacttgaaatcaaattagataaagagctaggggttaagtacttcttagaacgtcgtgaactgggcttcatcaatatcggtggtgatggtaaagtcacgattgacggtcatgaagatacaatcgccccccatgatggctattacattagcatgggaactaaagaaattaagtttgagtccgtggatgctgagaatccagccaagttttatgtcgtatcgacaccagcccaccgtgcttatcccacgaagaaattggcgtataaagactcgattgcgatgccaatgggtgatcaagagcatatgaacaagcggaccattcataagtatatcgacgcctccattatggatacctgccagttacaaatgggatacaccgtattggaaccagggaactcttggaatacgatgccagcgcacacccatgctcggcgaatggaaacgtacctctacattgaatttggcgctgacgatactcgagttgcccacttcatgggaacgccagaaaataccaagcacatttggttggaaccagagcaagccgttgttaacccaagttactcgattcactgtggggttgggacaacgaactatgccttcatttgggcaatgtgtggtgaaaaccagacttacgatgatatggatgcggttgatatgcatcagttacgttaactaaaggaggaatgtcgttatggcacagtcccgtgaagagattgaacataatcaagaatcattgaatcagttcaaaatggattggtttagcttggttggtaaagtggcgattatttccggtgggaacactggtctgggccaaggttatgcggttgcgatggctgaagctggggctgacatatttatcccgacttttggtaaagaaggttgggatgatacgcgggcattaattgagaagcgtgggcgtaaggttgaattcatgcaagcagatttgacggaagatggcattgctgaaaaggttgtcgccaaggcgatggacgtcttcggtcatattgatatcctggttaacaatgcgggcatgatcaaacgtaatccgatcctggagtctaaggataaggattgggatcaagtgattgcaattaacttatcggcggtttatcacatgtcattggcggcttctaaagagttcgcgaagcaaaaatccggcaagattatcaatattgggtccatgttatcgttccaaggtgggaaattcattccatcttatacagcggctaagcatggtgttgctggtctgactaaggcgtttgcgagcgaaatggcagcctataacgttcaggttaatgcgattgcccccggttatattaaaaccgcaaatacggcaccaattcgtgcagataaggcccgtaatgatgaaattttgggtcggattgctgccggtcactggggtgaaccttacgaactaatgggtatttcagtttatctggcaagcaacgcggctaactatatcaatggtgccattatcccggttgatgggggctacttagttcgttaacaactaaaaaatggatgcagagcattgactctgtatttatttttgccaaatttgtgaaaaatctttcaaaaaatgaaatgtgcaggtagatatgatgaaaatcaaaaagaatattgaaaaaatacctggtggcatgatggttgttccgctggtcattggcgcaattattcacactatctggccaaaagcagatgttgccctaactggggtgaccggatcgtatatggttggcacgtcggtcattctctttattttcttctttgcagttggcacaaatattaacttgaaatcttctgggaaaattgcggccaaaggggtcacgcttcttcttggtaaagtcattctagccgctttaattgcggtgggattaaatatgattttgcctaaggaaggggtgactaccggggtctttaccggattgtcagtgctggccgtcttggccgctttcaacgcttctaatggtgggctgtatgtcgctttaatgacgacaattcctaatcgagatgttgatgtcgcggcttatcccttcttcagcattcaatcgggtcccttctttacgatgattactttggggctagctggtattggcgcatttccctggccggcattggtctcaacgttagtcccatttgtgttaggcatgattgttggtgggttagatcacgacatgcgcgacctgtttagtcccctccaaggcggactggtgccattctttgccttcaccattgggtatagtttgaacttagacatgattttacaatcaggtttagtgggcattcttgtaggggtcttggtcgtcttggtttccggatacgttttatacttactcgatcgttacgtcgttcgatcagatggtttggctggctgggccgcctcatcgactgctggcgccgctgtgtcggttcctatcgtgattgcccagatgaatccggcgtttaaatcaacggcgggttccgcaacggctattgttgcgaccagcgtgttagtttcagctattctgacaccaattgtgaccatgtggtattaccgtcgattagtcaaaaagggcaaggttaccgtggcgcactcagcagcggcgcagaccccaaccccagctaaatagtaaatttgaggtaaggaaagtgatgaattatggctgaatttttaacgattggtgaaccaatggccgtcttcgcggctgaggacctagatgccaacctagttgacgcccagtgttttcataagttcttagcgggtgctgagttgaacgtggccattggcgtttcccggttaggccattccgccgattacatttccgcggtgggggctgatccatttggccaatatattacgaaggcgattgccaaagcaggtgtgggcacgcggtatctcagtcaaaacgatcatttctggacgggattttacttgaaacaacgggtcagtcaaggtgatccagcaacatattattttcgtaaaaattcggccgcagctaactttgatcagaagaacttggatcgcattgattttaccggtgtcaaggtggctcatctatcgggcatctttgcggcattatcagccaatgacttgaccgttttgaaggacttaacgcaacgattgctggcacgacagatcttggtcacgtttgatcccaatttacgaccggcattatgggccagtcgccaacaaatgattgatacgaccaatgagttggcccgacaagcgaatatcgttatgccgggaattggtgaaggtgaaatcttgatggggtcgcgtgatcctaatgaaattgcggacttttatctgcaacagagtgacgtgactcaagccgtgattgtgaagctggggcctgacggtgcgttgattaagcaacgtgatggtcaccaagaagtggttacgggcttccatgtggcttccgtcgtcgatacggttggggccggggatggctttgccgtgggactaatttctagtttgattgaaggtcacacactgtccgagtccgtgaaacgtggttgtgccattggcgccttggcggttacgtcaccaggagataacgatgggtatccaacgccgcgtgaattggcccaattttatgcagcccaggcggcattaagttagcagaaggagattatctaatgaaacgagcggaattattaaataaaatgattgataccggtgtgattgcggttattcgtgcagagacccccactaaggccgtgaaagtggcggatgcagtcattgccggtggcgttacgggattggagttaacgtatagtgtgccccatgctgataccgttattggtgagttggtcgacaagtatgctggaagcgcagtcgttgttggtgccgggacggtgttagatgccacctccgcccggttagcgattattgctggtgcgcaattcattgttagccccacgtttgacaaagatgtggccctgatgtgcaatctttaccaagtgccgtatgttcccggaacgtatacgattacggaagctcaaacggctttgaagtttgggtctgaagtggtgaaattattcccaggtgccatggctggcacgatggcgattaaagagtaccacgggccattcccatacttgaatgtgatgccatcgggtggcgtcaatgtccaaaatatggaagattggtttgctgcaggggccgcagtggttggtgctggcgggggcctcactgccccagcggccgatgatgactttgctggtgtcaccagaaatgccaaagaatatatggatgagtacaaccgaattaaatcggtacagctggtctaggtaagaagcacacgggcaatcgtgtgcttttttctatgattaccgattgaaaggttcagagttaatgattagcggcaggctgttcaatcctattggagtgaaacctgctatattcgacaatcaaggcaaattctttcattttctcaccgcaatgtgataccctgaacaagaatgaattgaaagggtgatagatgatgacagatcgtttgaaagataaagtggcaattattaccggcggcgttgctggtattgggttaggcatcgctgaatgttacgtgcgtgaaggcgctaaagttgtggtaaccgctaaccataatgtggatggcgggcatgcggccgttgccaagtttggtgacgatgtcagtctgtttgttcaacaggatgtgtccaaagaagctgactggcaaaaggtgattgatgccaccattgccaaatttggccgtgtggatattctcgtgaacaatgccggaattggtggcgttaatacggctatcgaggacttggacttagctgattggcagaaggtcattgacgtcaacttgacggctaacttcttgggcgaaaaggccgccattaaggcaatgaagcagacggcagatgccaaaggttccatcatcaatgtgtcttctgtcgcgggcttagttggtttgccgatggccccagcgtactctgctagtaaaggggggagtcgcttgttaactcacgcgacggccctgaatctggcgcaacggggcattgacattcgggttaactcggttcatcccgggtggattgatacttcgattgtaccggaagccgctcgtcaacagattattgcgacgattccagttggtcacatggggcaaccacaagatatcggtgaagtttgtgtttaccttggtagtgatgaatcacgatttgccaacggtgccgaatttacggttgacggtggtcaacgcgcttaattaaatatctaaaaatgggatgatttagtcgatagtcggctagatcatcccatttgtcataccctggatggtataaaaaaagtccaaccagaatggctggactcataagctattgaacgatgtgtaaggtatttaaaatcagatagatatttagaataattaagatgaccgcaataatccaaccgaggatcttactccaagttcggtttgcaaactcacccatcagcttcttactactagtaaagataacgagtggaatcatcgcaaatggtaacgcgatactcaagaacacttgagagaaggtcagtaggtcttcaatcttggcttcattaccgtggtaaataatggcaaagataatcacgggggttacggagagtagccgggtgattaaccgttgagcccatagtggcatcttcagattaatgaacccttccatgatgatttgaccagccagggttcccgtgatggtcgagctttgtccagacgatagcaaggctaacgcgaacagcatactcagcatgggactggcaatggcaccgacaatttgactgtcgcttaaggcgttgaacaagtcgacgaatcgacctaagtcactgttggtaccgaagaatagggctgcccctaagattaatagcaaactattaacgacgaaagctagtgttagttgaatgtttgaatcaatcgtcgtgaatttaattgcttgggccacactcttgcggttcttgcggtcgaagcttcgtgtttgtgaaattgaagaccccaagtacaagtcatgcggcatgacggtcgccccaacaatcccgagtgacaggtagagcataccgtggttggtaactaccgtgctggatggcaagtagcccttaagcacttcgcccatgtgtggctgagccagaatgacttcatataagaagacaaagagaatcacggcgactaatgttgccacaatggcttcaattttgcggaaaccgagtttcattaagaccaataggactaagacatccatcgcggtaatgataatcccgacaattaatgggaacccgaacaggagctttaacgcgatggccgacccaataatttcagcaatatcggtggccataattgccagttcagtaataatccataatgcaaagccggtgcgcttacccgtatgttcccgggtgagttgcgccaaatccttaccagtgacaatccccagtcgggcagacatggcttgtagtagcatggcaactaaactagagagcaggaccacggtcagcaaagtgtacttatactgagccccaccggcaattgacgtaatccagttaccagggtccatataacccacggcaattaaagcaccgggtccagtgtaggccatcagtgtgcgccaaaatccggcgttttgggggacctctacagtcccattgacttcatctaaactcttttgaccgctaccggttgattcgatcatatggtgcttggttttcgtatcggtttcatgatttttcataaaatccctcttttctattggcttagaaattcaggttgtcgagtgacatctgcctttccgggtaaacgcgagtcaacgttggcattgttagtgcgaataatggcaaaaaaaccgtgaccaacgctcagtgcgcgttttaattccacccgtaagtataggctattttgccgtaaagtcaaccacactggtaataatttttggcttaccaaaaatatttttatatgaaaagatgatctcttagattggctagtgaagtttaggctagtacttgagaaaagtgtggtgccgtttccatgtttggtagatcaactttagtatttggaacccagctacgccttaaagatagttactaaacaaattcattgctttaacgttatgattcaattcgatttcgctaaaatggggataataaaaattttcagatgattagggatcgctagggggcggtcgctcatggcttagacgctaatcaaagaattattttctagtatgaacaatagatcatctagttttcaaaaccagatgattgcgttataatatcctcaacatcaaaaaccgttactaggagaaatgaggtaactactatgaaaacagaaaaaatcgctatcctagtggattcgtgttcagacgttcccgctgaggttcttgaggcagccgacatggctctgatgcccatgaatgtagtctttcgtgatcgcgtatatgaagaccgggttacgattaccccaaccgaattttaccggcgacaggctacagagaaggccacaacggcgagtcccactggcaaacggattttagatgccctagaacggattcaggcgtcggggtatacacatgtgattgcggtctgtatctcggctgcattgtcgggaacgtatcaggagacgcaactcttagctgaggattcaccacttactgtgcacgtggtgaatacgcgtagtgtcgggatcggcagtggatttgcggctatttacgcggctgaattgcgcgaacaggggaaaacctttgaacagattgtagcggaggttgagcgggtgacagcgcaaacgaaagtgttcttctatgtccctagcctgaagtatctgcaagctggtggtcgaattggacgtgtagctggtatggctgggacattgttgaatgttaagcccatcatttcttgcgatcctgaaggcgtttattacccgattgcgaaggttcggggagaaaagcgaaccattactaaattactagatttagtggcaacaacaattggaacagctaagcgggtgaatgtggctgtctgtgacggtgcggaccctgagttacgccaggcggttctggaaaaactccaagcggcccaccccaatgtcttaaagtggtacgcaggtgatgtttctccggccctaggggtgcacaccggtcctgggttgattggcgttggtattcagatactggactaataaaaaagccacgataaggtcgtggcttgagggggttacgagcaggaatcaagtactttgggggagtgcattagactgctcgcaaataagtgtattatgaattgagtcaacatcgctaatggcaagcgttggttaccactaacttgcttgtagtgtacctcctaactgaattaggtgcaattgattggttttataaatttaatgataataaacatggcccgcaatcgtgtgattatctgaccattaaagcaactaagcatggggcattagtaagcgcgaagatagctacagaaccgggcctgctacctagccagttaccgggatcgtctgcaagttaggactcagcagatggttgcataaaagttaagcaactggcgacacaaacaactgattgacggacaatgagtaatcagtataaaacgcatgacagctagctttcttgagatcagtcatgcgttttttgacatagaaagggccctgagtaacatgcggattactcagggccttattaggaatctgttaataaatcacttgttttggggggagtgcatctatagacagtgattcctatcatctatcacagtgcttaaggtcagaacgtatcacgaactaactaccggtatcatagtcgcttcccttctaatgcacaagcaaattgtaactctttactaaaaatggctagaggaattagctgacgagttcggctaccaatgaacctaaggtcaaatacacgaaaatggggctaaattgggatttaccaagggaagtcacttgcagataattaagctaagatcatgagaaaaaacataactcatataagttataggcttagacagttgtgcactaacggaattaaaccattcaagtggcagggcccaattcgctagactgatgcaatctgtcacaattggactgacgattaacatgatcaaatatacacaaaaaattagtgccaattgcacgaattatagccattttaatagaagtgtgagtaaaatggctgtattgcgctattttttaagacaaagtcatttatctttcgctaactttcaagtagactaaccatagaattgtttttcatgtaggagggtaaacatgaaagtcatcattgttggtagtacacacgctggtactaatgcagcgttacaaattttacgcgatcatccggaaaccgacgtgactatttatgaacggcatgacaatgtgtcgttcttgtcttgcgggatttcgctatttttggacggtcaggttaagcatctcgaagatatgttttattcttcacctgagcagttggaagcggccggtgcgaaggtgttaacgcggcgcaatgtcatcaagatcgattcggcggagaagacggttgatgtcgtaaatatggaaaacggtgacgtttcaacggacacttacgacaagctcattatggcaacggggtcaacggtaacagttccccccatcttcggtattgatgaagataaggtcatgttatgcaagaactatgaacaagcagtagcgattaacgaagctgctaaagggaacaaacgaattgccattattggtgcaggatatattggaacggaattggcagaaagttatgctcggacgggtcacgacgtccaattattccaatcccgcgatattatcctgaaccattatgttgataagagcttatctgatcggattgtagatatgcttaaaaaacagggcgttcaggtgtcgttgaatcaccgagtcacttcatttacgggtaatgataatggcgaattggtgattgaaacgaatgacggcgactacgtagctgatttagcagttgtctgcacgggttttgttcctaacacggaattactgcgaggacaagttgaaatggaccgtcacggggccatcattattaacgattatgtccaaacgtctaatccagatatttttgcttgtggggatgcgagtgttgttaactttaacccaactggcaagccagcttacacaccattggcaaccaatgcggttcggcaagggatgttagccgggatcaatgtttttggcaacattcaacggtatatggggacccaagcgacttcggcgatgaacatcttcggtcacacgttggcctcaacgggactcacgattgatcatgccaaagaagccggaatggatgccgaccaagtcacgtttgaaggaacttggcggccaacttatatgccaacgacagatgacttgacgattaatttggtttataaccggcaaaatcgtcggattctaggcgctcaactcttcagtgagcatgaagtggcgcaatcggctaatgcgatttcgattgcaattcaaaatcgcaatacgattgatgatttagcattcgttgatatgctattcaacccaaactttgatgatccatttaactacttgaatttagttgcacaacaggcagttgaaaaggaagttaagcgagggaataaccacccacgcttaacggctgggattgatccagattcagaagcaacggaaacggattaaaatgaataaagtcggctggcgtgtgaatgccggcctttttttagtttaaaaagagtgacagaaaataccccttggggtatactacgggtattgaatatctttttagggggatttagccaaatgcaagcaattacaagcaaggaatttgaacatattggtgacgatacagccgttacggttgtcgacttttgggccgattggtgtgggccatgtaagatgcagaccccggtcttagaggatctagatcaggcgtatggtgatcaagttaagtttgcttcacttgatgttgaccagaatcaagaactggcacaatcactgggaatcatgagcattccatcgttagtgatttttaaaaacgggatgccaacggagaaggtcgttggttttcaccccaaggctgcactgaagaagtatctggatgaaaagcttaccgaggtaacggcgtaatggttcaaaccacggcgaatcaattaaagaatcgcttgcgtcgggccgatggtcaactgcaaggaattctaaaaatggttgatgaaggccgcgattgtcaagaaatcctaacgcaattggccgccgtccgatcaggcgttgagcggatgatgggtgtggttgtggccgaaaacgtcaagcagtgtgtggtcgatgagtcgttgactgctgaacagcaagcccggctgcaatcagctttagacttagttgttaaaacccactgattattgtgaaaagtcgccgagatggcggcttttttggtataataaataggcatttttgagaggagcgtacactgtggcaaagggattttcgattatgatttttgcatttattggcggcagtagtcgttatttagtggggcaggccatgccagcaaccactgggtttccgtgggcaaccttactgattaatttagtgggttgtggcgtgttagcgtggctatcccatgccaagcgcctcacggcacactggccagaagcagtaacgattggtctaggggttggtggcgttggtgcgtttacgaccttctcaacctttagcgtcgagacagttcgcttacttaatgggcaacattgggggatagctgctgcctacctgtcagccactttactgggaggcttattgtgcagttggttaggtgtctggacagcgcggcggtggtggaccttccgcgtggaggaagagtgatggttgtggtggctgggttaggcgcggctgtgggggcattaggccgttatggactgacgcgcttagttcagtcactgtatggcaatcagtggccattagcaacgctcttgattaattggttgggctgtttgattctgggattaattacgggatggcattgggatcaaacaacgatggtattagttggtactggcgtcttgggtgggtttaccacgtattcgacctttagccatgaattagtgatgttagctgaccaacggcgatatctagcgatgctgggctacctgagtgctagcgttattggtggtctcttattggcctttggcggttttagtctgggtatggtcattcgatgattgattagagaaattagtggcgttttagtcagcaatttcctatgatgaagttaacaaggaaagagaaaggcgcgatgagtgtgacagaacatctgaccgtgacggcgcagaatgccgctttacggcaacaattatcaccgcaaaaccaagcctactgggatgcgttagtggtggcgctacgacaacaacctaaatttaaagatgaggcgacgctacaacaacacttacgggaattattgccaagtctaatcgtggcgcaatcggcccaacagactgcggcccaattctatggcggtgatccggagacagtggctgccaagatgggacaaccggcgcgaaccaagccgcaatggttgacttgggatttactggtgcccgtgttgatcttcatttctagcggcattctgccagccattatcttaccggcaataccattacaagggttgttggtggccgtgcaatttggtctgtttgtcattgctatggtggttggtctgggcgttacccggcaggcaacgctgagacggcgggtcttaagctggcttgccattgtggttgtgctactggttgcgatgggcattgctgctaagaccgtcccagcgcgtggactcgtgtactttccgcgtggcggtggcagtctagtattagtggggtttgccttagtggtgacgggtttcacgtggtggcatcaccgacggcatgtcacgtcctggttcccggcggtattggggagcttgtggattactacgttattggcattactggcgcgattcactgggaccgctggcttgatggtcacgactaccggcaatttattaattggggttgggacgattttgggtgatgttagtatcttaattatcggttggcacatttggcaactacggcaaacacttgcccaaaaggcaactgacgagcactgatgacgcggtcatcagtgcttttttaggccaagtgcttggtgctactttggcggcatggtacactgagattaatttcgtaaccggtttctttatcggtcgaataagttgtttttggggaggatgtttcagttgaaaaagacgattcaagttacaccgacgcgtagtggcctctggcaggataccgatgtgacctatgctcaggttccgggatggctaggacacgccacgttagatctcaagttaaccgtcatgcggccgtttgaacacgctaatcaggcgttacccgtgatcttttggtttggtggtggtggctggatggcagttgaccacaacgtccatttgccgaacctagttgattttgtgcgagcgggttttgtggtggtcagtgtagtctaccgcaatagtaaccaggcgatttggccagcaccgttagtggatgcgaagagtgccattcggtatatgaaggcgcatgccgccacgtatcagattgatccgaatcggatagtggtcatgggcgaatccgctgggggccatttagctagtatggttgctgtgacgaatggcctgtctcagtttgacgaaggccagtatctggattataccagtgaggttcaagcggcagtaccgtggtatggggtcgtcaatttattatcggctaaacaggggagtcgcacgaacgattttgatttcgtttatcgaaatattttaggcgccgatccagagacacatgccgacttggtggctcaggctgatccccaacactttgtaacggcgacgacggtgccctttttactgttacatggtacggatgatgaagtggtccctattgaagatagccgccaattttaccagtgcttaacggcaaaaggggtaacggccgatttaattgaacttgagcatgcacaacacatggatgaacaatttatgcagccagagattgtgacgttgattgttgattttctacggcgccagttggctatctgagggaatagtagccgtgatggggcgtttaggtgtaaagtaaagatgtaatcgctaacttagcggtccatgagcatctatcataacaaaggagttggcaataatggcaaaagttgaaagttttacgttagaccacaccgccgttaaagcaccatatgttcggttaattacgcgagaaactgggacgaagggtgacgtgatctcgaattttgatttacgactcgtccaaccaaatgaaaacgcgattccgacggccggattacataccatcgagcatttattagcgggatatctccgtgatgaaatgagcggtgtcattgactgttcaccgtttgggtgtcggacgggcttccatttgattacttggggtgaacaatcgacagaagaagtggctaaagcattgaaggcttccttgcatcggattgcttacgatacggaatggaaggacgttcaaggcacagataagtacagttgtggtaattaccgcgaccacagcttattctccgctaaggaatggtgtaaagcgattttggatgaaggtatttccaaggacccatttacccgagaagttatttaagtgaattaatgatgagccacgtaccggattatttggtgcgtggcttttattttgcgttacactaaagataactaggttaggataagaaggggactgttatgttcaggttacagcggtggttgattgtgttagctacggtgtgcttaaccgtcagtccattgagtgtggcgaccgctaaaacttatcatcagaagtcgtcggccctcagtgttggccgcaagcggacactcaatgatcgacaggtgcattatgtgacggcacctaaaaaatatgcccatgcggcgcatccacacggacgaaatatcatgaaatcatcccggggtgcggcggtgacattcaagacgtggtaccaactgccattaccagggtatcacggtcaggcatggggaaatccgcaaagtgtcacaacttcagggcgttacctatacgtcttgtattgtccgacggcatggcataatcgcggtcggattgtgcggtatgatttgcaaaagctcaagcaaaccggcttatcggcgacgcaactgcagaccatttacttggcccatgtgggagctaaattggctgcgcaggccgctgtcaaagtcggtccggcgtttgtgacaggacacggccaatctttggcctataatgggcacaatcatcaattatatctgtggtgcgatcgggaaaagaaggcagcaacgccgattaatcaatatggttatattaaccaaattaatccgaaaacgttaaaaacgcgctaccagattcgatttcgattaaagacgtggcattttgccgtacctggtgggcatgtgttagcctttgatcggcgagaacgggcgtacttttggagtcgaccaacatcccagacagtttacatctatcaaggatcagttagtcggcaccacgttcactttcggttaacccatcaggtcttgaaacacggacccggtagtcacgttcaaagtatggggtataacccacacacgaatcggttgtatttggtcgcagatggttctatagctagtttgccgattagcaagttggctgggaagggacatctgacgtcacggcaagttcgttggacccggctggcttcaaaacgggaatttgagggattaacctttaccaagcaaggccgtgcgatcgtgttaagtaatcataaccccgaagtattgatgggtaatcgaacggcttggtaaatgtatgttgggctgtagctaaatgaacaatcaaactggttattaagagcaaatgctaaatttctacggagttttagcgttttttattgggcgctagttggtgaaattagcataataaaatttataaaacattgtcgtattatttcagatgaagacttgtataataggaataatcgaaagtttcaagggggagtagaaatgaagcaaccacatttgttgcgcggattatggcagttgaatcagcgactaagtcaatggcgaatgatgcaagctattacagctgcgttgcggttggtttatccgtttgtactggttatgaccttcattgacgtgattggtcaaggttttttaatgaagaccggtttcttttatcagatttaccacattggacactggttacccggtattaccatttggcagcaagggtttacggcgttgggactggtgattaatggagttgtagccgtgatgattgcgtttgcgacgggttactatttggcgcggagttatcacggggacgcgttaacggtcggcattatgagcgcattagcctttttaacgttgaacttaaactatggggcgctaggtgcggctcatgcgggagtgagtggtgtcccaccatttgtgacgaccaatctggggccgcaaggaatttttctggcaattgtgattgggctgaccgtgggttggctggctagccatctgatgcggggggtggccacttggtatttacgccatccacgactggggcagctcggatggaccggacggattgcgattccactgatgagtgttttaattatgaacggcgcgattggtctaggattaagttggttaaaccatggcgggctaaatggcctcgtctatcagggtctcagcaacctagtaaccaatccggggcatcgtggacttgtcatcttggcagtgacagcgttgaataatcttttctggtggttagggctgattggtccagtgtctttagctggtaatagtgccgtgacgtcgctacagaatttagcgtacgccgtgcagcatggttctggttggggcgctcctaatccgattacgctacatacgttaggcgatgcctatgcaaactttggtggtgcggggatgacactagcgttagtgattgcgatttggatagggtccaagcaagttagctatcgtcggatagccaaccaaacctttttaccgaatttggtgaatttaaatgagcccattttattggggttacccgtcttgtttaatcccattttattgattccatttattgtggcacctgctgttaatattgttttagcttggtgcgcgattacgtggaagttggtgccaccaatcgtttatccggttcctcggacgacgccaggaccattaatggcctttttagggactggtggtgactggcgggccttcatcttgagcctggtgtgtctggtagtgtccgtcttgatttacttgccatttattcaggtgttaaatcaggaaggggggtctgaccatgcggcataattggtggcgctggctactaggaattgggctgattttagtggtctttattcccagtctagcgtggatgcagcatcgcgtgacgcattataaatcgaactataaaacaccgctgaatcccacgattatggtgccggggtcgagtgccagtcaaaaccggtttgatgcgttaatttcggagttgcgtaaagaaactaaagtgggacatagtgttctaaaggtcaaggtcgctacgaatggtcaagtgtcttatacggggtcaattcggcgcggagacaaccaaccgtttatcgtgattgcttttgaaaataatcaagatggctatacgaatattaacaaacaggcccagtggctaaatatcgcatttaaggatctcgtcaaaacgtatcattttaaccatttctcggctttgggtcattccaatggtggcttaattctaagtttatttttagaaaagtattttagtgaaacgaagcacgtcaacattgatcgcctaatgacgattgcgacgccgtataatatggaatctgatagtacgaccacacgcacggctatcctgaaagaattgattgcgggacgtgaacagctaccaaagaagctgacggtttattcggttgcggggacggaaaactattctagtgacgggaccgttcctgccaacagtgtgaatcaaggaaaatacgtctttcaaaatcaggtggcccattacacccaaattacggtgaccggtgataatacaacgcattcggatttaccacaaaataaacaaattgttctattgattcggcaatatctgctccaagaagagttgcctgctaaggaacgggccaataatcgctctggtattgttcgtcgttcaattacgggtgaggcgggtcttccttaacgttagatgaagtgaggtggcaacgtgaattttcgacagttagaatatttcctagcagtagccaatgccggtcaaatcacagcggcagcccaacaactgcatatggcccagccgccattaagttatcagattaagcaattggaggccgagctaggtgtcaccttgttaaatcgggcgacaacgggaataaccctgacaccagcaggacagttattgcgagactatgctcaacaactggtggatttacgggaccgtgctgatggtcaagtacgatcgctgggtcaaggcttagccggtgttttatcagttggggtgatttcatcttcgatgggtgccacgcccaatgcaaaattacggactctgacgcgacattatcccaaggttcaaattcgactattcgaggataatacgtatggcttgattgaccggctggctaagcatctcattgatgtggcgattgttcgcacgcctttcacggcgccaggactagccagcaaaacgttacagacagaatcaatggtggccgttgtcccgcaaaaatacgatcattttcaagcggcgacacttaaggttgaggatttggctacggtgccactgattgtttatcgacgatttgagcatttgtttcaaacgacctttacggaaaagcaaatttcgccatttattgcgtgtacgtgtgatgatgcccggacagctgtgcagtgggcggaggcgcgaatgggagtggcaatcgtcccccgttccgttgccgagcaagcaacaggagtgacgattcatgtgcggccaattcgttatcagccgtggcggaccacactaaagattgtgtggccggcagatattacgccgagcccgttggtgcagcgcttcattgacagttactagatatatgctaaatacaaaatagaccagcttaccatattatttttatatggcgagttggcctatttttgtaagcgattaagtggtgactctagcgccaatgctgcctacatggttgcgggggattaagagtaaggggcagtaggttatatttgaaaatcattgatcaaaatagtgaaattaatctacgagtatgctgacttaaagcttatttttattgtgaatgaaaattcaatcggtatggacgacgcagtgtgactggcttgccgctcacggaggaaaggttgataattgatagcgtaagttcaattgattggaggaataattgcgatgattcaaacagcgatactgatgcttgctgtaggtatttttgcaggcattgccggggctattctcggcattggtggggggatgattatcaccccaattttaactttagggatgggattaaatataaaatatgcgatcggtgccagtattattgccgtgattgcgaccagttcagggtctacgatcgcttatcttagggataacgtactaaacttacgggtcgccatgttcttggaaattgcgacgacaaccggcgccattgttggcgcattgctgacgggtgtattagaccccaagtacctatatttactctttgggtgcttactcgtcttttcagggtggaacatgtaccgcaagttacggcgcggacaagaggttttgcaacgggttgagccggacaagattgccgcgaagttgaagctgaatggctcatacttcgacaaggctgagatgaaaaacgttgattaccaagtggaacatgtgcccgctggtttttctgtgatgtttggtgccggagttgccagtggtctactgggaattgggtctggtgcgttcaaggttatggcgatggatacgttcatgaagatgccccttaaaccttctagttcaacatctaatctgatgatgggcgtgacggctgccgctagtgccaccgtttatttcttcaatggggcgattttaccgagcattgcggtaccgatggcgctggggattttagggggtgccgtgatcggttcgcgtatcatgcaggtcctaccggcgcgctggattcgcatcgtctttattccgatcattctctacattggattggaaatgttatttaaaggattgggggttcatttctaatggctgcaaaagaaccaaccaccgccaaagaaatggcgcaagtgcaaacgatcattggtcgtattctccaagtgggggtcattttttccgcaattgtgatgttaattggcctggtgttatttttggtgagtggccagtcgggctatagtgggtcatatgtgccgcgacgaatgggcttaattctccaaggaacttggcagttaaagccgtatgccatcatgatgctgggcgtttattgtctgattttaacgccagtattgcgagtcgtcgtttcaatctacgctttttataaggaacatgatcgtttatacgtggcaataacgacactagtcttagcaatcttattagtcgccttagccattggggttacaggataaaagcacctaaaaaaaggaacgagatcagctctcgttcctttttgtatataagttattgagcggtataaccaccatcaactacaaattcagaacccgttgcaaatttagattcgttagaagccaagtaaacacagatgtaggcaatatcgttaggttcaccgatatggcccattggcgtcttggtccgttgtgacatcgcttcttcggcccctggtaggtcatcaaccaatggtgtcttgatgtagccagggtgaacagtgtttacccgaacatcgtagtcctttagggcacaatctaaggcagctgacttggacataatccgtacggcccctttagatgcgttgtaagcccctaagctaggatcacccacaaagccttcgatcgaagacatgttgatgatggaagcccctaagcctttgttcttcatccgttgaatccctaatcgggtaccgaagaagacaccatcaaggttgacggctaatagtttacgccattcagcagtcgtggtttcttcgacactcttgttaaccgcgatcccagcgttattaactaatgtagaaactgggccaaaggctttttccgttgcatcgaataatttcgtccagccgtcttcatcggaagaatcatgttggaaaaattgaatctgatcaggagtgccgacactcttagctgctttttcaccaacatcgctgtgccggccggtaatcatgaccttagccccttcttcaacgaacttcgtggcgatagctaaaccgatacccaacgtaccacctgtaacgattgctacttttccatctaaccggtttgacatttgaacgacctccatttatttagtgaaaataatcacatacgatgctgctattatgcaccttttttttcgctttgccaagttttttgtaaattattttcacgtttgtcagggtagcgaccaatggggtggaatatgctacacttatcgaagaagatgataagtgaggcgaatcaccgtggggacacgtcaaccagaacaatggcgccgtaatctggcggttttatggttaggaacattcattgctggcatgggctttagtgaagtcatgccgtttatttcgttatatgttgacgacttgggccactttaccaagggacagttaaccatttacagtgggctgacctatgcggtaacgtttctggtgatcgcactggtatcgcctttatggggcaagttagctgatcggaaaggccgcaagttaatgctgttacggtcatcgttgggaatggccgtcgttattggcttaatgggttttgttaccaatgtttggcaattaattggcctacgtttcttacaaggttttttcgcgggatatattcctaatgccagtgcactgattgcggcagaaacgccccaagcgaagagtggcaacgcactggggatcttaacgacgggctacgttagtggtaatttgattggcccggtgttgggtggtattttagcacaagtcttctcaattcgctggacgttcattttgacaggcatttttctcgtcattgttttcattctaagtgcgacattggtgcatgagcatttcacgccaatcagtaaagaaaagcaagcccaggctggtttctggttggggcaagtgaagaatccgacgttgattatcgtcttattggtctcaaccatgtttattcagatgggaaataattcgatcacgccgattatcagtctctatgtacgtcagctgatgggcaaccaaggccccatcacgttagtggccggaattgttgcggcgttacccggtatttcgacgttaatggcagcgcccaaattaggtgagtatggggatcgcaagggaacccaacgcgtcttgatttttggctacgcgtttgccgttttgatgtactttccccagggattcgtaactagcgtttggctactaggcctgtttcgcttcatgattgggatctctgatggggcactgtttccagcggtgcagacgatgctaacgaaaaatgtgccacacacattaacgggaacggtctttagttggaaccagtcatttcaggccttaggaagcatgttaggctcgatgttgggaggctttgtagccaactggtttaactacaatggtgtctttatctttacggcattcagtctcttgttgaacttccttctattatggtggttggtaccagagattcgccaatggcggggacccgcatccaaggaggcgtctaaatgaccactgataatttaccagcacaatttcccaatgatcccacatcacttgaggccatcgatcggtttcgttcgctgatgttaaactatcgtagcgctgttcaagtggtgcgaaccaagattcattacttagaccaagaatatcaaattcaaaacgggcatacgttagtcgatagttgacagtcacgcattaagtcaccggaaagcatcttagaaaaagtacaacgtaagcacttggattttaattttgagacgttaccgcaacagatgcatgacattgcggggattcggatcatcgttcgtttcgaagatgacattgtggcgatggagcgacgattggaaaagcaacctgatattaaggttcttcaacgtaaggattatgtgacgcgtcctaagtcaaatggttaccgcagtttgcatctgatcttggcagtgccggtgtacttggctgctggggtcaaggctgtgacagttgagatgcagatccggacgattgccatgaacttctgggcgtcacttgagcatgaattgagctataagaaaaatgttcaacaccaagccgaattgcggcaagaacttgtcgagaaagcccaactggtccatcaactagaccaagatatgaatgacattaagaatcagattcgttcagaggaatctgattccatgtcttgagacggtgattgaacgcacaaaaaaagccttagcatacgccaaggctccggtttatcgatcatgcttaatgtgaaattatttttcactcgaagcttggtcgtcacggctaagtagcgcgatcccattgaccgcgaccaccgcaacaactgccattaagatgcccaattgtaggggcttccaagtcatttgttccagcgtcccaccaatgtaaccgacaacttcaccaaagatgacggaccaaaagatcacgactaaattagattcaagccacttcacacgtgtcacctcacaatcgttattagtttaccacgattgcggacaaatggggagttaagtttgttagtgatctaaatatctgaaatggggcgtgactgttgcggtgactgtgggtatcaggtataataatgaccatacgaatacgaactggttgaagcgactgctttcaagaataagttccgccttgggttgggtggactattttgaagtgggcgctttttttaatttaaggaggctacttgtggagttattacgagatttaaccttgattttattggcgacaacggtggttggacattactgcacacgaattgggattcccgccgtgattggtcagttactagtcggcgtgattgtggggccggcgatgcttggttggctgtcgttaacccattcgctggaaagttttgccgagattggtgtcattattttaatgtttattgctggattagagagtgacttacagttattgaaacgctacttgaaacctagcgtgttggtggccttactcggtgtcttgatcccggttgccggggtctatctagtggggatggtctatcagttaaatacagttgaaagtctgttcatcagtgttatctttgccgcgacgtcggtgtcgatttcggtggaagtgttgaaggaaatgaatgcactgaatagccgtgaagggacgacaattctgggggcggcggtcgttgatgatgtgttggcggtgattattttgagcgtgttgattagcacgactggaaccgccgttggtacgaccgcagcgtcttctaatctattgttgacgaccttggaacaattagtctactttgctgccatttattttgtggttcgttggctagcaccttacatggtccagattggtcagcggctgatgattccaatgggctcaacattgatggcgattattttatgttttggaatggcttatgtcgccgaacttgtaggtttgagtgatgtggtcggtgcgttctttgccgggattgccatttcacaaacgagtgccaaggaaacggtggatcaccatatcgaaccagtaggctatgccttgtttattcccgtcttttttgtcagtattgggctgaatatgagctttaccggactgggtaagcaactgggatttatcgctgtcttgacggtcgtcgcggtgctgagtaaacaactgggtgccggtgctggggctaaactagccgggtttactggcgccagttccttagccgttggggctgggatggtttcgcgaggagagatggcgttaatcattgcccaaatcggctatcaggcgaagttgatgtcagcctcgcggtattcagcgatcgtggcggcaatcatcttagcgacattgctagccccattcctgttgcgctggacgatggatcgtgtccgaaaaaccgcggaatagttagtcgcttaacgaagtggtcgtgattgaagtgaatttgtaactgacgatgggtgggcctcctatactaaaagtaaatggggaggtggcacacatgatcttcaatcgacatttttatcggagtattgccttttggctaggatggggattcattggcctaaatgtttggctgggctggcccgttcaagaaacgaaggtaatgtggtgggggatgcttggtgtattagtcatcggtgtggtattagtcgttacagggcttttacgtaatcaagagtaaaggaaaagcgtggccgaaaataatctcggtcacgctttttatgatttagtgacggtgtttcttggttagtggtcgttgccattcaaccgtaaaccaaagtaagatgaacaatgccagacaagcgagactgatcagtgcgcctagctttaagccgggagtctgataggacaaaatgacatggttctggccggcttgaagtggcacgccaatcaccccattataagtttgcttaacgggaataagtgattgggctcgcataagtgacttgattttaacagatcgaccattaactgtggccgtccagccaggaacatcagggatggccagatataacaatgaccgttgacgggtcccagtcacgttaccagatagccacgtgacaccgctgttagcattaagtttgaatcgctgttgtttcaagcgattaaccaaggctacgtagcgtttctggttcaacgagacaaaatgattatcataccccgtcgttggtgtttgggtgacataactaatcttgagaatttgacctttttggtgctgccctaaattgatgacatagcggaagccgtccgcattaatcaagggttttaccgaccggccattaaggcgtaggctggaatagataatagaattggatggtgagtagccatgcaacaggcctgtcgcgttaacgcgaaccgtgaaggtttggactgacgtatggtcaccccgcatttggtggcgagtcttggtgggaattgtcgcgagatcatgggctttagccgcccgcgtgttgactttaagtacagaaacgggtgccaatgtgtctggtttagcccctaaggcggttaggatttgttgttggttcgtcaaagccgcctgatccttaagttgaagctgggctaattgattaggaactgcaaagccaatcccagcgtatgaatcgagacgggtaaccgcgggctccttgttgatatttagccgatacttgacgcccattagcgtatctgtcaggtgtgtatatccttgggcactaatccggcggacattggggctaaagtagccgagatcgtgttggaagacccgcgattgttctatgagcgttgagctgtaggaactaatgcccgcgtagttgaacataacgggatcgttgtaatggttataagcgccatcgtaggctttggcgatgttagcatgtagaaattcaacccgatgtagattagttttggtcttcgtcgctgttacttgatccagtagggcagcatcttgccggtaatatttggcaaatttagcctgattaccaaattccatgccctgagtggcaaccacaaagttcccgcccagttcaccgaaaagaatgagggccagtagactaattcggacgggtcgccattcactgatgaacagaagcatggtgttgagcaataggagtccgagcgctaaccaaagtaagtgaaaggacggctggctggctgcatacagctcatgattaaagctggggcgtaagtgcaagaagagcttaggaatggcttgtgctgagatgaacccaacgactaaaaagccaattccccaaaccaaggccaagaccttttgtggatcattcattgtttgagccggatgcgtttgccaagcccggtaggccgtcactaacgccaaaaaggtgaagaagtagacgttacggaacggaaatccggccggttgctggaacatgtgccaaatggtattgaggacagtcacaaacagactcaagcccatggcaattaataaccacatggtgcggcgcttttcgaccgcatgaatctgtggcgaaacaaagtagacgatgagtagcaaaaacatcaaggtacccatgaagagtgaaggggcatgataaaggtgagaaacgtaggtgctggtgcctggggcaaattgggccaatacttctgttccaaattgtccggttggtaggtagttgttcacaaagacattactcttacccgttagtaacatgcccaatgccgttgggatgagcaccaccattgacatcccaccagccagtaaagaaccgatgataaattgccgaatggccgcgcggtgcatccgccagacatctttgaatggtgttggcgtgggttgatgttcgatgattaagtagataaagtacaagaccgaaaacaggcaggtcatatagcctaaataataattgcaaaaaatcgtaatggttaaactaatggtatacaaaccataatgatgctgactgaccaatcgatgtaggcccaaggccaccaatggtaaccaaattaacgcatccagccacatcatgtcataaaagtacatggcgacaaacccacatagactgtaggcggtggtgaataggagcatagaccacccactcttaagaaaagcatgccgcaagaagatggccattgtgaggcccatcgcgctgatctttaacatgatgatccaacttaccgcaatgggcaaattggccgccgagaaggcaaaaatcagcagattaaatggactaatcgcatagtaggtcagaagaggcacgacggcgctccctgaacctaacgaaaaagaaaaaagatggaactgaccatgtaatatggttgcccgtagattttctaagatagggatatattgtgtccccatgtcacttaaaagtaagttccggttgccaaaaggcgtgatcctgagatgccaaaaagccagacacataatgataagcggtattaaaaatgcgcccccatacacccagcgactaacgcgcaatgcggccagttgttgggtggattgttgctgtttcatgaaaaatccctccgttgtaaaacccacatgatgtctaaccctattaggatatcatatggacgactttgttcaaagtttacccctttatcctgatagttccgtgaataactcgttaaacttcgcaaaaacttagcctttcgtaaggaaattaacttaaggttgcgttatcgttaatcaggtagactatacttttataatgagagtccgacgtcactggtactggaaaacgtgatagttggtgaaaaagaaagggaggcatgcccgttgcgtacgaccgccaaggtattagtcgtggaggatgagaaggcattatccgcagacattgttgagttaatcgaaccgatttgtgaaacaacaacagctttcgatggtgagcaaggagaatttttggcaagtcagggcgtctttgacgctattattttggacctgatgttaccaggtgaaagtgggttggatctcttgctccacatccgcaaccagggggtcaagacaccggtgttgattctaaccgctaaagataccattgctgataagttacgcggctttaatgacggtgcggatgactatgtgactaagccctttcaccgagaagaattattagcgcgaatgaaggctctgttaaaacggactggtcatctgaatagtagtgatacgattgcgctgggacaactggaaattaacaccagtaaacatctggccacctttaatggcgcaccactgacgttaaaggggcgggaatttgatttgctagcttacttagtagggaatccagggaccattattaccaaggaacaaatcttcaatcggctctggggatttgattccgagaccagcctttccgtggttgaagtgtatatgagtaacctgagaaaggagctcaaacacgctggcagtgatctgtcattacgaacgattcgtaatgcgggttacattgtggaggccccagatgagcaataaggttaatcgggcccaacgacggcgcttgtttttaagtagcttcattggctttacgattatctttatcttattaggagtcatcgtgtttgtgctatttcgacgtgcaattttaacgagcacggatcaggctttacaagtcgagcggagtgctcggttggcggggccacccaaaaagcaacgaattcaacggccgtttgggcaagctacccgggacttgcaacggggtcaacagcagacgactcatccgtttatgacgactacggtagtctttaaccaaaatggtaaaatccttaatcgggcccagttggggtcacgttatgacaccctgaaaacattgacgttgaacaaatcagagactggaaagattcggtcagttgtggtaaatggcaagtataacttccgaacactgttagttaaaattcccaaagataatggagataaaacggttgctggccgttacctgatgatcttggaaaacattgatccgcaaaaagcggcgatgagtagctttacccgagtgatgttgatgacgatgggcgttttttggttattatcaattttgatgagcgtctggatgtcccggctgacgatgcggcctattttacggtcgtgggagcggcaaactgaatttgtggggaatgcggcccatgaattgcgaacgccactaacgattatccaaaataaattggagttattattgaccaaacccaacgataagatcattgaccaggcggaaaatattgccattgccaatagtgaaagccaacgattgcaaaaattaacgcaagatttactggcattagcgcgttcggattctaatacggtgcaaaccaactttgaagtgacgcgattggctcggtttatgacggatatagtggaaccttacagtgagattgccgcaagtcagggaaaatctctgtcattaacgccggtgactgactttaaggcgacgctggatcaaaaccttattcaccagttgatgaatatcctgattgataatgcgcttaaatactcgccacaggggcgcgcgatcaccatttctgcgcgactgattggccgaaaatggcagttgatcgttgcggatcagggaattgggattcaagcaggcgatcgtcgacggatttttgatcggttctatcgggtagatacgtcacggagtcggcaaaccggtggcaatgggctaggattgtcgattgcccagtggattgtgggcctgcatcatggcacaattgttgtcaaagacaatttacctcaagggacacaatttgtggcgacttttccactgaatcccagtgcgagtctgaccggacgacgggacaagaaacagtgagatagcttcctgacacgggctagccataggctgacccgtttttggtgtggctaaggttgacattatgggaaaaagtttcaaagattgcggttgtatggtaagatttgagtcattgagaagtgttagtgcataaggagcttgtaaataaagatgttaactatccgtgatattgctgcgaaggctggtgtgtccgtatccaccgcgtcgcgggctttaaataataatccccgtatcagtcaggcaacccgtgagcggattcaagcattggctgaagccgagggatatttaccaaattataatgcgaaaaatctgactgccggagagtctaatgccgtgggggttgtttttgctacggctgatcgcagtcaaccagaaaatcctttctttattgatattcttcgaggaatcaatgcgcagctggtgcaacgagactatgtcctgtcagttgccattagcaaaacggctgatgaacttttgaagaatgttaaggccatggttgctcaggggaaaattaagcggtttgtgttgttatatgctcaccaggatgatccgatcgcagcttttttacggcagcatcatctccgcttcgtaacgattggtcagccggatgacaatgccaatgactattttgtagataatgacaacttagaagcggggattggtggggcgacctttctactcaatcaattgcaggtgaagcatcccgtatttgtcgaatcagcccatgattgggcttacgagcaacaacggcgacagggatatgaacgggtggcggcaacctttaatgtcgaaccgttgacgtgtcggctaggcgagttgaaccgcgtgcgggcatttatcaagcggcaccctgagattgatgggattatggcgactgacgattttaacggtatcgaattctatcgattgatgcgcgaacagtatggaattaatcattttccaatggttagtttcaaccagtcgttacccaatgggctaacggatgcggatctacattccgtgaacttatttcctgagaagatgggatcggcgacagtggccctattatttagtgacaaggagccattagagacaccgacaccgggacaaataaaaattccatttgaaattaaataggttattaacagcccatatcatcgacgccaatcgccggtggtgggcttttttaattgtcagtggttcttattttgaactggaacgatccaataaattttaaaaaaagtttgcgcaatcggttgcattaaaatgaaagcggtgccataatagtggggtactttatattagtaattatttataaaccttgaggaggttttcgtatgtcagatgttgtgactgaagatacgtctgcggcagcagccaaaaagaaaaacgggttgccgacgcttcctgccagcaccatttggatgattaactttgggttcttaggggtgcaaaccgcctttaccctgcaaagttcacaaatgagccggatcttccaaactattggggccgatccgaatagcttggggtggttcttcattttgccaccattagctggcttgattgtccaaccgattgttggatattactctgatcgaacatgggcgcctaaattaggaggtcgccggttaccgtacctgttactaggaacgattgttgcggtgattgttatgtgtctgttgcctaattctgggagtctaggctttggctatgcgtcattagcagcgctgttatttggtgcaattacagtggcgttcttggacctttcttccaatgttgccatgcaacccttcaagatgatggttggggacatggtcaatgatgaccaaaagagttatgcttacgggatccaaagtttcttatctaacacgggtgctgtggttgctgcgatcctcccattcctgtttgcaatgattgggattgccaacactgctgctaaaggggttgtcccggcaacagttaaggtggccttttatgttggtgccgcactgttagttattacaagtttgtttacgattttccgtgttaaagaatatgatccagatacttatgccaaataccatgggattaccaaagaagataacgcccaaggtggtaactggtggacattgttgaagtccgcaccaaaggtcttctggacggtaaccttggttcaattcttctgctgggttgcttttcagtacttgtggacttactctgctggtgcgattgcggccaacgtttggcacacaaccaacgctgcttcagctggctaccaagcagctggtaactggtacggtgtcttagcagccgttcaatcaattgccgcggtggtttggtcttacgttttggctaagttgccaaacagcatgcacaagttgggttatgctgggagtcttggtttaggtgctcttgggttcttatccgtcttcttcttacacaaccaatacgccttgattgtttcctttatcttagtcggtattgcttgggctgcgatgaacacttacccattgacgatggtaaccaacgccttgtcaggtgcccacatggggacttacttagggctgttcaacggttctatctgcttaccacaaattgtggcttctctggccagctttgctttgttcccattattgggcggtgctcaagccaacatgttcttgttagctgggatcatcatggcaatcggtgccttgtccgttggaacgattaaagaaacattccgcgcttagtctgagtgttgattgaacaattagaaatgaataaaaaggagtaatgtcaaccatgaaacgaatttttgaggtccaaccatggaacgtaattacgcatacttttgaccccaaagacaaacgtctccaagaatccatgaccagtttaggtaatggctacatggggatgcggggtgactttgaagaaggctatagtggcgattccctccaaggcatttacttgggtggtgtctggtatccagacaaaactcgggttggttggtggaagaatggctatccgaagtactttggtaaggtcgtcaatgccgtcaactttatcaagttaccgattgaaattaacggtgaacccgttgatttagcaaaagataagatcagtgactttaccttagaccttgatatgcatcagggtgttttgaaccggtcatttgttgttgaacgcggtgctgttcgcgtcgccttgaatttccaacgtttcttaagtgttgctcagccagaattgtccgtacaaaaagtaacggtcaagaacctgagcgatgctgaggttgacgtgaccctaaagccaagtatcgatgccgatgtgatgaacgaagaagctaattacgatgaacgcttctgggatgtcttggccactgaccaacaggcagatcgggggagtatcgttgccaagaccacgcctaatccatttgggacaccccggtttacttccgggatggaaatgcggttggtaacggacttaaagaacgttgccatcacgcaaccaaatgaaaaagaagtgacgacggcgtataccggtaagctggccccacaggcaagcgctgaattagaaaagcgcgtgattgtggtaacgtcacgggattacgacacacaagaaagcttaacggcagccatgcatcagttgagcgacaaagtggcccaatcttcatatgaagacttgttgaacgcacacacggccatctgggcccaacggtgggaaaaatctgacgttgtgatccaaggtgacgatgagtcacaacaaggaattcgctttaacctgttccagttgttctccacgtactacggtgacgatgcacgcttgaatatcggacctaaaggctttacgggcgagaaatatggtggtgcaacttactgggataccgaagcctttgctttccctgtttatcttgggattactgatcctaaggtcacgcgtaacctcttgatgtaccgttacaagcaattagacggtgcttacatcaacgcacaagaacaagggctcaaaggggccttgttcccaatggtgaccttcgatgggattgaatgccataatgaatgggaaatcaccttcgaagaaattcaccgaaatggtgatattgcttttgccatctacaactacacacgttacaccggtgacgacagttatgtcttgcatgaaggggccaaggtgctgaccgaaatttctcggttctgggccgaccgggttcacttcagtaagcgtaataaccagtatatgattcatggggttacgggcgctgatgagtatgaaaacaacgttgataacaactgggataccaacatgttggctcagtggacgttgaagtacacactagaaatattgggtaaggttgatcagaataccgccaagcaattggatgtttccgatgaggaaaagacgaagtggcaagacattgtcgatcggatgtatctgccttacgataaggatctgaacatttttgttcaacacgatgggttcttggataaggatatcgaacccgtcagctcgattccagctgaccaacggccaattaaccaaaactggtcgtgggataagatcttgcggtcgccttacattaagcaaggggatgtcttgcaaggaatctgggactttattgatgactacacgccagaacaaaagaaggccaactttgacttctacgaaccactgacggtgcacgaatctagtttgtccccagcaatccactcggtattagctgctgacttgcattatgaggataaggccgtagaattgtactcacggacggcacgactggatttggataactacaataatgacacgacagatggcctacacattacggccatgactggtggctggattgcggtagttcaaggtttcgcgggcatgcgggttcgcgatgggcagttgcattatgccccattcttgccaaagacgtggacaagctacaccttccggcaagtcttccgtgatcggctgattgaagtcagcgttcacgcagatggccctcacttcaagctactcagtggcgaaccactgacgattgatgtggctggtgaaaaggttgaattaacccaaaacgtgacagcttaatctaaaaaaaaggacgactgagaaattaatctcggtcgtcctttttgtgtggtgtttagaagtcattaggcaaaaaatcttgttggaatgctttagccctaggcagcggcgcatctgcttgccagtaagtaagccattccccagaaatggttaagctttcgagatccagctgatcttgaatcaaaaggtcactttcgaggcggtgcttaaatgccgctagcaggtcaccaataattgttaagttagcctgcaagttgtcgccacctaagtccataagctcatcttcaaattgttcacgaatcgcatgttcaatcgctttaagctgacgttcgtgctggcgcgtcaacttgggttgattgttggcgtcaaaggcgatggcactggcaactccaacaaattgggcattgattgtcggctcgtccaagctttcaggggtgtttttggcgtaaccaaaaattggaaattcacggagaatggtataaacttcggtcattgatgatcagtcctttgttttttgcagccgagctgctgttaattagtgttagtgtacggcatgaaaaaagccacgtcaaacgcggttaagcgactgatgtggctgagtttggtttaacgttagattaccagctggccttttgaaccccggggattttaccctcgtgggcaagttgccggaagttcaaccgtgagaggccaaacttccgcatgtacgcgtgtggtcggccatcaagatggtcacggcgatggatacgagtaggggaagcatcgcgtggtaaaagggctaacgcggcgtagtcaccagcggcctttaactctgcacgacgattggcaaacttctcaacagttgcttcaatacgttttgctttcgcaattttggatttcttagccaataaatgaatctcctttgatagtaattattacgctttatcaatttagcatagctgatttgtccagtcaattaatgtgtcttcgattatacgagtgtgttgctagtctttcattgagacacgtttcaaccgcaggcaagggccacaaaaaagtcctgaacacctgtccaggacttactaaatcgacgcttaataggttaattcataagtgatgtcataacgcttggtttcaccagctggaagcgagacgtcaccgaattcagggtgattgggtgaatcaggaagactctgggcttccagcgcgattcccatgtagggctgaccagcacccgtggttaatttcatatctgacgtaaaggaattagccgtgaagaccaccagaccatcgcgttgtgatttaattgttacagcgcggttggtttggggatcacttagcttggcaattgtgccatcagtaccaggaacaacgtggtagacatcatcaaaccctttttcagggatgtcttgtagaccccggatggcttgcccaagattttgtccatcggcgaaatcgtacggggttcccgcattggcaatcattttaccggtggggagtttttcatcatcaagtgctaaatgttcttggctgttgacttgcaacgtctgccccgagatcagctggtcgtcgctgaggttgaagtaaacgtgaagtgttggattgaagagcgtgagggccgttgaattagcttcaaacgttaaggtgacacgatcctggttgtctaaagcatagatcattttggcggttaaatcgccaggaaatgagtcatcagtatgcttaaacgtatgggttaggatgatcttggcttgctggggatcgcttgtgtcgagcgcaccagcccagttgactgtgttgaatccatgcgggccaccatgcaacgtattgtggccttcattggtatctaactgagttgtcgttccgtttaaagtgacttgccctcgggtaattcggccgccagtccgaccgatgcccatgcaaacgtaaaacggattgtcgaggtaatcagccaatttgtggtaagatagcaccaaattatggtcgccgtttcccgtcggtaccgttaatttatgaagggtggcgccccaactgagaatggataatttaacaccgttgtcattttcaatcgtgtattcagtgacagcctggtcctgataagtatcccaatgatttgttgtcgtttgcatagaatagtcctcgattcttttaatttaaagcgttttcaatttagttctatcatatattttcatccggacaattgtcaactttaattctagcaaattaaatagagaatttttatatttgctttgatacaagctattttaagacctaaaaattattcggacgaatttaataacatattgatagtgaaataacaaatgcaacggtgaagataatttcacttgtgtacaattgaggaaactggcataatgaataagttaaagaaggcggcgtaatgagaaagtttttgctgaaaagtggtttgattggtgtgggtgtatggtggagctatcggtggctaagtcaacgaactgccgtcaaggttcccctaaatcatcgacggactgacgtaccttatacaactaccccgaccttatttattcccggatggggtggtaatgcttggacctacaatggtcttttacgttggttagcccgtcacggctatggtcatcaggtcatgaccatagtggttgaccggcggggccaattgcgggttcaaggggattggtcaatgcaagctgacaatccgttgattcaagttctatttgcgcacccgttcacgcgggactatcaacagcagattgcgtggttgacgactgttttacgagaattaaaaagccacacccaagtggcgacctataatatggtcgcccactcttggggtggtagtgcagcagttaatcaattggttcggcaggggggcacaacagatttaccgcgtttgaatcgactggtcttgctgggggcaccggttaacgaagccacaccgaccaagccagatgccatgtacgagcgtctaacggcaactaaacaaaatctggcagccattacaccgggcatcatccacaacgtgtatggcctattagctggccgattaacggatggggaagtaccggttcaccagattacagcattacgtgccgttgtctgcgatagtcccttgcagtaccgcgaacatccagtgtcaggaattggtcatggtcgtttgcattcggccccacaaatgtggcaattgattgcccacctattgtggtcaccagatcaggtttttaattaacgttaaccttgatctgctaagatagtatcaatgacgtctaatacaccttcgtggttgttatcatggggagtaatgaggtcggcgacttctttaaccgagtcagtcccgttgcgcatggcaacgcccaaaccaacgtgggcaagcatttcccgatcgttgtcgttatcaccaaatgccgcaatttccgccggtgtaatgtgccaagtggccgctagttgggttaatcccacagctttgttcatatgaggggcgacgatatcgatgctaccaaatccgctggcagtggcattaattaaaccaggaaagtgggcgttgagtttggctgcgatagtctgaatactgtcgttgggccactcaccgttaattttatagatggtatcgttgacctgagttagatcgtcaacgcggactaaattattaaagaaatagtcctgactggcctcgtcgagagagcggtcttggcgattaaggtaggtgccgtgagcacccgagaggcgtaaaagttgcggacgaagcgtctgatcggctaaaatagcctgaaccacctcgcggaccacgggtagtggtaattgggcttcggcaagggtacggttatgatcaacgatcaagccaccgttttcggcaacaaaggtttgcacctggggtgtcggggcaaacacatcttttagatggccgaggtggttgccactggcaacgacaaagcgaatgccagcggacgataggcgattcagctgagcagcgaaccgattgtgattgtaggtgcgttgttgattcagaaaggtagcatcgacgtctgtagcaatcaatttaatacgtgtcataaagttctcccttagttttaaaatttcttaacattaatgataaaggcttcgtagtgggaattcaatgggggagttaatgagaaatatgacaaaaaagttgcaaattgctggtttttttatttggtatgctataaactattaataaatcagtaacatataggcggaaaataagggctataataaatgattagcgggtaagaatagtaactttaaccgtaattataaggcagaaaggaagacttacttaatgacgcaaacaaatgatttgaatcaatccttagaatggttctcccaacttcaaaagattatgcggccagtgacgactatcaaaacggaggatatcacgatctcgttagaacagtttaacttgttgcatgcgatcactgaccaaaaggatgattttacgccaactaaatttgctggccaaattggggtatctaaatcaatgatctctggtcaaatttcccggttgttgcgggcagggttaatcgaaagcattgcttctacgattgatcgtcgccaacacaacctgaagctgacgccagatggtgtcaaagtatacacgcaagttcggggtcaagtggttgaccggttgaacggcttgcatgatgatattgccaaattaatgtaagcaaagcgacttaagttactcttaaaaaataagccccgccacaaccgaaatctttcaatcgtgtaacaattaggttaagacgacccaacggttagatgtcttagctataatggttatgaaggaagaatttggaagtggaggggattttttgaaattacgggttaaactaggtctaatagcaaccgttgctatgggggcaacgctgttgggactgaatccaataagtgtgacatcgcagcaatcaacaactggtgttgcgtatgcagcgacgattaatgctaagcatcaaggtttggtgggtgatggtgccaccagtaataataccgccttacaggccatgattgataagtggtcagataatgtgaccattcatgttcctaaggggacgtacttatttgatgcgggtaatattaaattacattcaaatattacctttaagtttgataaaggtgccgtttttcggatcactggcggtcaacgggttaactttgtttacccaagtccagaagctggttatgatggtggaattagtaatgtgacgtggcaaaatgcgaccttccaaggtgataataccagtgccggtcaaagtgtctttacgcaaagtattcaccatgcccagaacgtcaactttgataagtgtgtgttcgataatgctgaatcaccaactggacactacattgatatcgatggtagccacaatgtgaacattaccaattcagtattcacgggctttaatggttcacaggactataaggaagccattcaagtagattactcgaataaaaaggcaatgtcctacaagaacgcgggcgaccagtacgataacttacctagttatgatgttacggttgacaataaccaattcttaccagtttctaagaagtctggtcaagttcaatcatatgcccctaacccaattggtgagcacgtcatctatgggcatggtgcggctggaatcattcatgatgttcactttacgaacaatacggttgttgatcccaaaccattgttggggaatggtgtggctacgatccacttcaagggaatttctaacttgtggatcacggggaacaagttcattaaccaacatgttttaggttcaggaaactatatttatttatacaattctgaagcagactatcaaatgacgaacctgaacatcacgaataatacatttacaaatgttaatccgactaaacaatatatttacctggacagcagtacggcgcaaaatccgatgactgatgtgacaattaatggaaataaagccacaacgcagcgatcaattgtcccatttgttaatagtaactttgatttgaccggtgatggtatcaaaattgccagcaattcagttaagaagcaaaaggcaacgaccactacggttaagccaaagcaaaagattacaacgaccaaggttaacaaaaatgcacaaaagctcaagaagcgtaaacaaaccaataagacggaaaagtatgtcagtggtttggcaacgcaacacgcgcagttgaagagtaattacaagacttattctctctataatcacattcgcggtcataagaactggaacattatgaaattcgactggaagaagattaagagtcaacgtgtttacattgatatgcgggcgacggctgattctggtcaatggtaccggattcgcttcagtaagaatgccacaacgaagtattggattcgaaagggcgctttagactttgataaaattacggttgaagaatatgatcgtgatttaaacttgatgaaagtttatccggtctactccctaccatttaatgattcgcaactagccaaggctaagggaacgaccgccgatatttcggaccggcgggtaacgattacgcatcgagcgaaacgaaccgattccaatggtcaggtaacgacctattaccaaatggacaatgggttatggacgcgagcattggcgtttgatttagattcataatgaataattgaaaaagacaccgctagcagactgttggcggtgtctttttgtctggtaattgttgcggtggctttcaatttagataaatataaaagaaaattagatgcacaaagcagaaaaagaacgacaattctggtaaaataaaagtatgtaagcgcataatttcacgttttcttcaaatttacagcgaaaaacgttcggattcgtttgttacagtaggattacagggttggttagaccacaaaaagacgagaaagcttgcgtttttttaaaaagtcggtcgaaatcgagggtaatgggtttcatcgttaccgattgtggtgtacaatacttaccatagttagcactcatagaaaagagtgctaataccaagtacctcatcgaatagagttaaaatggagggcgattttatgattaaaatgtactttcacgcaaaaacgacggctgttaccaaggcaatgaaatggttggctaaccatgatgccaaatttacagctcgtgatattaaaaaacaaccattaacccgggatgaaattctgtacatgctatctttaactgaagaaggaacggatgacttgatttcgacccgttctaaggcctacaaagcattaccagcttctgtgcaagacatgggcatgaatgaattggttgatttgctgcaaaagaatcccggaatcttgaagaatccgattgtggttgatcgcaacaaattagccactggtttcgaccttgaaacgattcgcgaattcgtgccggcttcttaccggaaaaaagaattggctagtttcttcaagattttgaatggtagcaagaacagtctaggtgtgtcaccagcataatagaagattaaggattaaccgtggtcagtggatcacggttttttagtgccgtaatcgtgagaaaatataggcgtatacaaaaaagccgtacgtagtagcacggcttttttgtagtggatttagctcaatgttgccggacgggaatacccgaccgtatgccaccaggaaacatttgtggcttcggtaatgacaccgtttaattgggcgtcgatcattttgtggttacccaggtagatcccacagtgtgtaatattgctagcgctggtaccgaagaagattaagtcaccggccttggcattagcggcactaacgtgggtgtagctatcgtattgcgcttgcgccgttcgtggcagcgtttgcccaatagcttgattaaagacatatttggtaaagcccgagcaatcaaaggcacttggtccgttaccgccgtaggcataaggtttgcctaattgtgtcttggcagcttttaaaatagaatcataggttccggtccctgtagatgaagttgttgttgccgtgtgggcatagctcttcttttgcaaatacccgtgccagatccaaccagcagcagtctttctgccgttggtgacatagtagtagaggtatttaatcccattctttttgatgatgtaacgttttttagtggcatgccacgtggtgttgggataattctttaagtagtgggtcttcttcccaaaggtcatgttagtggccgttccccctaagttgtaggtccaccccgtcgcgctcttgcgtgtataggcggtactagtcatgttactggtactaacaattgtatttgtactattggcatgagcggtggtgctttgactcaatgcgggtactaaagcggcggcaaatgccacggtgaaactaactttttgtagtgtcttcattttgcaattccatccctcatatgtattgttgtgatctcagtagtgttatcaaagtacagttactaagatagtcgttatgagttacagaatggttacggtgcaaaatcattggcattactattttgtgcgtaatcgtaacattacaaggcttgggccacttatactaggtgtttgcccagttagattgattaaaaattagatgcgcttgttgctaatcggcaattgccgctggtaagtcatataggcggctgttggtggaaagggtagtcgggactgtaagtgcatagccaaaggatcagtcgtatcaaattcaccggttagtgtgtgaaaatgccgttgtagccaacttaaaatgactggtaatagatggtctaattggccactgtgccgttctcctggccaagcgattgcgacggacgtgggggagtcggcaaaggaaaatagccaagcttctaggtattcattgaccattaaggccagtggtgcctcaagaatttgatctctaaaaatacgagcttgccactcttcaggtgattgggagattacggggttattgaggtgtgtctgggcatagtcctgataagcccaagcgctcagttgctgacagagctttggatttgctaagacttgcgccgcacttaagacggttgcatgggcatccggtaatccagttgttgtcagtgttaattggggaagataggtcgtgcgaataagatagaattcgtgcttagttagccagagattaaagggatgttgcggtgcaaagtcacgggtgatgagggattgatggtgcccgcttaatacttactgcgtcacatctgtgagaatttgttggctgatagacgtaaagttggaactcgttgggtcaacgtagccagcaaagtatagcgcgtggggatgaagggcgtttgtccaagtcgtaaccaatccttgtggttggtgaggatcaccgtacaaggtagggtgccgatgctctaattgttgtggtagctctcgtgtcttggcgagctggtgtaataggggataaatagttgtcaaagcgagtcaccttcttagaaaaattaagcttagtataggccataaaaattaatagtgacaaatgaacacatctattttttagcaagaaccgttgtggtggtgaaatatccgtcaaaataactagccgtttaccaattaatgggtgattgcctgttgattgttaggaggagtagcgcgagaataaggttggaaacttttatgaagaaagtagggattaaacgatatggaaactaaacgtacccattttaagatgtataaaagcggtcgccgttgggtatttgcctgtgcggtcattgcagctttggcaggtggcgtaacggtaacggcacaagctgacgtaactgatgataccagttctagtatgacgactagcagtcaggtagcgacgtcatcagagagtagtactagtgcgacgagtagtgcggtgagtcagtcaagcgtcagtgccactagtcaaagtagtacgtcagtggctcaggagaacggtagcagtacaacgcagacatctacagctacgcagacgactgagtcaacaaccgaaaagacggcaaccgcagcgactaagacaatagccaaggcaaagaaggctaaagcgacgacccacacgacaaccgcagttgttccggggagtcggttaagtctagctttggcaaataccttaaaagctaaaacacataccggtgcaacgcgtaaacaacagttggggcacacgaacgcactcagttctgctgctaccaaggcccggacggctaaggcaaccgttgctagtttgttacaaaaactggccgatcaaacgccggcaaccactacggcattaacgccatatgcggacagcggcattcaagcaggtgggagtgtctacgatgatttcccggatttagataatttactgggggtctcctcagtctttcatatctttgcgcgggaagctgagttgaacgcccacacaaatggtaacgttgcggtacaaaatttgattggcaacgtgaacttcggaacaaacatcattgaagaactattggataaagatatttcttacatacaaaacctgaccaatattgctggtagttcatttgtctcagggggggatacccgtgaaaacaaggtgatcttcggggacggcattgaagtagatattagtaatcctaaccggccgatggtcaatggcgtctatattgatcacttgctagcctcagaagtttatcaagatcaaaatgggcaaacgtacattgattttgatgctgagtttgctaagttaaaagcactcaatgagtcattagcaaatacagcgagtgaagcgacctattcgaatagtgattttgacgacttaaataaacgggtcattgacatcagcaccatgacgccgaacgccaataatcaaattgtcattaatgtgacgccggatgttttggcaggggacacaccgttaaccatttccggattgtcaccagatgctgatgggacaacggtgattattaacgtggatacgggtggccaatcggactacacgatcaagtcgcaaattaaaatcatttacagtgatggaacggaacgaaataatcaagagaccgaagactttggtgataatcacctactgtggaacttttatgatagtaccgctagtgataaacagtatggcggcacgattaacgttaacgcaccgttccaaggaagtgtcctcgcgccttctgcgacagtagtggctaatcaaaacttggatggcaatatcattgctgacaaagtgattgtcaatgcggaaacccaccggtgggacttgcaagacaatacggacgccgaagatgaaccggaatatgaagatgttatgactcttcccgggattggcgttgagttaccaagtattgaggagccgaataccgaagaaccgaataccgaagagccaaatactgaagagccaaataccgaggaaccgaataccgaggaaccaactgttgaggagccgcaaactgaagaaccaactgatgaagaaacgacgtatgaacatgagcgtcctaatttggctgatgaatacgaagacgatctgattgattttgaagaagaaggcaacacagcagccgaagaaaccttgctcaataaggttgatgcggcaattgctcaagctaaggcggcaggaaaccaaactttagttgctgaattgcaaacagtccgtggtgagattctggcagccttgggactggccgatggcttaccacaaacgggtgaagcccatcaaggctggttacaagtgcttggcttggcattagctagtggtctgctagggacaaccgttattcgccggaaacggcaagattaacgcaaagaagatcaaaggagctgtgacgaataggtcacggctccttttttgttattagacaatcatgcgcagtcccatcacgatgagcaacagccccatgaacggcttaacgtattgattgagtttttgtggatcaatatgcatcagtaagcgtggggcacacaacgcccctaagacagccccaatcatgagactcagaccaacggaccagtcaatattgttagcggacaggtgaaataggagtccgactagggaggttccgactaagacgtaagcggaagtagccgctgctggtaacatatcaagtcctagaactaataacccagcaataataggtccaccaccgctaagtccagcgacaccaaccataatgccactgagtgccccataaatggccgcctgtgaccgttgatggggcgcggggcgatcattgtgactaaggaatcgcttaatcaggatttgaagacccaagcccattaagataaaggcgaccagccaagtataaagcttaccgggaatgtatggcgcaagcagcgccccacaatggttgcgggaatggcggtgagtaacatctgattaccaactctgaagtggatttggccagttcggtaatgaccataagcccccaccactagagatggaaaggccgtgaataaggacgtggatgctgccacggctggcgctaaaccaaaaacactggttaataagcccagataaatggcggcgcccccaccaccagttgacaagactaaaatcccgactaaaaatccgattaatactaagcctaaccacatgagcaaccgtgtcgtctccttgtttgtaatcagcggcaacgacggattcagcggcaacgacggattcagcggcaacgacggattcagcggcacccacagagattctgcggccgacagcaacagcagtgacgccttcaacggattatttgccggtaggtacagtggttgaaacgcctgcgaccgacgcggaggtagcagagcaaccagcctcgacggcggatgaaccagcagaagtaacgcgtgaatctgtggcggaaaacgtgggtcctaaaccggctgaacaatcgcgtgaagtttcagccttattagaccgggcaatgagcgatgataccacgccgaatcaatcaaagtcggcggcatcagtagacaataagccggctcccgcaacagttaagcctaaagcgaagcctgcccgtggtttgggccattcgctgggagatattatgcaagaagaggggaatgatcagcggaacttggctttgtttgaccggccaacagcacccgctgagaccgagccgtcagttgttagtgaccggggctatcatttcccagatattagcttattacccaagccagtcgtgccggatgaggcagcattggatgaatggattgaacaccaagctgaggtactggacgccacgttaagtgcgtttcacgtggatgcccatgtgacggactggacagtgggaccaaccgtaacgcagttccaaattagtctagcgcttggggtaaaagttaataaaattactaatctaaatgatgatctcaaattggctttggcggctaaggacattcggatcgaagcaccaatcccgggtaagacaacggtgggaattgaaattcctaattcaaaatcccgtccagtcatgttagcagaaatcttgaattcaccggcgttccagaagagtgaatcaccgctgacggttgctttaggggtcgatttatttggacagccccaagtgactgacttgcgaaagatgccccatggcctgattgccggggcaactggttctgggaagagtgtgttcattaattccttgctgttatcgattttgtataaagcaacaccacagcaagttaagctcctgctcattgatccgaaggctgtggaaatggccccatatgatgccttgccacacttgttgtcaccagtaatttctgatcctaaagcggccgcagcagccttgaagtgggtcgtcacagaaatggatgaacgttacgaaaaactggcagcggcaggcgttcgtaacatcgagcagtttaacgaccgcgccgatgctaacgaagaacccgggttgaagatgccttatattgtgattattatcgacgagttagctgatctgatgatgatggcggctagtgaagtccaagactacattgtccggatcactcagaaggcccgggctgccggtattcatttgttagtggctacgcagcggccaagtgtggatattgtgacagggaccatcaagaacaatattccaacgcggattgcattcatggtatcgagtcagattgactcacggaccattttggataccgctggggctgagaacctcttgggacgtggggacatgttgtatcttggaaatggggccagtcagccgatgcggttgcaaggcgcatttgttgagtctgaggttgatgccattacggactttgttcgaactcaagggcagccacactatgcttttgaacccaagggcttattacaacgcgagacggcagaagaaaatcaagatgaattgttgccaaaggtcttggactacattgcccaagaaaagacggtctcgacgtcgaaattgcaacgggtcttttcgatcggctataaccgagcagctaatttgattgatgatttggaacagcaccattatgtttcaccgcagcacggttcaaaaccgcgagaagtgtatttaacaccagacgacttaggtaaggatttaccagaaccgcatgaccaagatgcaccattttcatcttagcttgaatagacctcaccgcctttctgcgttggtttcttttatgggggtgggggatatgctaaaatgaagctagagtcactcggtcgggggagtatatggccttaccgcacagagtagaaaagaggatcatttaatggataacgcaacggtttatcattttgttggaattaaaggatcagggatgagtgcgctcgccttgattttgcatgacaagggctttaaggttcaaggttcagatattacgcaatacacgtttacacaacggggattggaacaggccggtatcgacgttatggcgtttgatgaagccaacattcacgaaggcttgacggttattgcgggtaattctttcacggatgatcatccagaaatcaaaaaagcccgggaaatgggcttgccggtttatcgttaccacgaattcctcggtcacttgatcgaaggttataccagtattggggtggctggtgcccacggtaagacaagtacgacgggattgttggcccacgttttaagtggggttgcaccaacctcttacttaattggtgatggtagtggtaaagggacgcccaatgcgcggttctttgtttacgaagccgacgaataccggcgtcacttcttagcaaccaagccagactatgcgattatgaccaatatcgattttgatcatcccgattattacacgggcattgatgacgtctacagtgcgtttgaaacgctggctaagcaggttaagaagggtatctttgcttggggtgacgatccagaactacggaaattaaagacggatgttccggtttattattacggtacgagtgatcgtgacgacttccaagctagaaacattaaacgttcaacaactggctcaacctttgatgtttaccatgatgatgaattcttaggtaactttgaaattcacttgtttggtgaacacaatgtgcttaacagtctagcagttattgcggtggcttactttgagaaggtcaacatggatgaaattaagcatgaattggctgactttaagggtgttaagcgacggtttacagaacgaaagctagcggacatgaccatcattgatgactatgcgcatcatccatctgaaatcaaggcaacgttggatgctgctcgccaaaagtatccagacaaggaaattattgcggtcttccagccacatacctttagtcgaacaattgctttgatggatgattttgccaagagcttgaatttggcagataaagtcttcttaaccaatatctttagttctgcgcgcgaaacgcagggggccgtatccagtaaagatttggcacaaaagattgtcaagggtggcgaaatcttaacggtagacaatatgtcgccgctgttagatttccatgatgctgtggttgtctttatgggtgctggggacgtgcaaaagtacgaacgggcttatgaagaactattaagtcacctatctttgaaaaataactaaataagtaatctaaacgggcattggtagttttaccacgaccgttttttattttatccagtaggcgatgtagccggttgatgtcttaagggaatatcaattgtctttttcggccggacgcgtattctggaattatgacttcgggggaagtcgaaaattattttggggagtcgtttggaaaatggaaaatgggctaacacaccgaaattggtggtatcaacaacttttcactaattggaaacggtttgagctggtttatgtggtgctgttgattttgttacagttagtggtttatttaatcgcacctgatagtcttattgggatggtttcagggatcggtggcgtattatgcttagtttatggcatgaaagggcgaaaaatttcatttattttcgggttcattcagtgtgtggtcatggcttacgttgcttggattagccatgcctacggatcatttgcaatggacctcatctacgtgatttcacagccgattggctggtacttatggggacgtgatgaggtaacccgggcctttacacgccagacgcgtcgttggctattcattggtgcatttatcgcctggttagttattttatcccagctgggtgggcagttgccctatttcgatgcaattaactttgtggtcagtttgattgcccaggtcctgtatatccttaaattccgtgagaattggtcgttgtggattgtggttaatattgccaacgttgtttactggggcgcgttgacaggacagaccttgttggggatgacggcagttgggactctgggagctaatctatcacaggtcgcactgcaaggagccttgttgtttaatgccgtttatgcgaccaaggtatgggccagtggcgcagcagaccacgagggtggtgcgggtcaataggttaaaaattccttctttcaaatcatttaaacgacagattacttgtgtttagtgtcgtttttggtagaattattttaataaaccccgagactggtttgaccaatggtggtgactaagtcgggaattgattgaaagaaggagcgtttcaatgaacaactatgatcagcaaccccgtacgacgattaacactgaggtcggcctcaacagctttctgaccaaaatgtttggctggatgggtgcggccgtgttggtctcagctgtagtcgcctattggatgtcaactcagatggcctttttacaaaccttaaagggtggcggtctgttgatcccaattattgtttggtttatcttaccgtttgtgattagcggacagtcgatgaaacgaccaaccgtggccttggttggactcttcgtgtatgcagtgattaccggtggcgttatttccttgtattcactggtttatacacaaacgtcaatggtggcggcctttgtttcaagtgcggcgatctttatcaccatggctggaattggggtctttaccaagcgagatttaagtaaaattgggacacaagcgacagccgctttaatcggtttgattgtcgcaatgattgtgaatatgtttttacgcagcgcgctaattgctttaatcttctccttcgttgccgtgattatctttgccgtattaacggcttgggatacgcaacggatgcagaaaatgtatttacagtacggcgatcaagtgtcaacgacagggttagccgttaatggtgccttgcaattgtacttggactttgttaacttgttcttacaactcttacaaatctttggaatttttggcggcgacaaccgttaaaactcataaaatagattaagttaagctctgttaagccacaatggctcgacagagctttttcttttgaaaaatagagtgcgttattaaaaggtggttcggcagctgacttgctaccgaaccacctcattatattgataatcgttaaaacacgttgcctatctagtcaagtgacgacaatgctgccgaatgctgttggtcagacggcatacatagattgagcaagatggcggcgattgccgctaccgcaattggcgaacccaataagtattgcaccaattggggtgattctttcgtcaccgttgcaggtaatagaaccaacgctaaggtgaggacgatggggagcccgatgacgtagagactgctttcgcctaaatctaggcgacgaatgacatttagtccatttaacataatggtgacacagataatggcgaaaaccccgccgatgaccggagccgggatagcggctagaaaggcagatagcttactgaaaaagccaagaatcatgaaccagataccggctgaaatgaagacccgtttactagccacgccagtaattgagatcacgccggcattggttgaatatccggttaccggtgtggcgcccaaaatggaagaaacaaagcagcttaagccttcaccaatgaggccgcgattccattggtttttggtcagttgatggttgataacggcacccatggcaaaccaggtaccggttgtttctgttgtcaaaacggcatagatgacgatgaatgtaataatagccgaaggtgagaaggtaataccaaagttaagtgcggttccttgaggaaaactgaaccagggtgcttgaatgactgttttccagtcgaaccgacccatggcagtggcgaccaaagtccccgtcagtaacgataagataatggcaccggttcggaagagacgttgaacgcgaggaaaccgaatactaattgaaatggcaactagaagtgttacggctgtgatgctggctaaaataatattctgattgatattaccgctggcttcaaaaatattactattcaatgcagaaggaattagtgacaaaccaacacaggtgatgatagtcccaccgacaatcgccggtaccagtttagcgatgattcggtgaaagacaccggttaaaccgagtgcaatcagtacgagggatccgactaacatggcaccaatcaacgtgcccataccaccatgattgacgccaccgctagcgagaacaattccggcagcagcgcccagcgggacaaatgacggcccttgggagatgggcatcttcatgaaccaacaggtctgaatgatggttccaatcccagcagcaagaaaggtggcctgtaataggctcatttgttgggctgctgacatcgctagtaaaccagccaggatgatgggcggcacgtaaacgtccatagcgaggacatgttgcaggcctaaaaatccggcggtccgggggttaacggcgtcatctggtccaacgagtaaacgattagaagttttcattaattgtggtctccttttagatgatgaacccgttgaccacgaacatagacggcttggatgtcagcgggggttgtatgatacatcagacgttcaaagatactgtcagcatcatttggcattaaggtagcatagcggtcgtgaacaacttgaaaatcggcggtatagctgggaattaactgaccagcttgcaggtgtaaactggtagcaccacccttggtggctaaataaaacgcggttgtggctgaaatacgactgtctttaacaccgcgtttttcagcaatccgggaagcatcgacgccatcttggcgcatctgcgatgccataacggcttgctgtaagttgcgataaagactaggcgtgaacccaccggacaagtcgctgcctaggccaactttaacgtcacgatgtagcgcctggtttaccggaaagacagcatttccaaaataagcattggaaatcgggcaatgggctacggcagtttgtcgttgatggaacaagtcaaggtcactagttgatagctgggtaccgtgagccatgacggatcgtgaggttagtaacccaaagtgatcgagaacttcggcgtcacgacggtggaagtgttcttgagcgtattgatcttcccaagtactttcactacagtgtgactgaatgggcagatcatagcgttgtgcgagttgacccaggccggttaaggccgctggggtgcaactagggacaaaccggggggtaatcaccggtgtcaccgctgcatgtcgttgtttggctaaggcctgaactgccatgacaaacttctcggttccgttaatggcatccgtcgccgatggggtccgataagtcgcaggggtttgatcgggattgtccatcacaacttgaccaatataaccgcgttgaccatagtctgcgcaggcacgagcgagttcgagattggcatcgtggtgaatggttccaaagtacagggcagttgtggtgccattagctaacagctcggggatgaggtgttggtaaacacgatgagcaaattgcgaatcggcgtaccgggcttcaagcggaaatgtataggtatttagccagtcatttagtggacggtcgagcgctaatcccgcttgtggccattgtggggcatgcacgtgtaggtcgataaatccgggcagtaaatacgtatgggcgggtaaaatttgtaaaatatcagccgcctgggctgcttgtcgaacagaggtgtaatcggcgtcgctcggacgaattaagcggtcgattagaccggtatggtccacggttagtagcgcattggactcgaaatgaacgtggtaggcatcttgaggtgaaaagctggcgccttgaaaaaccatctggatagtgatgacaactcaactcactttctctttgaataaaaatagaataacacgaaataaattgattttaaagttaaaaatagttcgcctttttattttaagataaattacaataacggtaaatcggtttatttatagataaatagcgaacaaggccggaaaaggttctgatgtttatgtagactaatcaatcgtagaaaaacggaataatcgagcaattagcgatttactatttcggattttccagtttttttggtaaaatagaaatagaatactcgaatacagctagctgcgttcgaaaggagcgaaacatggcggaaaaacgtttattattgattgatggaaacagtgtgacttttaaggcctttttcgcgttatataccgcattgggaaagtttaccaatagcgaaggactgcatacgaacgctatttatgggttcaataccatgttggaaacgatgttaaaagtggtacaaccaacccatgctttagtggcttttgatgctggtaaaacaacttttcggactaaaatgtatgacaattataaaggtggccgggcaaagacggcaccggaactttccgaacaatttccgtacgtgaaagagcttttggcggcacgtgggattcaaacttatgagttagccaattatgaagctgatgatatcatcggtaccttggctaaacaggcagaggaacagggatttaccacgactattgtgacgggtgaccgggatttgacccagttggctgatgatcatacgacagtttcaatttctaaaaaaggggttagcgaaattgaacactacacgcccgcctatgtaaaagaaaaaatgggggttacgccggctcagattattgatattaagggccttcaaggcgacaattccgataattatcccggagtgacaggggttgggcctaagcgagcagttgaattggttagcacctacggcagtatcgatggtatctacgatcatttggctgacatcacagctaagaaattaaaagagcatttgattgcagatcacgaccaagcgctgctagctaagcaattagcgaccatcaagcgcgatgcaccagtcgaaaaaacagtttctgaattggtttacaagggcgacgactatgatcaactggtgccgttttatcaaaagatgaactttaatcaatttctaagtaagatgagcattgatggtgaggctcccacggcaacaccagggctagaagaagtcacttatactgttttgacggcagacaatgtgactgaattgccatcttttaccgatggctgtgaattttatctagagatgcttgatgacaattatcatacagctgagttagttggttttgtgattggacataacgatcaatggtgggtgagtcgcgacacggcactccttcagcaagcccccttaaaaggcttattggaaaatgtggacattgccaaacaagtctttgatgcgaaacgaacttttgttgcgttgcaacgcttagccgtgactttaacgggtgtggattgtgatttgttgctggggtcatacttgttaaatacgtatgacaacagcaatgatttaggtcgacttgccatggaacacgggtaccatcaggtcgcaaccgacgaagatgtttatggtaaaggcgccaaggcggcaatcccagatgatgatgacgtgttctttagtcatttagcccgtaaagcccgggccattgaacaacttcgaccacagatttttaaagatcttgctgacaatgagcaaacagatctttaccgtgatattgagttgccaatggcatttgtgttggcacgaatggaagtagctggtattacggttgaggccagtgaattagaggctatgggcagcaagttcaccgaacagttggcggagatcgaacagactatttataacgaggcgggcgaagagtttaacattggttcacccaagcaattaggtcatattttatttgaaaagatgggtctacccgtaatcaagaagacaaagactgggtactcaacggcagtaggggtgcttgagaagttagccgctgaagcaccgattgctgagaatatcttgaagtatcgtaagattgccaagattcagtcgacctacgttgaaggcttattgaaggtcattcatccggacgaccacaaagtgcatacacgttatttgcagacgttaactcaaaccggtcgattatcttcggttgatccaaacttgcaaaatattccggtccgtaacgaagaaggacgagcgattcgtaaagcctttgtaccaagtcatccaggctgggaaatcttttcatctgactactcacaaattgaactgcgcgtgttggctcatatgagtcatgataagcaaatgcaagaagcctttcgtgagggacaggatattcatgcggcgacggcgcgacgaattttcaagatggggcctgacgaagaagttaccccgaatatccggcgacaagccaaggcggttaactttggtattgtatatggaatcagtgactttggcttgtcacaaaatatcggtatttctcgcaaacaggctaaggcttttatcgatacgtactttgaggagtatccgggggttaaggcctacacagagcggatggtccaacaggctcatgaattggggtatgtcgaaacgattgctcatcggcggcggtatttgccagacatcaactcacgtaacttcaatcagcggtcatttgctgagcggacagcgatgaatacaccaattcaggggagcgcggcagatattatcaaaattgccatgattcgaatggaacaggcactaaaggacatgcaggccacaatgctactgcaggttcatgatgaactgatctttgaagcccccgcaagtgagattgacaccttggcaaagctggttccgagtgtgatggattcggccattgagctagaaattccgttgaaagttgagagtcactatggaccaacttggtatgatgccaagtaagtggtaggaggagagaacagggatgccagaattacctgaagttgaaacggttcgacgcgggttgacgcgattggttcaaggggccactattgctcacgttgaggttcgttatccaaaaatggtcacacctgacgcggatgtctttaccgcggaattaatcagccggaaaattgagcggattgatcggcgaggaaaatacctgttattccgatttagtggtgacttaacgatggtgtcacacttgcgtatggaaggaaagtatgacgtccagccagaaggtagccccgtttccaagcatacgcatgtgatctttcatttaactgataatcgggagttgcgttataccgatacccggaagtttggccgaatgcaattagtgccgacgggcgaagaaacaacgctggccccctcattgggcaaattgggaccggaaccaacggcggagaccttaacgttagcgtatatggtcaaaatctttggtaagtcacataaagtggtgaagcctttcttattagatcagacgcgaattgctggattggggaatatctatgcagacgaggtcctgtggttatctaagattaatccactaacgccagtagatacgttaacgccgtctcaattgtcggagctacgccaaaatattattgatgagatggctttagccattggggggcatggcacgacagtccattcattttcgacagcgtttggtgaggctggtcagtttcaaaatcagttgcatgtctatggccgagaaggtgaaccgtgcgaacggtgtggaacagaattggttaagattaaggtggcccagcgtggcacgcatttctgcccgcactgccagccattaccaccagaagcaaaggtggcgttgattcatgactgaggtatggggattaacgggcggcattgccacggggaagtcgacggttagcgcgtggttacgcgcagccggggtaccggtgattgacgccgaccagattgcgcgacaagttgttgcaccgggaaccgcggggcttaaacaagttgtaacgacttttggggcagactatttacgtgatggtcagctagatcgcaagaagttgggccagtgggtcttttcgcgaccggccgagcttaagcgtttagaagcgattacaacaccgttaattcgtgctgaaattagccgacaagtcgcgaattaccgtcagcaagccgttccagtcgtggttattgatgcaccaacgctatttgaagctggctatgcgacgaccttggttgatcggattatggttgttgcaacagatgcgccgacacaaaaggcccggttaatggcgcgggataacttatcggctagcgatgcgcaaaatcggattgatcggcaatggccaatcgaccaaaagatcgcacaggctgatgtggtgattgataatggacggacaattgccgaaacacggcaacaagtggtaaaatggcttgacatgaataactttggaacaagtaaccatttaaaacgaggtgaccagtaatgcagtgtccacactgtcatcataatggatcgcgggtcgtggacagtcggcccacagacgacggtcgtgttattcgccgtcgtcgtgagtgtgagagctgcggctttcggttcacgacgtttgagcgagttgaagtcacaccgctgttagtaattaagaagaacggaacgcgtgaagaattcaatcgtgaaaaagttctgcgtggtattattcgctctgccgagaaacgaccggtggggatggatgtcatgacgcagattgttgatgaagttgagaataagattagggcgctaggtgttagtgaaatctctagccaactgattggtgaatatgtgatgaatcgattagtcgatgttgatgagatcgcttatatccgttttgccagtgtctaccggcagtttaaggataccggtgttttcttcaatgaattaaaagatatgcttgataaagataaattgaaagccaaaaaagaaacaaatgggaaaagcgaggcgaagtaaggcatggaggattcctggcaccaattgcagccaaagaccagttttttggttcgattggccgaccggctgaccgatcagagttggcaaacgctaacgcagctgtatcagccgatcatcggaccgagtgccgcggggctctactcggcccttttttggctacccaagacgggacagtatcaccggcacgcgacattgttggcgatattgaggatggatttggcacacctatatgacgcgcgtttacggttagaagcaaccggactgttaaccacgacggtgtccaccaaagatgatttgacgagttttaattatgatttgcacgcaccgttactccccgcagccttttttaaagacgacctcttaagcgttcaactgttgggggttgtgggtgaggatctttatcaatcactggtcagtgtcaatacgtcgaccactgaacggtcaactgatgaagaaaacattacgaagaactttttagaagtctttcatgtggatggtcaggagctcgcggaactaccaacagcgataacagcaggtcgtcagcgcttagatgctgaaacacaagcgacggcaccggcattgcaggtgacaccagcggactttgattttaaattactaggagaaattttagagcattcatttattgatacgcgggccttgcgaagtgagcgtcagttattattaacggagcatgccacctatggtttggatgaagtgacgatggcccgctatattggcgaagcaactgatctggctactaatcaattcaatgccgaaacgtttaaacgggtcattgcccaaaactttgggcgaccgcagtcagcgaaatcggtagcacaaccgcagaagacagcaacgacaccagctaatcagtcggttaattcggccgaacaggccttgattaaagtggcaactaatacggcaccggctgttttcttacaggccattaaacaaaagagtggtggctttgtaacggacggtgaacagcgaattgttcgtgatttagtgagtcgacaattatttccagaagccgttttaaatctgatggtctatcacgtcttggttgatgaggatcgaccaaccctgaataagaatctgttagacactattgctaatgactggagcaaggctaaaattacgactccggagcaggctatccaaaaaatccgggagcgtcagcaggcagctaagcagcctcgccggtcacgagcccggcaatcatcgacagtcaaggagacgttaccagagtgggcaaagacatcgacaaccaatcaacaggcctcacggacgaagctgtcagcagaaaaacaaaaacaattacaagaccgaattgctaaattgcaagatcggccgtcaacaggaaaggaggactaaccgatggaagatttaggtaagacgatgcagcaattgatgagtcagcagcaccttaatgataattatcgccagctgatggctgaagtctatgatgatccgttagtgcggcaattttatgaggcccatcaggcagaattggcggatgatgttttgacccgttcagcagctaagctttatgagtttgtttctgaacgggaaaaattggctaagggcggtgcgacgtttgccactggttacgagccacaattggttgtgtccaatcacttgattgacgtagcttatgtgccaactgcagaaacacaggagaaacaagctgagcaacgattgcgacagcgggtcaaatcaattgctatgcccaaaagcattcgtgaggcgacattgaaggcgttcgatcaggactcagatcgggcggaagccctaatggctgctctggatttcattgatgcctatgaggctagtcccaaacgccgtcatcaagctctgtatttgtcaggaagctttggtgttggtaaaacatacttgctggcggccgtggccaatcagttagccgccgatgggttttcaacgactctggttcattttcctagttttgccgttgaaatgaaaaatgcgattgcccaaaatggggtggcagaaaagctggatgcactgaagaaggctaaagttctgatgattgacgatattggtgcggatgccatgtctgcttgggtacgtgatgatgtgttgggtgtgattctcgaatatcgtatgcaagaggaacttcccacatttttcagttcgaacttttcaatggcccaattggaaaatgaacatttgcgaatctcaactcggggcgacgatgagccgttgaaagcacaacgattgatgcaacgaattcggtttttagcccgggaagttacgatggttggggtcaatcgtcgaccacaataattcagggttatgcttgacaagctcgcgttacgagtgtttaatagtctttgaaaccaaaagagctatgacgaaagacatggtgttaccggagttcgtttacaggaagagttggcctagcttggaagccacttagcgcccggaagcattaccactttcttagctgttggaaggaaatttccgaccggtccgttccgttaacgacgactagagttcacgggagtagtctcgtgaaaaatatcgggtggaaccacgttattgacgtccccagtgccttttagaggtgctggggactttttgtgtttttcgcctaaaaaaataagggagatcgagaattatggcagatatttcaattaagttccctgatggtgctgttaaggcctttccagccggaactacaccagcagacgttgcaaagtccatttcgattagtttagccaagaaggcggttgccgctaagttagatggccaattggtcgactacttaacgccattagcaagtgatggcagcatcgaaattgttacgaaagatagtgatgatggactgaccgtattgcggaacacaacggctgctttactgcggattgccttaaagaaggaatttccagctattcgcttgggcaaagtcagtgctgatgaagatggcttctttgtggataccgataaagatgaccaacaagtcagtgttgatgagttagatgccttagcggtaatcgttgaaaaattagtcagtgataaattagacattgaacgtatcacggttagcaaagccgacgccttagctgatgcgaaggacgatcagttcacgacagcgttgattaatgcggttgatggcgatagtgtaccattcttaaagattggtgactaccaaattcttagtgatggggcacagttgaccaataccggtgatgttaagaaatttaagttgttatcagttgctggtgcctactggcaaggtaagtcttcaaatccaatgctacaacggatctatgggacagccttctacaaacaagctgacttggatgccgatcttgctcgtcgccaagaagcgcgtgaacgtgatcaccgagtaatcgggaatcaattagacttgttctttgttgatcccaaggttggtgctggtttgccatactggatgccaaacggggccacgattcggcggacgattgaacgttacatcattgataaggaagtttccaatgggtatcaacacgtttacacaccagtcttagctaacttggatctgtacaagcaatctggtcactgggcacactaccgagaagacatgttcccaccaatggacatgggtgatggtgaaatgcttgaattacggccaatgaactgcccaagtcatattcaagtttacaatcaccacattcggtcttaccgtgaattacctttacggattgctgaattagggatgatgcaccgttacgaaaaatcaggtgctttgagtggcttgcaacgggttcgggaaatgaccttaaatgatggtcacacgttcgtagccccagaacaaattcaagatgaatttaagagtatcttggacttgatggttaaggtttacgctgactttgacatcaaggactacacgttccgtttgagctaccgtgatcctaagaacacggaaaagtactttgatgatgacgaaatgtggaacaacgcccaagctatgttgaaaggtgctatggatgacctaggcttaccatatgttgaagctgaaggggaagctgccttctacggtcctaaactggatgtgcaaacaaagacggcactgggtaacgaagaaacgttatcaaccattcaattggacttcatgttaccagaacggtttgacttacattatgtcggtgctgatggcgaagaacaccgtccagtgatgattcaccgtggcttggtttccacgatggaacgtttcacggcttacctgacagaaatttacaagggcgctttcccaacttggttagcacctaagcaagtgacgattatcccagtttctgaagaaaagcatggcgcttatgccgataagttagctgctgagttaaaagctgctgatattcgggttaatgttgacaagcggggcgaaaagatgggttacctgattcgcgatgcgcaaactcacaagattccatacaccttagttgttggtgaagatgaaatgagtaacggtagtgtctccgttcggaagtacggcgaaaaccaaacaacgtcaatgagtagtgatgcctttgttaaggagatcttagcggatattgcgtcttacagtcgcgaaaacgactaatacgagtatttgctaaatagcattgacaaggcagtgcttggctggtatgatggttaagttgagaaattaagcagaggcttccgcttctcgccttatgactaacgttattgggctggatatgcacgttaatgtcgtcttcgtgatgacatttcttgcgggagccgtttgattctgatcaaaggttcccgcattttttgtgagtgagatttctgcagttctcgagattattttggaggtggattaccatagcaaatgacacgattgtcaacgaggggattcgcgcacgcgaagttcgattgattgccagtgatggtgaacaattgggcatcaagagtaagcaagaagctttgcagattgctgaagacgctaacctcgatgtagttttggttgcaccgaaagctaagccaccagtagcccggatcatggactacgggaagtaccggttcgagttgcaaaagaagcaacgcgaagctcggaaaaagcaaaaagtggtcagtgttaaggaagtgcgcttgagcccaaccattgataccaatgactttaacaccaagctgaagaacgctaagaagttcttggctaagggtgaaaaggttcgggtttcaatccggtttaagggacgggccattacccataaagacattggtcgcgaggtgcttaatcggatggcagctgaaacagctgatgttgccacggttgaacaacgaccaaagatggacggtcgtagcatgttcctgatgctctcgcctatcgctgagaataagtagaattgattgggtagcttaagctaccgatttaaggaggatatttcgtattatgccaaagatgaagactaaccgcgctgcagctaagcgtttcaaagtaactgctaagggcggtatcaagagtgccaacgcatacacgtctcaccgtttccacggtaagaccaagaagcaacgccggaaccttcgtggtacccggatgatgaacgaaacgactattaagacttaccacgaattattacaaaagtaagctagtcactaatttttcgggtcgacgaaatgtcgacataatgtttgaattgatttaggaggaaaagattatgccacgagttaaaggcggtactgttacacgcgcacgtcgtaaaaaggttttaaagttagctaagggttaccgtggttctaagcaccgtttattcaaggttgctaaggatcaagttatgaaggggcgtcaatacgcattccgtgaccggaaagcgactaagcgtaacttccgtaagttatggattgcccggatcaacgccgcagcccggatgaatggtctgagctacagcaagttgatgcacggcttgaagttggctaacattgacgttaaccggaagatgttagctgatttagcagttaacgatgctgctgcatttgctgctttagctgaacaagctaagacggctttagctgcttaattttaaattaattgtggagcttgttctctgcaggataaaaacgagcatgccgattctagggttctgctcgtttttttacatagttttttatttgtaagtgatcaaattctgcaggtcgaatggggctaatctgctgaaaaaatagaaagctgttttatgactaagcgttgtaaactgctaggatgttttggataaggccaatctttatcggtcttccgagtggtaaaattacgcagaattgcgtataatagtatgctagacatgccaaggatggcaaaaaaacgaaggggggctgtcacccgcatggtttctcaattcaaaccaacgtggatggttaaaaatatttatgatttgactccggcacaactgcgtgccaacggcatcaaagtgattttaacggatctcgataatacgttaattgcgtggaacaatcctgatgggacaccggagctacggcattggctaaccttattggagttggcagggattcgagtaattgtcgtgtcaaataacaaccgtaagcgggttgatcgtgcggtggcaccttttaacttggattatattcaccgggcactaaagccattatcatgggggattttgcgggcgttacggcgttggcatctgaaccgtgatgaagtcgtcatggttggtgatcagcttttgacggatgtttgggcggctcaccacagtggcgtacgcagtgtcttagtcaagccgattttaaagtcggatgcgtgggtgaccaagggtaatcgtttaatggaaaaggtagtcatgtggcggttgcgtcacaactatccagaattaacttggcaggaggatcttgatgaacgaaaagcacattgaacctgttttgattgatggtgaaccacttcattgtattggctgtggcgccaccattcagacgactgatccaacagcaccagggtatacgccacagtcggcgttggataagggaattgaaaagcaagaggtctattgtcaacgctgtttccgattgcggcactacaatgaaattgtgcccgttggtttaacggatgacgattttttgaatttgttaacccaaattcaagatgctaacgccttgattgtttatgtcgttgatatctttgattttaacggtagtgtgattcccggtttgcaccgatttgtgggtgataatccgattttactggtgggtaacaaagaagatttgctaccacgctcactgaggcgcagtaagctacgtgactggttgcgtcaacgggcaaatgaagctgggttgcggccaattgatgtgacattattaagtgctaagaccaaccagtccgtcgatggcttattacaattgattgataagtatcgcggagaccgagatgtctacgtggttggtgtgacgaacgtcggtaaatccacgctgattaatcaaattattcggcaaaatactggggtaaaagatttgatcaccacttctaagttccctggaaccacgctagataagattgaattgccgttagacgatgaccatgttttggtggatacaccagggatcattcaaaatcagcagatggcccacttcttaaccgggaaagacttaaagatcgtgacgccacaaaagcaggttaagccgaaaaattaccagctaaatgatcagcagacgttgtttttaggcggggttgcccgatttgattttaataagggtcctaagtcagggtttacagcatactttgaaaacaatctgtacattcatcggacgaagttagaaaatgctgatgatttttatgcgcgtcagttgggacagttattgacgccaccacaagcagtggacaaagatgatttcccaccattagtcgctcatgaattcaagacgaccgcgaagagcgatttggtctttgaaggcttgggttggattacggttcctgccgggattaatgtgaccggttgggcacctgctggtgttggtgttttaattcgtcacgcaatgatttaaattggaggataacaatttgttacgagggaaacaaaagcgctatttacgcgctcatgcgcacgtgatgcgtccattattttcagtcggtaagaatggtttaaccacggtttggttggaccaattaaccggtgcgctagaaaagcgcgaactgattaaaattaatttacaacaaagtgctgacgtcacagttgctgagactaaggcgttcattgaagataatacggatattcaagtggttcaaacgattggtcgtgtgctggttttgtaccgggtcgcaaccgacgaagataatcaaaagatttcaccaattgtggaaaacatgtagggaggtctaagtcgtggtaaaaattctggaacgaacgagtacgcaagtcgcaacggagatggccgcgacggccaaaaaacggcggattggtattcttggtggcacctttaatccaccacatctgggtcacctcgtgattgcagatcaagttgccacccagctagggttggaccgtgtcttatttatgccggatgcggaacccccacatgtcgatcgaaaattgaccattcctgccgcagaccgggtagccatggttaaagcagcgattaaagacaatccacgttttgacttggagttaacggaggttgaacgtggtggtcggagctatagttacgatacgatgttgcaattgacacaagcccaccccgaaaatcaatattatttcattattggtggggacatggttgcctatttaccaaaatggtaccgaattgatgaactggtaaagctggttcaattcgttggggtttgccgtcaaggatttacccacgcgtcgccgtatcctgttttgtgggtggacgtcccacagattggaattagttccacgatgattcgcgatcaagttcgccgtgggcagtccattcgttatctggttccaaccatggttgatctttatataaaggagcatctgttatatcgtgactgaactgaattatcaagaacatatttttccgggtacccgcgagcaactagtggccaagctggagcaagcgttgaagccacatcggtttcggcatgttttgcgggtcgaacaaacggctattcaattggctacagctaaccaagtggatgtggaaaaagccagtattgccggtttagtccatgattatgccaaacaacggccagatgaagattttattgccgccattcaacgttatcatttagatcccatgctgttggactatggaaatgccatttggcatggcgttgttggtgctgaattaattaaacatgaactacaaatttttgatgaggatattttgaatgcggtgcgccatcatacaaccggtgcggtttacatgtcgccattagaacaagttatctatatggcagactatattgaacctaaacgtgactttcctggcgttgacgaagctcggaaagtcacagcggctgatttagctaaaggtgtggcgtttcaagcaaaacagacgttgcagtatttggtgactaattgcaagccggtttatccgaagtcgattgacacttataacgcgtggatttcccgttagttgtaagtgcgagaggagaaaatgcatggaaagcaaagagattttagaaattgccgtaaaggcagctgaaaacaagcgagcagaggacttaactgccttagatatgaccaaggtgagtttaatggccgactacttcttaatcatggaggctaactctagccgtcaaattcaagcgattgccgatgaaattacggatcagatggccgctaacggcgttaagatgcgcgatgttgaaggtaagaatgaggccaactggattttaattgatttaggcgacgttgtggttcacgtcttccaaaaagaacaacggagtcattacaatttggaaaaattgtggtctgatgccccaacggttgatttaggtcagtgggttgaagcatgatttatcaatcatttgctgagctttacgatgaactttttgatccagccatgtatgaccagtggctggattttgtgaccgaccgtgttgatcctactagcggcgaactattagacttggcttgtggtagtggtcggttgggcgtgctacttgccgaacatgggtatcaagtcagtggcttggacctcagtgaagagatgttggccttggcagctaagcatgccgaggaagcggatgttgctttgccgttagtggctggtgatatgctggacctcagtgtgttgggtgagtatcagacggtgacgtgctttgccgattcgttctgttatttaccggacttgacggcggtgacgcaagcctttacacaggtgcacgaccatttggcggttgggggacaatttctgtttgatgtgattacgccccaccaaacagatgacgtctacccagggtacatgtataactatgtcgatgacacccgagcctttgtttggacgagttatggaattgaagacgagacccatgcggctgaacacgatttgacattctttacgcaaaaccctaagacgggtgaatatcgaaaggtgacagaactgcatcatgaacggacctatccgttagctgactatcaggcggccctcaagcaggctggcttaacgttgaaacgggtaagcaccgacttcggtgcgaatgaagttactagcgaaacgacccggtggttctttgaggtaacacgggaggcttaatatgacacttcaagcagcggggattgtggcagaatacaatccctttcacaatggtcatgcctatcagattgcacaagcacgacaaaaaacgggtgctgacgtgattgtggccgcaatgagtggtaattgggttcaacgcggagagccagcgattatggataagtggcagcggactgaagcggcacttgctggtggcgtcgacctcgttgttgaactgtcgggtgctgcggcgctacaaccagcccacttatttgctcaaggagccgtggcggttttggctgctttgaaatgtcagtggcttgtttttggcaccgaacatccggatatggattatgattgcctgatgtcccatttgccgagtgatccagcgacctttaaacgatttgatcagacgtatgcctcactatttcaaggctatttgcgggagcaaacggggattacgctgagtgcggcaaatgatattcttggcttcttctacgccgtggctaatcagcagcaaggacaacccttacagttggtgccattagcacgacgggggagtcaacataatgacactgcagtcatgcaaggtacaaactacgccagtgcaaccgcaattcgtgcggcctccttggctggtgattgggcgacggttcagccagttgtgccggccaagacgttggcattattgcagcaagaatcattaataagctgggccgatttttggccattactccgatatcagttgattagtgcccccgttacggatatgcggcaacgttatcaaataacggagggcgttgaatatcgcttgaagcgagcagctttagaagcaacaacgtttgcggattttatgcgtatcgtaaaaaccaaacggtatacgtatacgcgacttcaacggcaagccgcttatctactgttacaggcactgcccgaggagatgcggccacagccgcaatatttgcgggttctcggctattccaagcaagggcaggcctacttacaccagattaagaaacacgtcgccttaccgctcgttagtcgggcaaatcgggattggcagaagggcgttgggtcccttgacgatcggttgggggcactccgaactttggtgacgggaattccacaagattatggccggattcccataaaaaaaccggattctgagtgactatcaaggaaattaccttgacatcacattttttgacaggtataatttatcacgttgcattggagggattacgatgaaatggtcgttgaccgagctgcggaagaaccatcgcagtgagccgcttttgttcgatgaaacactcgatttgaaggcggatttaatggcgcgttatggcgacgaggtcttagacttaagtcccgttcacgtgacgggcacagtgtccgtcattgacggtggcgacgtcgtcgtaacagcacaggtaattgcggatttgacggtaccatctagccgatctttggcaccggtagatttacccgtcaacttcagtatgacggaattttatgtgtctgacccagccgcaacgcaacggtttgaaaaaactgacgttgtgatggtcgtttccgatgaccaagttgttttagacaaagctgttggggataacattattctacaaattccgatgcacattctttctgacgctgaaaagcaaggcgaagcgatgcctgccggtcaagactggcaagttgttgcagaagctgacttagaagccgttgagaaagaaaatcaaccagttgatccacgtcttgcaaagttaaaagatttcttccctgatcaggatgatcaataatcgcctttgtgagccttaaaaattttttcactagtggatataatttatttaaaggaggtgttttctttggctgtaccagcacggaaaacgtctaagacgaaaaagcgtatgcgtcggggtcacattaagttggctaccctgaacttagcaccatgtccaaactgtggtgaattacggaagtctcacgtagtttgcccaagttgtggtttctacgatggccgtcaggtcgttgcggttaagaacgcaaacaactaaatcgatgaaaagctcctatgaagtccgcggcttctaggagcttttttgtgtttccaataaaatcgcgtataatgaaacgacaaggattaacgaaggagtgaaattgtggcaatgaaattaatcgcgactgatttgaacgggacgttgttgcatcaagatcagggatttaatcaacctttgctcaaagaaacgctgtcgcaattaaagcagcgagggataagactcgtgttggcttctggtaaccaatacgcccatttgaaagaggtctttagagaaatctggtccacagatctggcggtgattgctgaaaacggggcttcaatttatctgggtgatgagctagtctttgatggaagtctgacaccccagcaagtccggctgttcttgtcggccacggcacaagatgagtttttgcagaatgcctatttgattttagtcggcgcacaaggttcttatacaagggttggggcaccagcaccactaattgcagccgcggaaaagttctacgaccatctgcaacaggtgatgtccctcgaaaccgtcaccgatcgtattaaaaaaattagtgtctccacagcgcctgaacaggccgccgcgctagttcagcacttaaaccagcggttcgcgggtcaattaagggcccatgacagtggttatggtgtcattgatgtcgtcagtttacacgtcggtaagttaccagccgttcaatggttggctcagcattggcagattccggctactgagattgttgcatttggtgatggtgccaatgacgtgccgctattaaactatgcagggcaaagctacgccatgaagaatgcacccgtcgatattcaggcgcaggctaagcacgttaccgtttgggacaacgatcgtgatggggtactccgtacaattgctgccttgttagttgcagactagagaggagcaccacaatgcccgttaacgatgcaatcttagcggaagccgttaagatctataaagtattgagtaacatgaaccgaatcaagattctttatttcttggagaatcacgaggctaacgtgtcgagtattgttgatcacgttcagttgtcacagccaattgtgtctcaccagttggcgattctctatcactatcaattggtgacacgtcacaagcgcggtaagcatgtctactattgtttggatgatccccacattcttgagatggttgatgcaatgctgggacatgtctctcatgagatcaaaggagaaccgcatcacgattaaacagacggtcggactaacttagtcgcgaccgttttttattggcgtggtaaatcctatcatgacatgactgacaattatcgaaagtgaaagaagtctagtgcgtttgagcagtcagttattaaaaaaacgtagcatttcaagaattccaggcgttttagtggcttctaatgaatgggaccagtaaactaaccctaatcattcaaaataggagcaaaaataatgcgcaaatttttgggttttctgttcttgctggcgctaggagcctgctttttcttaccccaagtacaaactgaattgccaaagattctaaaacaatcgcagttgaccgttgcccaagcggctaaaaacgtcggggttcagttgccgctggtcggccgacaagaggcggctggtgccacgccagtcgagtcgattgtgcgtccgcaaacgttaaagaaaacgtattattatcgtttttcggcggatgttccagtaaaagttcaacaggtatttgaacgggccatcgctgtttataatgagaccggtattgttgacttagtggcaggtcaggccactgctgagcaaaatgagattacgatttttgtttatcagaaaacgatgacggctaaacaagttaattatttagaattaggtaagggtgggccggaaatccagcaattaacgggacttcaaggctacacggctaatcatgcacgtgccgggctaaacgtgaagtatggtcaaagtattaaggaatctgtggcgatccacgaattgggccacgcattaggactcgatcacagttcgagtcggcaatcagtgatgtatccaattgatcaggggctaacccaactttctgctggtgatttaaaggcactgaagtatttgtattaggatgccgcgtaaaaaaggccacgacacgtcattatcttttgaggaccgacaactaaaaaaacaattctgaaaatgactttttcagaattgctttttttaattcaaatattaatttaagtcgaaattacttcgtgaaatcaacgaccattcggccaacgatttggttattcttcatttcgtcaatgatatcgttaacttcgtctaaacgacgggtcttaacgattgggtgaaccttgccttcagcaccaaattggaaagtttcggcaagatcttgacgagttccaaccagtgaaccgcgaacggaaataccatccaagacggtcttggcaatgtttaattccatgtcgccttgaggaagggcaacggcaactaatttaccatctggcttcaaggcgttaacagattgtgtaaaggcatccttgttaacagcagttacttgcgcgttgtccacgccaccgaccttttcttgaatctgttcggcgacattaccgtcatgccggttgattaatacttcagcaccattagccttagcagcagctaacttatcagggttaccatcaacggcaacgacgtgggcgccaaagacattgtgagcgtattgaatagccaggttacctaagccaccggcaccaacaacttccacccattgaccaggcttagtttcgccgactttcaaggctttgtacatggttacacccgcacaagttaatgaagtggcttcaattgggtccaaaccttctggaaccttaacggcgtagttggcatcaacaatacattcttcagccatcgcaccatcaactgtgaaaccagagttttgaacattccgacaaagcgtttcgcgaccggttaggcaatattcacaatggccacaacccttaaagaaccaggcaacggaaacccggtcgccaatcttcaagttatcgacgtcgtcagcgacttgaatgactttaccaacaccttcatggccgataatccgaccaggttgcttaccgaagtctccggcagccacatgtaagtcggtgtgacataacccacaatattccattttaactaaagcttcaccgtgagtaattgggcggagcgtaacatctttaatatcaacgtaaccgtcaactgaatcgcgaataactgctgctttcatgaaaaaaactccttttcttttcgtctacaagaatcagtatactgcaaaggaagtaatattcaagtgaaattttgcacaaaaagtattacgtttttcctaagattaattagaaaagcttatataacagcaattattggttgatttgaaaagtatataaatgtgaagcaaatgattaatcgctttttcagaagcaattttatcattcgaatgcaaccggttgttaatttttcaaaagacagcgactaacagtgctgaataggtaatgtttcagttaaatgtgagtgggtagggagttttggcatacaattatgagaaaatatgataaaattaaatgttgaaatgagaatcggacgtccgttgttagtgttttttgctgacagtgggtgccgcgaattagccagaggagttaacgtgtaatgagccgaattttaattattgaagatgaaaaaaacctagcccggttcgttgaactggagttaaagcatgaagggtacgaaaccaacgtgcagtttaatggtcgaaccggcctggaagcagccttgtcacaggattttgatgtgattttgctagacctaatgttgcctgaattgaatgggatcgaagttgctcgccgcgtgcgtgaggttaagagtacgccaatcattatgatgacggcgcgtgattctgtgattgatcgggtttctggattagatcatggcgcagacgactatatcgttaagccatttgcaattgaagaactgttagcgcgtgttcgggcgctattgcggcgaattcacctagagggtgagcagaagagtaccaaacagacgacggttaagttcaaggatcttacaattgaaaaggaaaaccgcatcgtacgtcggggcgacgaagtcattaacctgactaaacgcgaatatgaattgttattagccttgatggagaatatcaatgttgttttggcgcgagatgtcctgttaaccaaagtgtggggttatgaatcagaagtagaaaccaacgtggttgatgtctacgtgcggtatcttcgcaataaaattgatgttcctggccagaagagctacattcaaacggtccgtggaacagggtacgtgatgcggtcgtgacccaaaccgataaaacccctgagttaactggtgatagtgttgcgcctaagaaggccgggtttcggttttctttgaagtgggagtgggcgctatcaacagcatttggtgttttggttatttttgctgcgattgtttttttgatttttaacagctttatgacggtgttgatgcgtcaggaaaaaactcacgtatcggacacactgaacgttgttgtagaaaagttgaacagtcaaaaacaactgacaagtactaatgttaaccagctgttgcgtccccaagcagttgtgtcagcgaccaagcagccgacgccctataacaatgccgtgattgctagtttagcccgtgatagtcaggccgtaacggtttatgataccgatggacagtcactctttgcgacacggcaaggggatgtctcattccggcgggctagtaaacagtcaatttctactcagacggtgtctggtcgcaagaatttagtgggacggtcaccaattcgagctaagcaaggtaatcgcattttgggctatgttcaagtgacagataacttgcgagattatcgtgccacgcaagtcaaattgttacaggttgaggtggtcttagggctgatggcgggcttagccgctgcagtgctgagctatagtctagcaacctttttactacggccagttgaagaaattcgggagacaattcacgcggtacgtgaagatccacaaacagataagcgagtgcccgagatgcatcatcaagatgagctaagtgatctaggtagcttgtttaatgacatgctggatacgacacagcgctatatggatcagcagcaacaatttgtggaagatgtctcgcacgagttacgaaccccagtggcgatcattcagggacacatggagatgttggatcgttggggtaaggaagatccagaagttttggatgagtcgatcaaggcctcgttacaagaaaccaagcgtatgaagagtttggttcaagagatgctggatctccaacgagcggaacaaattgaggttaattaccctaatgaagtgacggatgtcagcgaagtggttgagcaggtcttcgataatttcaagatgatccacccggattatgtgtttatcttggatgatgacgttcaccaaccactacaggcgcaaatttatcggaatcatttggaacagattcttattattttgatggataatgcggttaagtactcacaaacacgtaaggaagttcatctgacgtacgaaagtgacttgcgaaaccttgaagtggccgttcaggacttcggtgagggcatttcgcaagagaatcgcaagcgggtttttaatcgtttctatcgtgtagataaggcgcgttcccgcaccaaagggggcaatggcctcggcttagcgattgccaaacggttaatcgaagcttaccatggccgaatcacaattgagagtgctttggggcatgggtctgttttccgaatttcattaccaatcttgtcaccggaagcggcacaggcgcttaatgctaaaaaagaacaaacgcaagcggccaatgacattccaggaatccaatcagaattgttagtggacgacagcgaggattcaacgaaatctgaataaaataaaaaatccggtttgagtttagttgacttaaatcggattttttatacgataaaatcgtaaagagattgacaggtaatgacgattcaagtatgctgttaacaacaagttagttactatagtaactaactaaatagggggagctgctatgaaattagtcaaaggctttttgtggttactggtcggtgccgtggtcgttgttgggggaagtttgttttggttaccacaatttacgaagaataagcattcagaattggtaatggctttggataatgttaatccggtggttaaaccggaaacggtttatgcactcaccacgacaaagccagttcgtcagtttactgggggtgctggtgaaaaggaatacacttatcgattaacaacctataatgatcgaggacagacccgtattgtaatgttcgatgcccaatggcggttaaaaccacaacgttttttgaaaattaagacgaaaggccaaaatgttgagtcttggacagcaacggcgcgacaagaagtcccaagtgtgttcgacaaaatctgttaatgagctagtgtttaagcttgttgttactaacaatcgttgtattggcgaatggctggggatcagatttaatgcctttgaaatggcttattgttattaacaatcatatcagaaagaataaaaaagatcgtcgacaaaaagtcggcgatctttttttgattatcgatgacgctgttgttttccggcgttacgattacgatttttttgactaactggtttgggggttgtgactgtcggtgttggcttgacgacaggtgcaacaaccggagccggttggtctttcatcttttccttaatctcgcgacgaattcgtggtcgatagaaattgatgatcaatgtttgtagacaggcaaacaacccaccaacgaagaagtataagccaagaccagctggagaactcattgtgaagaagagaatcatgactggtgatagcaataatgtcatgcgcatttgtttcttttgatcttctggcatccccaacatggacaagtatccttgtagtaggtaagagaggaaagacaataatgcaagaatccagctagattttcctaatggaattcctaagaaaacagtgttggacagttctggtgagtaccggatagctgcatatagtgcggcgaagatcggcatctggatcagaagcggtaagcagccaattccaccggtcatgctaatgccattgttacgatacaaagccatcatagcctgactggcagcctgctgttcttccggtgtcttagcagctttttgttgcttctgtaaggcggtcatctgtggccggatcattgagatcttttcctgctgaacggtagcacttcgcatttgacgaaccatgattggcaataagaccattcgtacaatcacggttaagataataatggcccaaccatagctaccgccaaagatgtgggcgagccaatccatcacgtgttgtccaggtacggccagataatcgtaaacgaagccataaggtttaccattcttggtttgcacacagccactcaagaagagggccatggccgccaaggcggtcgtaaccgtaacttttttggagattttcatatgttgttttgaacccctttaaataacgatgtagagcctaattgctcccagcggcgcgaacgccgttaacatcaaacatcttacttgatttaccggccattttcaaataataatccggaagtcggcaaattggtgggttgggattgagtgggttgtcagcgtcatcacgttaatccagggggataagccatgtttgagctgctgacagaattgttgtagggttgcagattcaccagtggcaatgatttcaacttgtccgttagcgagattgcggacagtaccggttagcgtcagctgtttggctagtcgtgtggccgaccagcggaacccaacgccttgcacttgaccactgaccagaattttttgtgtttccataagacgatgccctcccgattaaaaatgcgtttatctcattatacaactgccggttattgatcggatatggtaaactagatgaaataacttaaagcgagggactatcgtgaaagaaaaaattacgtctagtcaaaataggcgcgtcaaggaatggcgatccttagccagcaaaaaagggcgtaaggccacacggacttatttattggaaagttggcatcttgttcaagaggctattaaggcgcaacaacctttaacggcaattatggggactgctgagcagttaagtgcccatgcagatagcttgcctactgacgttcccatttacgaactaacggatagtctggctaagacaattggggatactggcacgcctcagggcatttttgcgacggctccgatgccagatgagactgcaattgatcctaaaactgcgacgggggcttggctgtttctagactacgtacaagaccctggtaatattggaacgatggtgcggacagccgacgctgcgggcctaaccggcgttgtgtttggaaagggaaccgccagccgtttcttgcccaaggttttacgagccatgcagggaagtcagtttcacattcaattggtagaggccgatttacatgattggattggcgcttttacagcccgacaattgccagtgtacggaactaatttagatccacaggcgcaagactatcgtgacgtgccagctttaacgaatggtgcgattgtcatgggcaatgagggcaacggtatggcaccagacttgcaacgtttaacgacacaaaatctatatatccctattaaaggacaggcagagtccttaaatgttgccgtggctgccggtgttgtgatgtttcgattagtgggttaatcataaagaaaaggtaaacccgatgagaaataggccattttggttgcattttgtctaaaagacagtatgatatagggtaattgagagactgaaaatcataattttaatgaaaaggaagcattctatgaccaaacttacttggcgtgatgaccccgagtaccttgctttagtttctgacttgttggcaaaggagccggtccaacgcctggcgaattacacccagcatcatcactctaaccgattggatcactccatttcggtatcgtataatagttatttagttgcgaagaaacttggtttgaatacccgggccactgcacggggtgggttattacacgatttgttttattatgattggcgaacgacgaagtttaatttaggctcgcatgcgtttattcatcctcgggttgccttacgcaatgccgaaaagttaacggatctaagccctatggaaaaggatattatccttaaacacatgtggggagcgacgctggcgatgccgaagtatcgagaaagcgcgattgtatcgttggtggatgattatgaagctgtttacgaattctgtggaccagcccgtaagcgaatggaagccttgatggacaaggtaacgcctaacgcctagtttccaaggaatctggatgggaggcaagacaaatatgcaaatgatgtcaaaaaagacgacagaagcaccagacacggctatcgattttgaattgtgcccccgctttgaacaaactttttcctttttgggaaagaagtggaatggcttgattatcgatgtcctcttgcatgaaggaccacaacggtttcgggatttagcgcgaaacgtgccgcgatgcagtgatcgagtgctggttgagcgactaaaggaattagaggataacggtgtcattttacgccgaacttttcctgatagttccttgattgaatatgagttaactaagaagggccaagaatttgctcccgtgatggcggcggttcatgcttggtctgacaagtggtcttgtccgcttgaggagaaccagaagtagttgacttctgcggccaaatccgctaggctaattgaagtaatagttaaaaacgatgatagaaaagtagtaaccggaacggtttgtcaggaagagtctgcctagactgtgagcagacttcaaagcgataggtgaattcagttcttgagttgtcgccaggacgcaacttagttgttgtgaaaaggtgttccggtacgtgaccgttatcacgactgagtgtggttggggatgaaatccctaactgaatcagggtggtaccgcgatgcttcgtccctagttttaggacggagcttttttatttgtctaaaaagtaagttagaaatggaggatgacgttatgtcgttgagagataaattaaacgaactgcatgaacgtgggttagccgagattcaaaaatcgactgacctaaaagacgtcaatcaagtgcgggtatcgttattaggtaaaaagggtccaattaccgaggtgttgcgtggtatgcgggatttagacgctgaagaacgacctaaggttggtgcttttgccaacgaaattcgggatgacttaacggcagcattgactaaacggcgagaagaattggaaaatgccgtactaaatgcccgtctggctaaggaagctatcgatgttaccttgccaggcacgccggttgctaaaggtgagccgcacgttattcagcaaatcattgatcaaattgaggacctcttcttgggaatgggttatcaagtgctgagcggtccagaagttgaagaggacaagtataattttgaaatgatgaacttgcctaagaaccatccagcacgggatatgcaggatacgttctacattaccaaggaaattttgatgcggacgcagacctcaccaatgcaggcccggacgttggaaaagcatgactttagtcagggaccattaaagatgatctctccaggcgttgtctatcggcgagatacggatgatccgacccattcacatcaattccatcaggtcgaaggcttagtgattgataagcatattacgatggctgatttaaagggaacgctccaggttttggcccacgaactatttggtgataagtttgacgtgcggttacggccaagctatttcccatttacggagccttctgtggaagccgatattacctgttttaattgtggtggaaagggttgtaacgtttgcaaaaacactggttggattgaagtgttaggtgctggtatggtgcaccctaatgtcttaaagatggccggcgttgatccagatgtatatggtggttttgcctttggggttggtcccgatcggtttgccatgctgaagtacggggttgatgatatccgtaacttctatttaaatgatgttcgtttcctgacccaattcacgaagaaaggataaccgccaactatgaagatttcatataattggattaaagaatacctggatttaaatgtttcacccgttgatttggcggaaaaaatcgaacgcacttccgtggaagtcgatggcgtgaccacccctagtgatggcctgaagaagatcgtggtaggacacgtcttgtccttagaagcccatcccgattccgatcatctgcacatttgccaagtggatgttggtgaagacgagcccttacagattgtttgtggggcgccgaacgttgccgcgggtcagaacgtcatcgtggccttaccaggctcacggattgccaacaacgttaagatcaagaagtccaagatgcggggagtcccatctgcgggaatgatctgtgcgttacaggaaattgggtttgccgaagatgttgtgcctaaggcttacgctgatggtatttatgttttgccaactgacgcgacgcctggggatgacatttacgattacttaggtatgaacgacagcttaattgacttggatgtgacgcctaaccgtggggacatgttaagtctttatggcacactacatgacttggcagctatctacgatcaacccgttaagttagaacaaccagcggttaaagaagctggtcaggcagttgccgatcaattgacggttcacgttgatgaccagttagcaccgcaatatcgcatgcgtttggttaagcaagttaaattagcgcctagcccaatgtggttgcagatccggctgtggaatgcgggttatcgaccaatcaataacgttgtagatattacgaactacattatgttgaagtatggtcaacctttgcatgctttcgattacgataagtttgctggacaagatgtttacgtgcggacggcacaaactggtgaaagtttaacaacgctagacgaaggtgaacatgagttagatccacaagatattgtcattgctgatgaacacgcgccaatcgccttggctggggtcatgggtggcttggataccgcaattagtgagggaaccgtcacggtagccattgaagcggctgtcttcgagcatgaccatattcgtaaggctgcgcaacggcaccatttacacacggatgcttcacaacggtttgaacgtggtgtcaatcaagctggtgtacaagaagccttagatgcagctgcacagatgatgaccgagttggccgatggtgaggttcaaagtggaaccgtggttgcggctgctaacattccagcaccagctgtgattacattgacactcagccgaatcaatgctgttttgggtacgactttggctatggaacaagttagtcatattctcgaaagcctaggttgtacggtggcgattgacggagagacattgaccgtgacggtaccggttcggcgcaatgatattcatattccagctgatcttttggaagaaattgcccggatctatggttacgaccagttgccagcaactttgccaacgggacggatgaccatgggggccttgacgccagcacaaaagctgatgcgggccactcgtcgctcactagaaggactgggattaaatcaggcgatttcgtacgcgttaacaacggaagataaagcgaatatgttcatgatgcgggccagcgaacccacccatttggcttggccaatgagtgtggatcatgcggtattgcggatgaatattattacgggcttattagatgacattgcttataacacggcccgcaaagttaaagatgtggcgttgtatgaacagggccgagtcttttaccgtgaagcggatacagagcgtcctagcgaagaggaacacattgccggcgcaattacggggacactgctaccagcagcttgggatcagccggcaaaagaagttgacttctatcaagtcaagggtatcgttgcggcttatctgaaagatatggcggttaacggcgacgttacctacgtggctaattcggatatgcctgatatgcatcccggaagaacggcagatattttggtgcatggccatcgaattggctttatggggcaaattcatccgactgtggccaaacagtttaagattggggctacgtatgtctttgaactgaatctacaggcaattattgacatgcctaagcaggaaaatcagtacgacgtcatttcccgttatccagcaatcacacgggatattgccatgctggtagacaatcaggttaccaacgaacaaattatggcgttgattgaaaaacgtggcggtgcttacctgagatccgtcaaattgtttgatgtttacgatggtgtgaaggttcctaaaggcaagaagtctttagcttacaccttaacgtatcaggacaagaatgcgacgttagtggacgatgcggtgaaccaagcttttgacaaggttacccagcggcttcaagatgaattaggtgctgaaattcgttaattctggtaataaaacgcgattggcctgagggctaaccgcgtttttacgaggcatgcaagtgaaagattacaatttcatcaaagtcacgtttacgtattcccgcggactgtaaatttctgtataatagagaagattatggcatagaacggaggaaatatgttggataatggtaaggatcctattccatcacgacaagattcgggaaaaaagcgctcgtttggtcgtcggatcattattggggtagccagtctactggttattttggcggtggcgattggcgttattggttatcactactttcaatcgtcgttgaagccgatggacagcagtaataaccaagtggtgcaagtccacgttcccatgggcgcaacatcaaataaaattgggcaaattttacaggataaaaaagtagttaaaagcggaatggtgtttaactattacgtgaagtccaataaatacactaattttcgtgccgggtattatcaattaaaaccatcaatgacactaaaacaaattgccatgcaattacaaaagggaggttcttcagaacctatccaaagtacatccggcaacgtgttggtgcgtgagggagaaacgattgatcagattgcgacagcaattccagttcaaacggatttcaccaaagcagaattcttgagcctaatgaaggataaagctttcttcaatcagttagcagctcgctatccgcaactattaagttccgctaaaagggcgaaaaatgttcggtatcggttggaaggttacctggcaccagcgacgtatcaggctggcaaaaagatgaccttgaagcaattgattacagaaatggttgctaaaacggatgaaaatctgcaaggaaactacgccacaattaagaaacagaagcgctcagttcaagaagtcttaacgttggcttcattagtggaacgcgaaggggttacccaagcagatcggaataagattgcgggtgtgttcttgaaccggattaaagcggggatggccattcaatctgatatttctgtccagtatgcgttaaagacaacgaaaaagacgttaacgtataaagatttaaaagtgaagtctccatataatttgtatatccatacaggatacgggccaggtccatttgacaacccaagtgtttcgtcaattaaagcggtcttgcatccaacggatcggagcaagggatactattacttcattgcgaacaccaaaacggggaaggtttacttctctaagacttacgcacagcatcaagaaaagacaagttcacttgcgagtgataataagtaaaggacggcgacagtgttggcagagaagaaacgaccgatcattattggggttactggggggtctggtagtggtaagacgactgttagtcgggccatttttaatcaattaattggccactctattatgattttacagcaggattcttactacaatgatcaatcagacatgacaatggcggaacgggccgcagttaattatgaccacccattggcctttgatacggatctgttgattaagcagctcaagcaattgttgcgctatgagccaattgaaaagccggtctatgattacacgttgtcaacgcgaagcgataagacgattcatcaggaaccccgtgatgtgattattttggaaggcatcttaatcttagatgatgagcgactacgtgacctgatggatattaaggtatttgttgatacggatgatgatattcggattattcgccgaatcgaacgggatatgaatgaacggggccgctcactggactcagttattcagcaatatttggcgacagttaaaccaacttatcaccaattcgttgagccaaccaaacgttacgctgatttaatcgttcctgagggtggcgagaaccaagttgccattgacttattggttacaaaaattcgtgcaattctagaagctagcggtaataaagaagtttttgacaatcctgatacaagcatatagaataagacaggttagcccagcgtggctaaccttttctacaagtgataagttaagttggacggaacgtttcgttcaaaataaaaaagataagtaaaaggggtggccagtatggcacaagaaaaaatgtatccaatgactgaagagggtaaggaaaagctcgaagccgaactcgaagatttaaaaatggtgcaacgcccaaaggtgatcgatcggattaagattgcccgatcatatggtgatttatcagaaaactctgaatacgaatcagccaaagatgaacagagtatgttagaaacgcggattagtacggtagaacgaatgcttcaatacgcgcagattattgacaatgatgatacggacaaagacgaaatcaccgttggtaaaaaggtaacattccaagaagacgatgacgaaccagaagaatataccattgtaggggctgctgaagcagatcctatgtctggtaagatttcaaacgattcgccaattgctaaggggttattagggcaccgtgtgggtgagacagtgactttcccaacacctggtggtgacatgaccgtgaaagtgattgcggtcgactaaaagcatttaagagattcagccctagttaaaggggctgaatcttttttatacctttgatgtatgcaaccgcgaaagaatcgttatttgctagatacaattgattgaattaagggcctttttgctggttagttggcggtaacttatcaatggtgttgcggtcagctgagcaaataggtcgctaactagaatgaaatcaggcataataaaagtacgacaagagtttgtgaaaagctgcttgccagatacccggcaaaagtggtataaataaggttgaaaccggattcatagtttgctaaagaggagtcctatcaatatgaaaattacggtgactgatgcagcaagtaagtggtttcgtgaggatatgggaatgaccggccgcggcattcgttttttcggtaaagtttacggaaaaacgccggtccatcaagggttttctctgggaatgaccccggatgatcacccccgccatccaatcgttgcagaaaaaaaggacgacgtaacctactacattacggaaggtgaccaatggttctttgttggttatgatctgacggtcgattacgatgcgcaaacggatggccccgtttatcggtatgcggaaaatggggaattagatcactagtaaaaaacgcatgaccagtttttgcggtcatgcgtttttataatggactaaattattggtggcggcgagagaaccaccaaccgccgagaagaataatgaacgttccaccgctaatcagcagtcccacattaagcagaggtggccaataggcgagcgtgacggtactgttacccttaggtaatttgaccgcggtaaacatgccaatcgttttataagtcttgacggcatgaccgttgactgtggcatgccacccctgggaatatgggatagatgtgttcaggacctgcccagcgtgtttactggtgatcgtgcccttgaagtaacgactagtgtgcgtcgtcaaatgccaaggctgcgtcttcagttgattaatcgcagcctgaaaacgaggagtgtttaaacgatacagcgtgaagttatccaaccatagggagcctttgctaagttggatggttaacttttgttggtgtcccttggcgtggtctgcggcactaaccaaaatggtatttcggtaagtcttgtattggttgagtgtcttgccattcaagataaaggtcgcgttgtccggatttacagttgatccgaaagtgaagtagtaggcatcattggtggtcggcgtgaaggtcaaggtaatcttgccgggctttagtaagtttttcttctgcaagacggcgcccgttattttagtctgctgattaatattttggaaggtgacttgatcaaaattctcagcggtatataactgcttgtcttgggaattgccggttaatgcggctagccagttagcctgatactgtgttggatcagcggttttattttttagagtcagaatttgctgattggctgcatagcccataggaagggcatactggtttttgtaggttgttgcccagtggtcactgctgattttttggtaatcggcgagatctgccttattagatgaagccggtaagatactggtaccgctgagtgcgcctgctaattggttctgctggaaataatatttcatgttgagcaaggaatcagtaactagtgtgccgttactgtactccacaaagccgtcaccgtcaggattaccaatattgccaaagaaagtggggactgctttgggtaatacggatgaaaagacgccaccaccattgtaaccagtttggaaagcatctcctttggtgcgcaagaaggttttaccgatgcgatagaagccatgatcgcgtttctgtacgcgattaacgagtcgttgaagttcattcgtgtagttaccgtattcactttgagacacgtaactaatattgttcaaagagatgaatgcgttagctgtcacctcagtcaccccgataactaagaaggttaggggatagatccaatgatgcttgattggcagggtaattaaggcaagggcgaggatgacgaacagtaaccctagcagtaattgatttaacgtcaagaacttgaacttggctaagttaatccccacgtaagcactaccggcaataacgatgagggtcactaagctgatggctaaccatcctggttgaaaatcggcggtcaaggtttgtgccgcgagccaaattaaccagaaactaacaataaaggagaaacgataaggataccaaaccggaaattggccggcatgccagagtaaatctagtggttgaaagcaaagtgatagtgctaagaaggctgttaaaatgccggaagcaatccgagtacgaagtttgattcgccgatcactgaagtaaaagagactgcctaatagggcgatggcaccaataaataagttagctgtgccatcgggcatttgatcaaagttaaaggcgcccaagaaaaatttggcgagcatcttaggtggaaagaaatcaaaatgccatttgaaggtggtgacggtatattgggccttactctgtgacagtgaccaccaggttggcagtaaaataaaggcagatagcaagccactaattgctgatgcaaggacaaacttaccggcttgtttcccgaaatggcgccaagtggagaagcggtcaacggctaaccaacaaaaggctagaaccatgaacaagcaaatcatgtaagccatgtagtaattaacgactaacatgagcgttagccagatgacgtaagtgcgccattttccggtgtgcatgagctgatataagccatagaagatcaagggtaacagataggcggcatccagccacatgacgttaagctgattggcaactgaccaccccattaaggcgtaagctgttgcaaacataatggctttaaacccgcgttgttgggttgttttctccagtaaccaggcaaaactcaaaccggccaagccatatttgaagacagtcagtaggaagacgcccgtggttaagctggttccggggcatagcaataacaaccaatttaagggacttaaaagatagtaagaccaagtacctaacatttcgccgccaatgccattagagaaagagtaaaaaatgctactaggatcatggaggattgcccggcgtagataggcaaaaaagtcgatatattgttgccctaagtcgacagttaacaagctactggtgccaaatggcgccatttgacgatagataaaataaccggtcatcaaaatgaagggtactaaaaaggccccccaaagggtgagttgacgtcgggaaagcgcccagcgtcgttttcgtacttgcaaagaaagccacctcaatttttttaattttaagcatagatcatcgggttgttcattgggggtggcgctaatgactgatcaaccagtgtaccttcccccgcaagaatcgatgggaacagttgcggacgaccgttcagctataatcttatcagatttattctgaagatgcggttaaaactggtaaaaatttcgagataatctgacgatgacgattttactataggcagttaattgggataactgtccgaactttgttactattcagatgcaccataaattaagctaattaaggagtgaacgacatgaaaactttggacatcgtagctctcattgtattagtcattggtggattgaattggttgttggttggcgcatttaattttgatttagttgcggccttgtttggcggtcaagcggcactgatttcaagaattgtgtatatcttagtgggaatcagcgcagtatactgtttacggtttttcgggctgattacccaccggaaaacggcttagttgatcgcttgttgccgaggtatctcacggatgagagggaaatctctgatccgtgttttagtgtgcttgacggtacttaaaatatataatttggtaaatgttgatttaacgggactttaagcaatcattaaaaggttaaaataccagttgacgttcacgaattaggtctctagaatagcatagaatgattaaatttcggtagcgggatagtgaccgacggcgaagtttggtaaaatagtagctgtataataaggagcagagctgttgtgaagaatttttataatcgcgttagtaaccgaaaccagcgatctagtggcccgagtaagtcactgattccctttcggttgaactttcttttcattattgttgccctgttgtttgcggcgttaattggtcaattggcgtatttgcaaataatttatgggtcacaattgaaggcagaggtcaattcgactgataccacgattgaaaccaccaacgttcaacgggggatggtttatgattcaaatggtaaggtgctggttggtaataaatcacaccaagccatttcctacacgaagggcgttagtgtgctatctacggatatgtataagattgccaatcggttaggaaagtatttgacggtctcgacgagctcattgacgccgcgtcaggcaattgattactacttaacggaccctaaacggttgaaagccgttgagaacaagttgagtgggaccagcgggatgtcgacgacccaaaagtacaacaaggcgttaagctatttggaaaatgattcatctttcaaattgactaaaacgcaaaagaatgcggcagaaatctttgctaagatgagtggcgcctactcgttatcgacgacctacattaaagattccggggtttccaacaaagagattgccgaaatcggtgaacatctttcagaaatgccgggtgttaaagttgggactagttggtcacgggattatccgaacgggtcttcaattaaggccattattgggacggtttcatccgagaagactggtttaccgagtgatcgggttaatgaactgctggctcaagggtattcgcgaaatgacagtgtgggacaatcctacttggaacaagagtatgaatctgtcttacggggaaccaaggctgaaaagcaagtcgaggtttctggttccacgattaccaaagaagcgaaaaagtatggtgggcaaaagggcgacaatctccagttgactatcaactcgaccttccaaaagaagctacagtcattggttcattcagcagagtccggtgccggtggttactcaacggggacctatgccatcgtgatgaatcctaacactggtgggattgttggaatggccggagttgaccgtaatccatcgactggtaagatcacaacgaatgccctaggcactatcaatagtgatattgtaatggggtcggttgtgaaaggcgcgatggtctctggtgctttaatggacggtgtgatcacgccaagcaataacacgttaaccgataaagttattaacgtcggtggtgtgaaaaaggcgtcgtggtttaacaaatctggtagtgccagcattgcgttaaatgcgtccacagcgttggaagtttcttctaactcctatatgatgcaattagccatgaaagaagccaagtttaattacgtctctggctcagctttgaccatgagcacgagtatttttgataaggaacggggttacttcaatcagttcgggttaggcgttaatactgggattgatttgcctggtgaaagtaccggactaaaggggtcgagcacgtactctcatattgggaatgcgttagacttatcctttgggaactacgatgcttacacaacgttgcaggtcgctcagtatatgtcaaccgttgctaatggcggtacccgaattgcgccgcacgtggttcagtcaatccggggaactaaatccgatgggacactgggcgccgtgaaatcaacggtcacccctaaggtcttgaaccggattgacatgacggctgcacagaagaaattggttactgagggactatatgacgtggttcatggaaccaacacgtataagacgggggcagaattagcttccatctcgcctgggatttctgctaagacggggacggctgaaacgtattacaaaggccattccactgttacgttaagtttggcctcttatgcgccatccaatgatcctcaggtcgtggtggccttggcaatgccaaacttgagcacgagtgatgaagataataacatgaaattggccaaacagatttatgctgcttactggaagacggttcaatcaacgtcaacgttgactaacccaaccaaggcaacaacgtctggctcagcagttaatacaagtgctgcgaactaaagagagcttaaaaatcacgtgaagccgttgggcagagcgtgattttttaatggctaaaaacacgtgttaagtatttttccttaacatatttgggattatgactggtaattgccccggattaatggtaatatattacgagttaagggctctagcctgtaattatgaacaagttgggaggttacccactatgcgtgtacacatcactttagaatgtacagaatgccacgaacgcaattacttatccagcaagaaccggcgtaataacccggaccgggttgaatttaagaaatactgcccgcgtgatcggaaagtaactttgcatcgtgaaactaagtaaggtacgggcgagagtccgcacctttttttgttgaatttttctatggattgagggggtgggcccatgatcactaaaaaacacttacgtcaacaaacgattcaggcgttgatggcaatgcctgccgatcaacggcaacacgcgacacgcgacctgcaccaccaattatggtcatcgttagcttggcaacaggccaaaacagtggccaccaccattagtggtgattttgaattagcgacggcacctattattgaccgtgcacaagccgaggggaaaacgatagccgttcccacaacgcttcctaatcgccagatggcgtttcatgttgttgataatcaaacaaattttgccaccagtccttttggtttacaggagccgacgaatggggcgattattgctccagcaacctttgacttactaattgttcccgggttagtctttgccgcgtctggtgaacggctgggatttggcggtggttattatgaccgttatttggtgaaaacgacagggactaaggtagctttagcgttgccagcacaatgggtagcaacgccgacgtggccagtggccgaatatgatgtattattagatgagatctttcaggtcacaccataaggaaggagcctaacggtggcaaactttaaataccgactacgaaatttgaaccagacaccctatatgacgactggattagtcgtcattatggtgttagtctttgttgcgatgacgttggctggtggtagtactagcctaaatgttttggtcgcttttggtgcgaaagtcaatccgctgattcagcagggtcagtggtggcggctgattacgccgatgtttctgcacattgggtttacccatatcttcttaaacatggtgacgttatactttgtggggacccagttggaggcggcttttggtcatgcccggtttctgataatctttttagtggctggaattggcggcaatgttgccagtttttgttttttaaatagtttgtcagctggcgccagtaccgctattttcggtctatttggggcgtttatgatgctcggagaatctttttggcaaaatccaattattcgccagttagcccggacctttttggcctttgtggtgatgaatatcgcctttgatttgtttacaccaggaatcgatttagctggtcacctaggtgggttaatcgctggatttctggtagcgtatacagttggtgttccccaaattggtcgagtaagcgtaaccaaacgtgttgttgcaacggttgtcttgattttgggattggtctggttatatttacacggaatggcgcagtaagcggcgaaaagtctcgtgcaatttcatggaggttgtggcacaatgaaaacgttatatgatgttcagcagctacttaaaaattttggtatttatgtgtacgttggcaagcgtctttgggacattgaagtgatggctttggaacttgatcacctgcatcaagcgcgggtagtcgacgataaggtttttgtttcggccaaacttgtgctcacacatgaacaccgcttagaagaacaacgagcaaaattcaagcatcaatccattggagggatttagcgttatggcacggaatttaattggaatcgatttaggtgggactaccactaaaatggcctttctatcactggctggggaagtcttgaccaagtggagtattccaactgatatcgccgacgaggggagccacattgttccaaatattatcgactcaatcagtcaacacattacgaactcagaattcagtaaagacgactttctgggtatcggaatggggacgccgggttcagtagatattgagaatggaaccgtcattggggcctttaacttgaactggaagaaacggcaacaggttcgtgatcaaattcaagcaggtttaggccttcaatttatcctggataatgatgctaacgtggcatcattaggcgagtactggaaaggtgctggcgaaaaggatagtgatgtggtctttgtaaccctaggaacgggtgtcggcggtggtgttatcgctggcggccacctcttgcacgggattaacggtggggctggtgaattgggccacgtaaccgttcaaccgaatggctatctatgtacttgtggcaaacgtggttgtctggaacaatatgcttccgcaaccggagtggttcacgtggctgccgatatggctaaggatttcatgggaacttctcgattgaaagaaatggaagacaaccaggaaagcgtgacgtcaaagatggtcttttatctagccgataatggggacatcttggcaaaccaagtggttgaccgggtcaccttttatttagggttggctttagccaacgttgccaacattttaaatccagccaacatcattattggtggtggggtttctaacgctgggaacacgttattacaaccaacgacgcggtatttccaagaaaatgcctttccagcagttcgggattcaaccaaactgcgattggcacaactcggaaatgacgcagggattattggcgcggcatcactcgctttacgattccaaaaaacgaattaagagaaccaggtttaggaaggacgatttagtttggtaattgctgcaggaatctcgggatggacggtctacatgatcgtactgattgttttacttatcgtgtggggtggctggtcattaacaacggtgatgcgtcgaaatcgcgttgccaagctaattgatgaagcaaccttccaagaaggacaacgtaaggcccaggtggttgatttacgtgagaaaaaggattttgatgcgggtcacatcttaggtgcccgtaacattccttattcgacgtttaaggcttaccacacgcaattgcgagctgacttacccgtttacctatatgaccaagggaagtctctgagcacacgcgcagcgattctcttaggtaaagaaggctacacggatatttcaatcttaaaaaccggctatgctcgctgggatggtaaaactaaaaaaactaaagactaaaaaaaggtccggaaaaatttccggaccttttttggtgactaaattacccatggtgggcagcgtgactttttcggttagctaacttgcggttttcttcaaaccgagcttcttggtcttcgataggttgaacgacttttttcttaaaagaaaaaactgcgccggcaaccgcactagccgtagcgacaacgccaaacaaaacgcctttggtgaagttcttcataacattcgactccttctatcgtgggattttgattatccgcttccattatgcttgttttttgatgaaattgctagcgatttacagcgaaatgcggggattctgtggtaatcttactagtaggatttgggagaaaggactgacgtgggtgtttaaacgacaaacgacacaggtgattgcacaccgaggaagtaaaggcacacgaccggaaaatacgttgttggcatttcaagcggcattggatgcgggtgccgatggtattgaaactgacgtgcagttgtcgcgtgatggtcagatggttatcatgcatgatgaaaaggttgatcggacgactaacggtagcggattaattaaagacctgacattggcacaattgaaacagttagacgccggtagtcattttggacgggaattcgcgggcaccaagatgccaacgctggatgaagtgattcagctcttaattgccgaccacttttctggcgtgtttaatttggaactgaaaacaaataagattccgtatcccgggattgaacagcaattagcgacgtattttacgcaacaacccgtgccgtttcggttagtcttttcaagttttcgcgcgcagtcattagttacgctacgaaaactgtacccacaggcggagtatgcgaaattatttaaaacggcaggccggcaggcgaaacaaatggagcgccaccaacaagtcgcggggctccatccggatattcgatgggttaaggcgcaccgcttttggttaccgcatatgcaactacggccgtggacggttaatagcccggcagacatggcgtattgtttccgtcgtcactttgcgggcatcattacggattatccggcacgggcggttgccttaagagaaaaaatacagggaagtgaacgggtatgattaaagttgtggcggttgtgggtcccacggcagtcggtaaaacagcactggccattaaattagcccaagcctttaatggtgagattatctcaggagattctatgcaggtttaccggcatctagatatcggtactgccaaggcaacggccgcggaacaagcgcaagcgcctcatcatctgattgatattcaggatgtcgatcaacaatttacggtcgctcagttcgttgcggcggctcagccattaatccaagcgattcatgagcgagggcatttgccaattgtagctggggggaccggtttttatttgcaagccctatttgatggcttgaaattaggagccgacgcaccaggtgacccgcagattcgtgagcacctccggcaaatagcagtcgaacaaggaccacaagtcttgtggcaacaattggcggctcaagatcccgttgcggctagtaagattccaccaacaaatattcggcggacggtccgggcgctggaagtcattcaagttacgggacagttattttctcatcagcaaaatgcgggttcccaatacgatgaatattatattgggctgaatacagcgcgaccgctcttgtatgaacggattaatcagcgcgttgataacatggtgcaagcggggttgctagatgaagttcgttggttagctaagcgcggtggggcaacactgccggcggcaagcggaattggttatcgggagttattaccggttcttgaccaaccggaaaaacttgcagcggcaattgaccagattaagcaggactcacgtcattatgccaaacgccagctgacttggttccgacaccaaacaactgcgaactggtatgatttggtgcagcatccagaagttgacgcccagattttacaggatgtgacggcgtggttaactgaaaagaactaaagaatttctaacaatcggctacttatgtcagaaaacctaacatgaattcttgacgtcagctgtcaacgtggtatgataacagcatagtttgaagggggcggtagtggtgaaagaaaaagaattacggcgatcattagcagttttgccgatcggaacggtgatgaagctgactaatttgacggcgcgacagattcgctactacgaagcccaggcgttggtttttcctgagcgtaatgatggtaatcggcgaatgtattcattgaatgatgttgaccgattactggaaattaaggactacttggctgatggcattaatattgctggaattaaggcaatttatgaccagcaacatcaagccgctcagcaaaaagcagcggctcagcgacagccattgacggacgaagacgtgcggcgaatcttgcaagacgagttcattcgtcaaggtgggctgggccatccaacgccaggaatacagcaacagcggccgctttaagatattgatgagacgagacaaatacgcagggagcgattttgatggcaaaaccggaatattctaaagatgacattcgacagatggcaaaagacgaaaacgtcaaatttttacggttaatgtttaccgacctatttggaacgattaagaacgttgaagtcccaattagtcaactaggtaagttattggataacaagttgatgtttgatgggtcttcaattgacgggttcgttcggattgaggaaagtgatatgtatctttatcctgacttgtcgacgtggatgatcttcccatggagtacggaacggggaaagattgcacgtgttatctgtgaggtttacacaactgaaggcaaaccatttacgggtgatccgcggaataatttgatccgggtgttagatgatatgcgtaaagctggttttacggactttaacattggaccagaacctgagtttttcttgtttaagatggacgaaaatgggaaaccgacgacggaacttaacgataaggggagctactttgacatggccccaatggatttaggtgaaaattgccggcgtgaaattgttctgaccttggaagaaatgggctttgacgttgaagcggcgcatcatgaggttgctcctggtcaacatgaaattgattttaaatatgccgatgcgttaaccgcggcagataatattcaaacgtttaaactggtggtaaagaccattgcacggaaatatgggttgtatgcgacctttatgccgaagccattggccggaattaatggttctggtatgcatttgaatatgtccttattccatgatcaaggcaatgccttttatgataaagatggtgaaatggaattgtctgaagacgcctatcatttcttaggcggactgctgaaacacgcgcggagctttacagccatctgcaacccaatcgtgaactcgtataagcggttagttcctggttacgaagcaccggtctatgttgcttggtctggctctaaccggtcgccattaatccgagttcctaattcacggggactgtcaacccggctagaagttcgaagcgttgacccagctgctaatccatatttagcgattgccgccgtacttgaagcgggcttggatggtttacggaataagctggcaccacgtgaagcgattgaccgtaacatctaccggatggatgcagaagagcggcaggaaaatcacattaccaatttgccagatacgttacacaatgcgttgaaggacttagcagctgatgatgtgatgcgtaatgcgatgggggatcacttataccagagcttcattgaagccaaaaacttagagtacaattcttatcgaactcaagtttccgaatgggaacgcgatcaatatctagaactttattaaaaattagcacgttaaaactggtcatcccttaaataggtgatggccagtttttggtgtacaatggcggatcgctcgtcgttaagttaccggatcgtgtaaatgacgaatgaaccccgtaataataaaaaattaaggattttccgataaaacttcacgcaaactgctttattctgaacggatttttggtaacatgaacgtataatcaaatgttcacggcaagcgctagggaacatcagaatgagggataaattcatggaaaatcaagaacaacaagctagtgcagccgacgtgttaacacaggcgatcgccagtaaattagattatttaagcacgttacaagcggcagtacagcacaatgatgatcgaaaggtttatgaattgcttgatgaagggcggtattaccaagaggtcaagaagacccggtcaccgcgagccgttaatcacctcgctgaattagtcgacaacattcacccccagatcagtcattacttgagtgacaacttaattgattatttgggacatatttacccatttttctactacgaagaatatacaaccggcttgttccatatttactttggcaactggtgggaccggcgattatttggtgatttagatgtcatcaatgtgcaattccagtttgatgagacggaataccaaaagctacgtgattcttttgcgttggaagcccaaaatcaacgcctgaatacggctaagattgagtcaatctccgcgcaaagtgaagaactacaacaattggtcaatgcccaaacacaacgcgacaaccaaaaggcggagttacgggaacaattaaaggaaaatagttccaagagtagtatgccttgggattctggcaaactcaaagaagaacgccaagctattattgaccaactaaccaagctggctgatgaagatgaacgggccttaaatgcccacaaaacgattaaagaaaacgatgatcgaattttggttttgtctaaggaagacacgattttaaattatgaaaagcaaagtattcgggatgctttcgatgattttgaacatttcgaagcacacaatgccagcctgtatgccgactacatcaatagcttaattggcaaaagtgaggtgacgatcgatgattaacgaaaatgatccatcgacgttgactaccagtggtcgtttattaaactataacaatgcgattaaggatggcttgcaaacggggctacgctttacggaattaatggatcaactgatcaaaaccacggatcctgatgagttagtcacggctgcaacggaattggccgattttacgctagattctgacttcgtcacgttcccccatcagtatagtcatgctgattattatctcctctttatgtcgcggatgttggaactccatgatcaaggtaagcatgtgatcttacagtcgcgtgatcaccatgaagaactgacccagcaactaaccccattaggcgatcggggaacgtttaactttcgggtagagacttcagaaaacggcggtgtttactaccgggaacgggcgacaggacagtccttgttctatttgaatttagaacggaaaatgttccggtttaacagccatgctttgactcagttatttatcattgatttacatgattccgtaccggccgatacaattaaggcctcggttggtattctggttgattttgcgcgctacttaaaagaagactatggctactccgtagacttcaatattttggatgcggctaaccgtcaaaactatgcggttcggtcgaccgacctaccagccggtgttgttgatcgcctatttgtgatggctgcgcaaaatgattatatgttaaccaatggtgtcaatggtaatggcgcagaaattgcgctaggccgcggcattgtggttgatatttttaacaatcagttggacggccagcctgaatgggtgttgacagttcacgatgatgaccagaagatttcatggtttgatgttttgttacgttttgactttatgcgggattggtatttggaaaacttaacggagttagaaattacctcagatccattgattttcggttagaagggagtctaatcgtgctagaattggctaaattagtgcggcaatcgattgcgctagatgaacagattacacgagaccgcgacattgaaatgtcgcggcagcagcaaattgaaaatgcctacgttgccttagatgttgaattggcagaagttgccaacacatctgaatggtttaaagtttggaaaacccatcgtggtaaagccgatgcgggacaaacgccaatggaaacgttgctaacagaatatacggacgcaatggatttcttctttttagtctcagctaagaagacgtggacccatcttattatgctgaaagaagaagacctcacaacgctggaaaagagccgaccggccaaggatttagatcaacagtatttgatcttaaagcggatgctattcaatagtcattttgcccatcgtcaagaagactttcgtcacgcgtggcgcttatttttgaagtgggggctggctgattttggttttacgcaggatcaaatccaagcagcttacgaggccaaacggcaaattaatttggagcgacaagcaaataattattagcaaatgggggctagttcgagttttcggactagccttttgttaggaaaggcgtgaagaatcatcagtcagccaacagatccacgggttgtccgcaccaacgaacgcttacgtcaggcattaagcacgctattacaagaaatgtcattcaaacaggtgtcggtccaaaagctcactcaggcggcagcaattacacgaggaactttttatctgcattatcaggataaagctgattttttagctcagactgagcagcaggttattgatgaatggttagcggccggcaaaaccttactggcaccatacggtcatccagtgaatggttttgcgttaggcccagcactccgatatgtggatgaccatcatcagattttgatggtgttactccaaccacagttcgcccattttcgtacgcagttacagcaacgtttggaacaagaactactagtatttagtcaacagctaccgcagtcaaatgtgctaacgtcaccattagacgtacaagtgagctttttggcaacgggattcattggggtgattgatcactggttagcagatgatcggcgttatcgcccggattatttggctcaggcgtttcagcaattgctaccattggaaagtctcccggtagcggcctggtttgcgccaattaatccggaaaaacgctgacaataaaaaagacttgacggtttgctgcctatcaagtataattttcatgttgtatttgtggacttccacagctgcaaccgctcggaacgagtttaagttttccgcttgcggagcacttgtcttcggcgagtctaagtctaaaattataaggaggtgcacattcatgtacgcaattattgtaactggcggcaagcagtacaaggtcgaagcaggccaagctgtttacgttgaaaagttaaatgttgaagctggtgaaaaggttacttttgaccaagttgtctttgtcggtggcgatacgcctaagatcgggacaccaactgttgcgggtgcgactgttactgggactgttgaaaagcagggcttggaaaagaaggtcgttactttcaagtacaaggccaagaagggccaacacacgaagaagggtcaccgtcaaccatataccaaggttgtcgttgatgctatcaacgcctaaagcctaaagattagaaggggcgatctcgatgattcatgcgacgttccatcatggaactaaccgaatcgattcattccaaatcaccggtcatgccgattctggcgaatatggccaagatattgtttgtgctgcggtttcggtgcttgcgatcacgactgttaatggcttacaacgaatcgctcagattccggtgcaagtcgacaatcatgatcaggaaggtggctttctggaagtccacctcccaccaaagctggaagcaacggccgaattaaagggacaaacactcctccagagttttgcggatgggttacgagatgttgccaacaattacgcggattttgttgaattcgctgaaaccaacaattaaatttgcggaggtgaaacttatgctgatgaacatgaacttacaattcttctctcaccataaaggtggtgggtccactgctaacggtcgggactctgctggtcgtcgtcttgggacgaaggctgctgatggttcaactgtaactggtggttcaatcctttaccgtcaacgcggtacgcacatttaccctggggtcaatgttggccgtggtggtgatgatacgttgtttgccaaggttgctggcgtcgttaaattcgaacgtcttggccgtgacaagcgtcaagtatctgtttacccagttgccgaagaagcagctaaataacacgaggttttcctcgtacgactgaagagcttgaggcgagaccaattcgctttgggttcttctttttttcggaaaattagatcgggggttgggtcaatggcgacacgagttgaacggctacaggcgctatttgcgccactgagcattgatagttttttggtgtcttcacctagtaatcagcaatatttggttggcgctagtgtgatgtctggtgatggctacttattggtgacggctaaacgagcggtttttatcacggatgcacgttaccaaacggaattgacccaggtgataccccaaataccgttagtgattacgcggagctacttgcaagccgttaatgatgtcttagaggccgatggtgcaaccgtattgggaattgaggatcagctaactattcgtgagttcgagtggttagatgagcacttaatgaccgatatcgtcccactggccgatgtggctgatgagttacgacaggtaaaagaagcggatgaactagcggctattcggcgcgctacgcaattaaccagtgctggattagaggcgctatttacggtactaaagccggggatgacggagcgtcaagttgcccaatggcttgaacagtggatgcaagaacatggggctactgggaccagtttcccaacgattgtggccagtggtgtccgttcggcttggccgcacggacagacaagtgataaacagctcgctactggtgaactggttacgattgactgtggtttttacgtggatggttacacatccgacgttactcgtacggtggcactgggcgacccgggatcagaactgaaagcggcttaccaggcagttcaagcagcacaatccgccattgtggctgccgttgcccccggtgtaacgggcgatgaattagatcggattggtcgcgactttttgacagaacggggctacggtgaggcgtttattcacggaacgggtcacggaattgggttagatattcacgaaggccctaatattggccgtggttggccagatattatgaaggctaatgaagtcattacgattgaacctggtgtttatttggctggccggggcggtatccggattgaagacgatatcttggtcacatcagctggtcacgaagtcttaaccaccgtgccacggaatttaattattttgtaaatggcacccctgtcttgctttttaggggtaagaattgatattataaagaggacatattttaggaggctataacattatggcaatttctactgctgattttaaaaacggtttaaccatcgaggttgataacgcaatttggcggatcattgagttccaacacgtcaagcctggtaagggtggcgctttcgttcgttcaaagcttaagaacttacggactggtgctgttcaagaaaagactttccgtgccggtgctaagatggaacgggcagacattcaaacgcgtagcatgcaatatctatatgaagatggtgataaccgggtcttcatggacaccgacaactttgaacaaatcgaagtacccgaagaacaaatcaaggatcaacttccatacttacaagaaaatatgaatgttgatttggttcaatttggctcagaagttctcggcattgaagtacccaacacggttgtcctggaagttacggcaactgaacctggtattaaggggaacaccgcttctggtggttctaagccagcaacgatgaacaccggcttagtcgttcaagtcccattcttcgttaatgaaggcgacaagctctccatcaacacaactgacgggacgtatatttctcgcgcctaggttatcacacgtttaagtaagggagggtcaatgaatggcggaagatactaacattattttagaatctaaagaaccagctttgggcaagattgaggtggcaccgcaagtcctagaaattattgtagggattgctgctagccaaaccgagggtgttgcccggatgcgtggctctttggccaatagcgtcacggaattatttggtcgcaaggaacaacatggcaagggcgtgaaactggtctttgacggcgacgaattggcagttgatgtgtacgtttatttggattacggggttgcagttcctaaggttgccttggccattcaggatagcgttaagcaacaattgctgttcatgacggacctcgatttgcgtgaagttaacgttcacgtggaaggcgtcattcccgaaaagacggcgcaacaggttgacccagataacctgttcaaccagaccgatgaaggagacagtgaccaatagtgacacttacacgacatcaaattcgggaacgggcatttcaaatgttgtttgcattaaatgccaatcctgaagccgatcatgatgcgttataccaacgtgttttgacggatgacccgaaccaacttgttcccgtgccagactatttggcaactttagtgaatggcgttttggcccatcagagtgaactagatgcgcaaatcgaccagtacttgagtaccggatggcagttgaagcgaattgcgaagactgatttagtcattttacgcatggcattttatgaaattgagcatgtggacgatgtccctaatcgtgtagctgttaacgaagccttggaacttgccaagaactttagcgacgatcgttctcgtcgttttatcaatggggtgttagcgcacacgttggacgacgaaaccgacacacaagcttaattgatcaaaccgtttgctggtaatgagcaagcggtttttttagttgtcagggagaatgtgtgatttaaccattagcggcattcccgttttcagagtaactatgctaaaatggaagataactttaaaacacagtgggaggacgcgctttatgacgaccatcattgacggaaagcagatagcaaaagacctaaatgcgcaaacagctacacgagttgcggcacttaagaaacgtgacatcgtaccaggattggccgttattgtggtgggggatgatcctgccagtgccatctatgttcgtaataagcataagaaagctctgaaattaggaattaagtcagttgttcgggagttaccagccacgacaacccaggcggaattgacacaaatcgttatggcgtataacgttgatcccacgattcacggtattttggttcagtcgccattaccggcaggactggatgaacaagcaattgtagcggcgattgatccccaaaaggatgtcgatgggtttcatcccttaaatgttggccggctatttgctaacttacccggaaagtatcccgtatcgtgcacgcctcggggaattatgaccatgttagcgactttgcccatgcacttgcgcggaaaaagagcagttgtggtggggcgtagtttaattgtgggtcggccaatggctgcgatgctcctgaatgctgatatgacggttagcgtggctcacgtgcatacccaacacttgagtgatttaacacgcacagctgacgtgctcgttgtggcaacgggcgtgacgcatctgattaaggcgactgatgtgaagccgggtgcagtcgttattgatgttgggatggaccgcgatgagaatggcaaattgactggggatgttgattttgacaacgtcgcaccacgagtggccgcgattacaccagtccccggcggcgttggcccaatgacaattgcgactttgatgcagcaaacggtcgatttatgtgagtggagtgagcaacgtggcaacaactgattatttaacggtcacagcactgacccaatatttaaagcgcaaattcgatgtggacccgtatttgggtaaagtttatctaaccggtgaaatttcaaactttcggttacgaccacatgcgcatcagtattttagtttgaaggatgaccacgctaaaattagtgcgattatgtttaaatcagcatttgaaaaattaaaattcacgccggaaacgggcatgaaagtcttagttacggggcgaatttcactgtatgaacccagtggtagttaccaaatctatgtggaacgaatggagccagatggtgttggtcagttgtatcaagcctatgaacagttaaagcgcaaattagccgcagaaggcttgttcaccgcacctaaacggccattatcccgttttcctaaacgaattgcggtggtgaccagtcccagcggggcagtcattcgtgatattatcactacgacccggcgacggtttcccatcgcacagattgtcttgtatccggcggttgtgcagggagatgcggcggccgatgatattgttcggcagattcaacgggcgaatgcggctcagtcatttgacacgttgattattggtcgtggtggtggctcaattgaagatttgtggccatttaatgaagaacgggtggcccgagcgattgcagcgagccaactcccggtcatttcgtcggtgggtcatgagacagatacgaccattgcagatttggtggcagatgtccgggcggcaactccgacggcggcagctgagctggcagtgcccgttcttagcgatgagttgctcaagttacagcagcagcgaacccggcttttaaatgccatggctaatcgcattaattttcagcaagaacgactcaataagttaatgacggcttatgttttccggcaaccacaacggttatatgaaacgtacgtacagcggcttgatcgggcacaacaggcgctggggcggaatatgcaagacctagttacccaacggcaacagcagttccagttagctcagcaggccttagctagccgatcaccgttggctcgggttcaacgcaatcaactagtggtgcaacaaacggcaacgcggttagcaacggaggctcgacggtatgtgaccgctaaacaagaacacgtgggtcagctgatcaatggcttggattatttgagtccgttaaaaatcatgggccggggttatagttatgtgacacaagatgaccacgtggtccgatccgttcagcaattacagccggggccggcaatggtccatctaagcgatggaacggccagcgcagagattaagacgattacaccagcatcggaggaaaagacacatgagtgaagaacaaccaacctttgaagaaaatttagctacgttagaaacgattgtcgctcagttagaacaaggcgatatcccgttggaacaggccttaacccaatttcaaaagggcgtggctctgagtaaggagttacaaacaaccttgcaggatgccgagaagacgttaacaacgatgatgaatgattccgatcaagaagtggcttttgaaacgccacaaggaggcacgggtgatgccgattaatgcacggttaatcgcatttgaagatcaatgggtgccagcattaaatgcaccgttaaagcaggccatcttggctgatagccatgatgcccaattagcggcggcaatgacctattcagttttagctgggggcaaacggctgcgaccgttactaaccgtggcgacgatgcggtcgttgggcgtgacctttgtgccagaacgccattggcgaccagtgatggcactagagttgttgcatacgtattcgttgatccacgatgatttacctgcgatggacaatgatgcattacgtagaggagagccaactaatcacgttaaatttggagctggtatggcgactttagcgggtgatggtttgttgacgctagcgtttcagtggttgacggctactgatctaccggcgacaatgcaggcggctttggtacaagccttagcgacagctgctggtcctagtgggatggttgctggacaagccaaagatattcaatctgagcacgttaatttgcctttatcccaattgcgtgttttgcacaaggaaaagacgggtgcgcttttacactatgcggtgcaagccggcttgattctaggtcaagcacctgaagcacagtggcccgcctatttacaatttgcggatgcatttggcctagcttttcaaatctatgacgacattttagatgtggtcagttcacctgctgaaatgggtaaggcaacgcaaaaagatgcggatgaagctaagaatacgtaccctggtaagctgggattgattggcgccaatcaggcactaattgatacgatccacagtggtcaagccgcgttacaaggcttacccacgtcaactcagcgggatgacttggcggctttcttcagttattttgatacggaacgggtgaactaaatgaaaaaaaagcgggttgcggatctcttattagaacagggcctattcacgtcactagatgaagctaaacgggcggttatggctggtgagattctaggaaaaaatgaagaacggttggataaaccaggctcattaatcccaattgatacggaactacatttaaagggtcacccattgccctatgtgtctcgcggtggctttaagttagctaaagccttagaagtctttaaaattgacgtcactgaccgaattgtcttggatatcggttcttcaacgggtgggtttaccgatgtcatgttacagaacggtgcgcaattgagttacgcgctcgatgtgggcagtaatcagttagtttggaaattacggcaggacccacgggtcattgtgatggaacataccaattttcggtatagtcagttagctgattttacgaaaggtcaaccgacctttgcctcaattgacgtttcctttatctcactcaagcttattctgccaccattaaagcaaattttagcggtgggcggcgatgtcgtggccttgattaagccccaatttgaggctagtcgtgaggatgtcgggaaccatggaattgtacgtgaccgcgcggtgcatgagcaggtggtccaaacgatcattgattttgcagtagcaacgggatatagcgtattgggcttagacttttcgccgattcgtggtggcgaaggtaatattgaattcttggttcacttacaatcagttgataaacatgcagtttgtgcaaatacggtctcggtggctgcgaccattgatgcagcatataaagacctaaaacactagattatgagaaatttatgagaatttactttccaaaacctaagctctggtatatgataagattatgcatttttatcacataaggggggctaggtatgaagaagcaagaacgccagcagctactcaaacgattattaacatcacgggaaattgaacgccaagaggattttgtgcgcttattaagtgaagatggtattcacgtcacgcaggccacaatttcacgggatatcaaagagatgcagctggttaaactgccagccgaatcaggtgggtaccgttacagcttgcccgtccagaaaaagattgatacacaaaagaaattacagcgaacactccaaaatgcctacatatcctttgctgtgcaagatcagtttacgattttgaaggtgttaccaggtaacggtccggtcattgcgtctttacttgatcagatgcggtacgagtttgtttttggaacggtgggtgacgatagctcggttctgacgatttgtgtttctcatcaaggtgctttacaattggagaagacaatcgaccgtatgcttgcggattgatgatttgagaccacgactgactgaccagcacatgctgacgaagcagtcgtggtcttttattctaggagggcgaaacgtgttacaagaattgtccattaagaattttgccattattgaccatttagatgtgacttttaagaatggcatgacggtactgaccggtgaaacgggggctggtaagtccattattattgatgcagttggtttattagccggtggccgcggttcggcgaattttgtgcggacgggcactgataaggcagtgattcaagggagctttgtttttccggctgatgggacaacttaccaggtcttagatgaactgggaattgaccatgatgatggtaatgtcatcttacaacgcgagattcatcaaaacgggcgcaatacgtgtcgagtgaatggtatgttagtcaatacgaatacgctgaaacgaattggcgagaccgtggtggatattcatggccaaaatgaacatcaggaactgatgcaaccagaaaagcatttggggatgttggatgagtttgcgggggccaacgttgccaaattacgaactcaatatcagaaaatctatcaacactacacacaactgcaggcgacgcttgaacacaagcgagccaatgaaaaagagtgggctcagcatttagacatgctccaatttcaggttaaagaaattgcggctgcgcagttacgttctggtgaagaagatgagttagttgctgaacgtgaccgattagataactttcaaaaaatcaatgatgccttgcagcgttctcaggtcatcttgaccggtgaggacacggcaccgggtgccaatgatcaaattggcgaagccatgcaggcgatgcaaggcattgcggattttgatccggcctttaatcagattgctagtagcttagaaaccgcgtattatgcgctaagcgatgccgtgggcgacgtttcttctcagttagacttattggaatgggatgagggacgcctcgatgaaattgaacggcgattagatgttatcaatcagctaaaacgtaagtatggcgattctgaggaccaagttttgcgatattatgataaaattgctgccgaattgaagcaaatgcaggcgactgatgaaacggctgatgatttggagagtcaagtggctgctcaacaatcgtcgctattaaagctgggcgaacagttgagtcaaggacgtcagcgagctgcggaacaattggaaaccgccattcatggtgaattagcggatctttatatggataagacggtgtttactgttcactttacgcgatcaaagtccattttgagtacggggttggatcatgtggaattttatctgcgaaccaatccgggagaagctatgcggcctctggccaagattgcatccggtggggaattgtcacgaattatgttggcccttaagaccatcttttccgagtcacaaggaatcaccagcattatctttgacgaagtggatactggggtaagtggccgtgttgcgcaggcgattgccgaaaaaattagcggtattgcgcgggcgtcacaagttctatgtattacgcacctgccacaagtggccgcaatggcggaccatcattactttattgctaaggaaatcgtgggtgatcggactgaaacgaaattagcgcggctaaatgaagccgatcgtgttcacgaattagcccggatgtcagcggggacccaagtcactaagctcgctttggagcatgctaatgaattgttggcattggccgcagaaacgaaacaacgtcgttaatatttggagataacgtacggggtatggatagctattgaaaagggctagttttaggatcactttttaaaaggctgctggttcgataaataaccgaaccagcagcctttagtctatggtaccccacaatgacgagtacacttcattatatgaatgataaagcattgggggatgttaataatgaagtggcgtaaactaagcttgggattactcttgatagtgggcctgatttgggtatcggcgttgtcaattggggtaactgcacaatcgcagacgaccgtcataccgaatgtctatcatggaagctggtttcagccggaggccttacagtaccgcgttaaaatgacagcaaccacgttcacctttggtggtggatactacgaacacgaacattggcagccacacaaccaggtgacttatcgactaagttcccacgtaacagcaggaacttttacctggggaaaacgaaacgcgcaaggatatcacagcgtcaaagtgcaggggggtatcttctatgtgaaggagaatcgagggaccctgtttgttaaacaaattcgtcaaggccatgacatcaacggctatgatctaacgtttaaccagataccgcacgctgctcaggtgttgtcggggggtgttcattagagccaaaaattggcagctaagtctcgcggggcttagctgccaattttagttaacatcgttgaatcgaacgtaatagctcaagggtgacaattgtagtgacctgattggtttgttttaaaatgagatgaccgaaagcatcctgttgcaagtgaccaacaacagttgtgggtgccacgttggtagccgctttaaattgcaactgcaccaaatagtggcgagtgatcgcctgttgagaaaagtaactaagctgagtcattggcatttgtggataaacgagctgcccattaatgacgggcaaagcactaaacatttcttgataaacagaggcgacccgatcagagagggtgggccgattaacgattggattttgcatgttgatcacctcgaacgtttgtttgtattttcattatacgaacacacgtttgtaaatgcaagcctttttccgtaaaaactttttaacagttttttacgaaaatggggaaggagatgcagtaattattaacaaatagtggtaatatagtatcctatagattaaagtttgcgtgatcatttcggttacataggtgtggtaggtttgactgatgagtcatttccaatcacacacttaattaatttttatgatgaagggatttttaaacgatggctaaacgtggaatgctcattgtgctttctggtccttccggtgtaggtaaaggaacggtgcgaaaggctttgttcgatacgggagcaacggatttttcctattcgatttcgatgacgacgcggcaaccgcgcgagggcgaggtcaacggggttgactactactttgtctcgaaagaagagtttgaagaaaatattcggactggacagatgttggagtatgccaagtatgttgacaactactatggtaccccgttaaaatatgttaatgagactctcgaccaaggcaaagatgtttttttggagatcgaagttaacggtgcgatgcaggtgcgggctaattgtcccgacgctgtttttgtgttcttgacgccaccggatttgatggaattaaaacatcgtctaatcggtcggggaacggacgcaatggatgtcatcaacaagcgcattaaaaaagcggttggtgaaattcaaatgatgcgcaactatgactatgccgttgtcaatgatgaggttagtcaggccgttgaacggattcaaatgatcatccggagtgaacgactgcgggtgacgcgggtgatgccagattatgaacaaatgattggagacgaataaaaaatgttactatatccctcagttgatgatttattagcacaagtggattcacggtattcattgattatgttggctagcaaacgggcacatgaattagatgctggttcgaagccattattgaccgactacaagtcgcccaagacaattggtcgggcgcttgaagaaattgcggccggtgcattgatgattgatccggatgaaaaggatttagacgcttaatttaagcgttcggtaaagaccaggttgccattgggtaatctggctttttttatcaagacactagatagtcagcagagtagtaggagggaacgcgatgtttgaaggtaagcatataacactaattgtaagtgggagtgtggcaagttataaggcggcaacgctggcccgagagttgcaacgagctggtgcccaggtgcgcgtgattttgacgactggagcggctcagtttgtcacggcagcaacatttgcggcactgacgaaaactaccgtgttgacggatgataattggtggcaagcggatggtcagattcggcatattgagtgggccgattggacagatttactgattgcggcacctgcttcggccaatttgatggctcaattggcgaatggattggcgaatgatgctgcgagtgcaacgtggctggctacagcagcaccgaaagtggtggttccggcaatgaacacccatatgtggcaagcaccagctacacaacggaatcggcagcaattaatgacagatggggctcacgtgttaacgccagcaaccggtgtgttagcggaaggctactctgggcaagggcgatttttagcaccggctgagattgtgcggcaactagcggatctaccgctatttactccccagaccttggctggcaagcgggtgatcgtgactgctggtgggacgcgcgagcgattagatccagttcggttcttaacgaatgactcttctggtaagatgggctatgccgtggctgctgccgcccagcaggcgggcgcaaaagtcacattaattacagcgccaacgggactgtcggctcccagtggtgttgacatcgtaaacattcaaagcacaacggaactagcgacggctgtactggatcgttttcctaatgcggatgtattagtcatggcagctgccgtggctgattttcagccagtcacggtagccgatcagaagattaagaagacagccgataatgatgagatggttttaacgttaaaaaagacgcctgatattttaaagcaagtggcggcgattaaacaaccacatcaagtgaccgtggggtttgccgctgagacccaagcggttttagctaatggtcaaaagaaactagctgataagcaattagatcttttggctgccaatgatgtctctcgccaagatattgggtttaacagtgacgataatcaggtgaccttcatcatgccagacggcgtaacggaccaaacacctaagaccagcaaacgagtgattgcccaagccttagtgtcacgggtcgcaactattttagcagcaaagtgaggtgacaacgcgtggctcaaattggtcaagtattagttgatgtgcccaccatgcaaaccaacgacccttattcgtatgccattccggcagaattggaacaacaagtccaattagggatgcgcgtgaccgtgccatttggtcgcggacaccgggttgtttcgggggttgtggttggtcttagtgatgggacgaactttgatgggcagttaaaaccgattgcatcggtcttagacctagctccggttttaaatgaggaattgcgccaactagcggactggttggcggaccagacgtatgcctttcgaatcacgtgtattcaaacgatgcttccgaatctactcaaggcccaaacggcgcgcgagattaagccgacaactgaactcagtccggccgagatggcgcaatattttccggatggtgctcctcgcgaatttgatacgagtaaattagatgataagacgatggctggattattgcggttgcagcgtgctgagaaggttgaggttacgtatcaagtgactagcaaggcaaccgctaagacggtgactggcatcttaccggcccagtcaattgatgaactgaaagcccatcaggatgcggtagttaaacgcgcccctaagcaagctaaactgttggcctacctgcaaaccttgtcgccaacgacgccagtcgcgcaaagtcgtgtgagtcatgatacgggcgtgagtgctgccgtgattacggcagcagaagcaaagggctggttggtcaaacaaccgatcgaggtgtaccgcgatccatttcaacggccagtaaccccaacggcaccattaacgttaaatacggcacaacagactgcagtgacggcgattacgcaggcaattgatgaacaacagtcgcaaaactttttagtggaaggtgtcactggcagcggtaaaactgaagtttatttgcaaagcattgcggtagccttagatcaaggccgaacggcactcatgctggtgcctgagattgcgttaaccccgcagatggttaatcgggttaaggcccgatttggtcatcgagtggcggtcttgcatagcggactatcaaagggcgaacagtatgatgaatggcgccggattgaccgcggcgaagccacggttgttgttggtgcccgatcggcggtatttgcgcccgttaagaacttgggtattatcattatggacgaggaacatgagagtagttataagcaagatgaaaatccacgttaccatgcccgcgacgtggctttatggcggggacgttatcatcattgcccggttgtactgggaagtgcgaccccttctttagaaacgcgagcgcgggcttctaaggggttgtatacgcgcctattgctagctaagcgggtcaatgatcatcccttaccgacggtgcacgttgtggacatgcgagaggcactaaagcaacaaggagaaagtgatttttcggaaccgctactcacggcaattcaagcccgattagaccggcatgagcaagtggtcttgatgctaaatcgacgtggttactcgtcgtttgtaatgtgtcgagattgtggctttgtgttgaaatgtcctaactgtgatatttcactcacgctacacatggatacgcacacgatgaagtgtcattactgtgggcatgaagaggcgattcctcacgtctgtcccaattgtcacagtcgaaagattcgttattatgggactgggacacagaaagtggaacaggccttacagcagttagtaccaactgcccggattttacgaatggatgttgattctacgcgtcgcaaaggggctcatgagaagattctccggcagtttggccagcatgaggccgatattttgctggggacgcagatgatcgccaaggggcttgacttcccagatgttacgctcgttggtgttttgaatgccgatacggcattggggttaccagacttccgggcgagtgaacgcacctttcagctattgacgcaagttagtggccgggctggtcgggctgataaaccgggagaggtctacattcagacgtttaatccggatcattacgccattgaattagccaaggaccaggattacgagcgcttttttgtcacggaaatgcatatgcgccatcagggcaattatccgccgtattactttgcggtacaggtcacggctagtcatgaagatgaagcgacggcggctaaagcgatgtatcaaattgtggcggcggttaaaaaggggctcagtgccaacgcgattgttctagggccaacacctaaggcaattgcgcgagttaaacggaagtattattatcaagtagtaatcaagtataaacacgaaccacaattaaaatcggttttggaacagattcgtcaggcggcccagattccggcccgtcacggcttatcggtcacaattgatccagaaccaatgaattttatgtaaagatagaaagtatggtggaacgatgacttcagtaatttttatgggaacgcctcagttttcggcgcccattttaagtagcttaattgataacggttatgatgtgttagcggttgtaacccaacccgatcgtcgtgttgggagaaaacacgttttaacggcttctcctgttaaacaggtggccgtcgctcatgacattgaggtgttacaaccagaaaaaatttccggtagttccgaaatggcgcgggcaattgagctggctcccgatttaatcgtgacggccgcttttggacaattcttaccgactaaattgctaaaagcagctaaggtggcggcagtgaacgtacatgcctctttgttacccaagtatcgcggtggtgcgccggtgcattatgctattatgaatggcgattctgagaccggggtttccattatgtttatggaaaagaaaatggatgccggggcggtgctggcacaacgggccatcccaattacggatcaagatgatgtggggacgatgtttgccaagcttagtgatttaggccgtgacttactgttagaaacgttacctaagctactggctggtgaattgacccccgtcccacaagacgagtcacaagtgagcttttcaccgactatcaaaccagaagaagagcgggttgatattaacctgagtgcgcggatgattgactgtaaagtgcgggctttacgtccatttccaacagcacatatttatctaaatggtgtgcggaccaaactttggcacgtgaccgttttggaccaaaaaacagacttacagcccggcgcagtcgttagtcgtgataagcatcatttggcaattgcaactggcgaacagggtgttttaagcttagatgaactccaaccagcgggaaagcctaagctcagtattacggattatttgaatgggacaaccgacgcattgaccgtcggcgaacaggtggcagaataatgactaaaaatcaaacgcccagagcgttagcagtagaagctttaacgcgagttgccggtggggcttactctaacttgcaactcgaacaaaccttggaaagccaccgattaagtgatgttgatcgacggttcgtgacgaatttggtgtatggcacgatccagcatcaattaacgttagaatactatttatcaaaatttattaagcctcagcaaaaggttttgccatgggtcaagatgacgctaatggtggccctctatcaggaactgtatttagatcgtgtgcccaagcgcgccatctttaacgaagccattcaattagctaaggatcgcggacacgaaggtatccgtcggtttgtcaccggggtattgcatgccattgatcgacagggattaccagacttggcacaaattaaagacccaattgaacggctgagcttgcagtattcagtaccaacctggctaatcacagcccttcaagaacaggttggcgaagacaaaacgatgcaaattttagcaacaatcaatcaacctgccgcccaatccattcgcgccaacgtggctgtgaccacggctgaagcggtacaagctgcattagcagcagaagggtatcaggtcacgcctagtcaggtagcggccaatgcctttcgtttggacgacaaagcggctaaccagagtgcattgttcgctgatggggccattacgattcaagatgaaagtgctatgttgcctgtggaggctttacagttacgcccgggtgatcaggtcctagatgcgtgtgcggcaccaggtggtaagaccacccaaattgcggcacaactggatgcgcattccgggggtaaggtgacagccctggatctgcatgaaaagaaagttaagctgattgaggccaacgccgaacggttacatgtgactgatcgcgtggatgccgtcgctttggatgcccgtaagattgatgaccaatttccaaagaagcaatttgatcgtattctggttgatgcgccctgttctggattgggattgatccggcgtaaaccagaaatccggtatgaaaaaacgccccaagatattcagcagttacaacgggttcaattggatattttgaacgcggtcagcaagaagttaaaacccaatggtattttggtttatagcacgtgtacgatcctggacactgaaaacgatgaggttgtggcccaatttctagccacccatccagagttttcgcctatgcgggtgacgactgcccagaatattaagagcgatcggtcgactgacacgctaaagatttacccagatgactttgattcggacgggttctttgtcagtgcctttcggcggcaaaaataggagtggcaacaatggaagtggcgtatcgaacgtctattggtcagcaacgggcagataacgaggattatgtggatgtttttaccaatcaggcgggacaacatctggcaattgttgccgatggcattggtgggcgccaagggggcgacgtcgctagtgcgatggcggtttctcacttgggccatgagtttgtccaaactgatttggcgaccccggaagcggctcgaacgtggatttcaaaagagatcacggcagaaaatcagtcgattattgataaatctaatcaatttgctgacctcaatgggatgggaacgacactggttgcggcactttattttgctgaggaagtggtgattgccagtatcggtgattcacgggcctatcttctccgcgatgaccaactgcgtcaattaacagaagaccactcgttggtcaatgagctggtaaaacgcggtgaaattagccgacaggcggcacgccaccatccacaaaaaaatgtgattattcggtctttggggatctccgatgatgcgcggtttgatcttaaaacctaccccttggtcttaggcgatcaattggttttatgtacagatggtctgacgaacatggtagaagaccaacagattaaagcagtcttgacgagttcactgtcggtggcagaaaaatgcgatcgcttagttgaattagccaatgcagccggcgggttagataacatcaccgtcttaatcattgccaacagctctcaggaggtggtggactaatgcggacggggtacacattaaatgaccgttaccgaattgtccgagcactgggcgaggggggcatggcaaatgtctatttagcacgcgaccttattttgaatcgggatgtttctgtcaaattgttgcggttagacttacgggatgatccgggcacaatccggcgttttcagcgtgaagcactcgcggcaaccgaattggttagtcccaatattgtacaagtctacgatgtgggcgaagaaaatgggatgcagtatttggtgatggaatatgttgagggaactgacctcaaggcatatatcaagcaacactttccaattccgtatcaagaagtcattcaaattatggagcagattctaagtgcggtgaaaacggctcacgagcataatattattcatcgggatctgaaaccgcaaaatattttgattgaccggaatcaagtcgctaaaattaccgattttggaattgcagtggccttgtcggagcataacctgacacagaccaatacggttttaggctcagtgcactatttatctccagaacaagctcgtggcggaatggtgacgaagcaatctgacatctattcgctggggattattctatatgaacttttgaccggaacggtgccatttgaaggcgagaccgccgtgtccattgtcttgaaacatttccagtcagagatcccgtcagttcgtgatcttgatccgcggattcctcaagcattggagaatgtggtgctcaaagcgactgccaagcgtcctagcgatcgatatacggatagcttaagtatggcggatgacttgcggacagcactatcgcctaaacgtgcgggtgaagtacgatttacaccagcggttgaagaggatggggagaccaaggttttgccagccaatgcattaagctcggttgcgccagatactgagcaagcagcgacaacccaatcggctccggccgcgccggcaactgaacataaggtaacccccaaggggcgaaagaagacgcggcacccgcgccggcgaaaatttttactagctgggctagtggtgttattggttttgttaggtgtcttgattggtgtgggacttttccgtccgcaaatgaccaatgtgccaaacatcactggaaaaacggaagcggtagccaagagccgtttgcgggatgcttacttgactgtcggaacggttcataagactgcaagcgctaaggtcaaagtaaaccgggccgtgaaaaccgaaccgcgatttgggacgcagttgaaacggcagactatcgtggatctgtggatcagtacgggacctaagcgctataagctagcaaattatcaaggcgattcgtatgccagtaccgcagctaaactagaagcgttgggcttcaccgttcatcgcgagtctgtgcactcaacaagtgtgccagcaggaaagatcatgcagcagagcgtgactgctggtaaacaggtggtaccctcgcggacctcgataacgctaatggtttcaacgggatcggcaacggtcacattggctgatttaacggataaaactaaggttcaagcgcaaaactatgcaacggcgcacaacttgaatttggcctttcaatacacgtattccagtgatgtgaccaagggccatgtcattcgccagtcaccgggtgaaggtgccgtcgttcaagaaggtgatgaggtcaccttaaccatgtcacgtggtgaacagaccgatagcagttctagtacggatcagttcaacgtcaccctaaaaattccttttgatgagggggactcggacagtagtagtgatagcgctaatgacagcacgtcaagctcatcggcgtccaacctgattcagatttatttaaaggatcaggatcattcgctaaacaccgtttataagcaaatgacgattaccgctgatacaacagtgacgttaccgtttacggtcgtgtcagggaaagcaggagcttataaagtggttcgtgacggccacgtgattgcatctgatagtcatgtgacgaaaaattaaggaaaacacctgcaattctgactcagttcttttataataaaggggaactgagtttttttaatggtgacgagcaaatgggctagattggctcaactaatcttgtaagggaggtgctacatggcagaaggacagattcgacaatcactcagtgggttttatgacatttatagtgaaggtaaaatgtatcgaacccgcgcccgggggaactttcgtaaacggaagattacgccgttagtaggtgaccgcgtcaaatttgatagttcatcacccaaagagggctacattttagagatcttaccacgggataacgcgttaacccgaccaccggtagctaacattgatcaaggagtggtcgtgacagcggtcgcggcgccaggattttcaactaatctactggatcggcaattgattgcgttagaggtgagtcacattgctccagtcatttacttcacgaaaactgatcttatcgatgatgatcgttatcagacgtttgaaacattggctgtcggttaccgaaaaattggttatcccgtgtgtttgacgcgagaaccctttgcatcaactggtttggatcagctgcgcgacacattagcgggtaaagaaaccgttattatgggtcaaacgggtgccggaaaatcaacgttattgaatcatttgtcaccagaattaacgttagcaactggtgaaatctcgacggccttgaatcggggtcgtcatacgacgagaaaagtcagtttgatgccggtagcaaatggtttagtagctgatacaccgggattttcttcgtatgatacgctcaccattgactatcgggaattgggacaatatttcccagagttcctaaatgttgcgagtgaatgccgttttcgtggctgtgtgcacgtgaacgagccgggatgtgccgttaaagatcggctagctgcgggtgagtttatgcaaagtcgatatgacaactacctccagttactgacattgttaaagaaccaaaaaccaatttataacaagaagaaatgaggaagagaatttatgattaaagtagcgccttcaattttaagtgcagattatgtgaaccttcaaccagacattgaaatggtcgataaggccggagctgaagttttacacattgacattatggacggtaactttgtgcccgccttgtcttatggtccaggctgggttaaagccattcggcccattaccaagatggtcttagatgttcacatgatggttcagaatccagaacggtacgttgaagactttgccaaggctggcgctgatattattggggtgcatgttgaagcgacaccacatattcaccgggccttacagatgattcaaaatgcgggtgtgacaccagaagttgtgattaaccccgggacacctgtttctgcaatcgaaccagttcttgatatggtcggccaggtcttagtgatgacggttaaccctggctttggtggtcaaaagtttctccacagcacggtggctaagattgctgaattggatgctatcaagaaggcaaagggctacgactttgatatcgaagttgatggtggtgtgaatgaccaaacggttgttgattgtgctaatgctggggcaacagtagccgttgctggctcatacgtcttcaatgctgatgatccagtgtcacggatcaacgccttaaaggacgcgacgaaataatgccacgcggcgggacatttaatttattagttggtggtccgaaggtcaactggccggaagactttgccacagaaactgatggatcttggattggggttgatcggggaacgttacgtttgatcgatcttaacattcagcccgtcgcagcaattggtgattttgactcgttggcagcgcccgagttgcagcgtgttcgtcgcaatgtaaaggatattcgtcaggcgcaagttgaaaaggactttacggatacgcaaatggcggtgtctgtggcgtttaatgactacggagccgagcgggtagacatttacggagcaacaggcggccggttagaccactttttagccaatctttttttggtgctggaaccgcggtttaagcgttatgcggggcagattcggttgattgaccgtcaaaatacagtcagcttttatttgcctgggcgccatacgattcaaaaagaggcagacaaaaagtatttggcctttgttccattaacgccaattgaccatttaagtttgctagatgaaaagtatcaattgcacaatgagccaattccgtatccgatttcctttgccagcaatgaatttgttggggagacgggaacctttcaattcgatacaggactactcggtgtgatccagagtcgtgacacgtatgaagcgcgtcatgaataaattaagagcctgggataaacttcccgggcttttttgcatcaaaaattccaaatgattacagcagaacacaaaaaaacacgaaccagcatgctgggttcgtgtttttttatatccgggtccgttaactagacgcgggttactttacctgatttcaaagtccgagcggaaatccaaaccttctttggcttaccgtccactaagatgcgaaccttttgtaagttcggcttccaagcgcgacgacttgaattcaaagcgtgagaacgcttgttaccgaagtgcgtccgcttgccgttgagaaaatcctttgccatggcgtaaaccctcctttgtggtttcgttactttttaaaaaagcagtgctttttactcacctgactaatttaccatactcttttgctgaacgcaatggtttctttcaaggaaatttacttgacacttatttaccgctagggcgtgcatttcggagttcctatttctatttttgcgtgggttgtggtaagattaatttctgttaagattctatatccagataaggaggctatttccatggccgtaaagattaagactcagtacggaacaattgatatcaccaatgatgtgattgcgaccgtagttgggggtgccgcgactgataattatggtgtcgtgggcatggcaagtaagaatcaaatccgagataacgtcaatgatattttgcgacgggagaattatgcccgtggcgtagttgttcgccaagaagaaaatggtgtggcaatcgatgtttatgtcattgttagctatggcacgaagatttctgaagtgtcacgtaacgtgcaatctaaagtcaaatacaacctagaaacgatgctgggagttactgcaaactcagttaatgtcattgttcaaggggtgcgggtgttggctgattagccagacgtactgaaatcaaggaggatacttagttgaaagtaacagaaattactaatcttgagtttggtaagatggttcaggccgcctcgcaaaaactaaaccaaaacgctgattttatcaactcattgaatgtgttcccagtgcctgatggggatacggggacgaatatgagcttgtccttagctagtggtgctaagtatgaacgtgatgccgatggtaccgccgttggtgttctagcgactgctttagccaaaggtctattgatgggggcccggggaaattctggagtgattttgtcgcagatttttcggggattttccaaaaagctggcggataagcaaacgttgacggcccaggatttggccgatggctttgcagccggggcagaaacggcgtataaagccgttatgaagcccactgaaggaactatcttaacggtagttcgtgagggggctcaggcgggattaaacacagctaaatcatctgatgatgtcttagctgtcatggacgctatttatgaagccgccaaggcagcactagccaccacacccgacctgttaccggttttgaaacaagttggcgttgtcgattctggtggtcaaggattgacctttgtcttagaggcctttaatgactcattgaatggtcgggttgccgaagatggcgaatacaagccagatgatgctgaaatggacgaaatgatcgacgcagcccaccaccaaagtgtgcaaggaaagcttgatcctaacagtatcaagtatggatattgtacagaaatcatggtgcgtattggtcgcggtaagcaagtcgatcatgactttgattatgatgaattttacaaataccttgctgatttaggggattctctgttagtggtcaacgatgatgaaattgttaaagtccacgtgcatacggaacaccctggaaaagtgattgcttggggccaggaatttggtgatctcgcaaaagttaaagtggacaacatgcggatgcaacaagaaaccatcatggaacatgatgaagaagctgctgcggatgctggtgtggccacggcgactgctgacgaagcaccagcggatacggcgatcattgcgattgctgccggtgatggtttagcgacgctctttaagagcctaggcgtgacgcatgtggttaacggtggacaaacgatgaatccaagcacacaagatatcgtggatgccattaatcaaagccaagcgaagcgggcgattgtgctacctaacaacaagaatattttcttagctgctgaacaggctgctaaggttgcggatattccaagcgtcattgttcattctaagactgtttctcaagggatgacggccatgttgggctacaatccggacgctgaattagaagataatcaagcgtcaatggaagaaaacttgagtgctgttaagagtggtcaagtgacgcacgcgattcgtgatacccaactagatggttttgacatcaaggaaggcaacttcatgggaatcgtggatggcaccatcaaagtaactgatgcagacctcttgcagacagctgttgcaacggttaaggccatgttggatgatgatagtgaaattattacaattatttatggcgcggatacgacggctgatgttgcagaacaacttcaacaagcggttgaagcattagatgatgacctagaaacggaagttcatgaagggaaccaaccggtttacccattcttgatttcggtagaataacggtcacttaacgaagaaagattgggcacttgtccagtcttttttcgctttttatgacgggagggagacgataagatggcaagtttaagtgatgcagtcagtcagctagcaggcgttggtcccaagcgggttcaagcactacaaagtctaggaattgagaatatgaatgatctgttgacttattttcccttccgttatgaagacctacaggcaaaagacccggcggagttgactgaccaagcgaaagtgacgttaaaggggacagttgccggagcaccagtactcacccgtttcgggcgtaagaaaaatcggttgaactttcggctactcgtcgatgaacataccgcgatgcccgtcacgttttttaaccagccttggttgaaagatcaattagaagtgggaaatgaaattgtcgtttatgggcggtttgatgcgaaacggcaaagtctggtggggatgaagattttggctagcgcagatagtgggatggggtccatttacccagccaacaaggagattcgccaaggaactgttaaaaaattagtggccgaggcgtatgagcagtatgcgtcagtgattgttgatttaataccggaaaccttacgagaacactaccggttgttacatcggcgcaagatgattcatgacatgcatttcccagctgacgagacggcagcgcaagcagcacgacggacggctaagtttgaggagttctatctgttcgaactgcggttacagatcgttaagttgcaagatcacacattgcacgggcaacctttggcgtatgatttgtcgaagctcaaagcgtttatcgcgtcattgccatatgaattaacagccgcgcaaaaacgcgtggttaacgaaatctgttttgatctaaagcggccgattcatatgaaccggttgctgcagggggatgtcgggagtggtaagacggtcgttgcggcaattgcgatgtatgcggccattacggcgggagctcaagctgcactgatggccccaacggaaattttagcagaacaacatgcgaacaacttagcgaaattgtttgcagactttcccgttaatgtggcgctgttaacgggggcgacaaaggcggccgctagaaaaacgctactcccacagattgctcagggcggcgttgacctgttaattgggacccatgcgttaatccagccggaggtaacgtatcatcagctgggactggccgtgattgatgagcaacaccgttttggggttaatcagcgtcaagcgctgcgtgagaaaggtcagcaacccgatgtgctggcaatgaccgcgacacctattccacgaaccttggccattacagcttatggtgagatggatgtgtcagtcattaatgagttgccggctggtcgtcagccgatcaagacgacctggattcgaagtaaccaagttgatgccacgttgcgtcaggttaaggcagaattgagcacgggttcacaggcatacgttgtcacaccgctgattgaggagtccgaagcggtcgatatgaaaaatgccgaagcaatttatgagcgctttaaaaccgaatttgaaccgacttataaagtgggtcttttacatggtcggatgaaagatgatgagaaaaatgcgattatggccgcctttaaggctaatgaattccaagtgctggtagcgacaactgtcattgaagttggcgtggatgttcctaatgccacattgatgatgatttatgatgccgatcattttggactcgctcagcttcaccaattacgaggacgggttggtcgaggcactcgggcctctgcctgtattttgattgctgatccgaagaatcagttggcgattgaacggatgaccacgatgaccagtaccaatgatggttttgttttatcgcaaaaagatttggagttacgaggcccaggtgatattctgggaagaaagcaatctggtgtaccggattttaaggtcggtgacccagtggctgatcttaatatcttgagtgcggctcaacaggcagctaaagagaccgtggctgcccctaattgggcggaaaaggatgcgaatttggctttagcagccttcttgagcacgacagcgcaccagacaacaacgatggattaaaggagacggaaaatgaagattgcagtagacgcaatgggtggcgactacgcccctgatgaaattgtcaaagggattgaattagcacgcgatgcttatccagatttggaatttttattgtatgggcaaacggcaaaggtgcaaccgctgttacagaatacaacgcggattgaactcgttgatactcctgaagtgattgccatggaagatgaaccggtacgtgcagttcgacgaaaaaagcaatcaagtattgtgttagctgcaacggcggttcgtgagggccaagcagatgcgtttttctctgccggtaatacaggggcagtgctagcagccgggttgttaatcattgggcggatcaaaggaattgaacgaccggggttgacgacgacgctaccagttttacaacggccggatcaatctagttttgttatgctcgatgtcggtgctaatgcggacacgaagccatttaatgtcgtgcaatacgcgatcatgggccagtattacgcgcagtcagtcatgcacgttgacaacccgcggatcggtttattaaataatgggacggaagccgataagggtgatatggctcaccgtgcgattcatgatgccttggctgacatggcggaaatcaatttcgtgggtaacgtcgagtcacgtgaattgttaaatggagctgctgatgtggtagtaacggatggttttaccggaaatgcgacgctaaaagcagttgaaggcacagccttatccatgttaaagctaattaaaggcgagattatgagcggcggcctaggcggtaagattggggccagcatgttgaagcccgtcttccgtcaggtgcgaagtgcgatggactattcacagtatggcggcgctgttttattaggattaaaagcaccagttgtcaaaactcacggttccaccaaagcggaaactgttaagaatacgattggccagattcaggaattgctggcgagtcacagtgctgatcagttagggacttattttgccgaacatagtgatgaaatggcggctttgaaggagaacctaaaggcctaattgacggggaggttttcgttgaaacgctagacatggtggcctaaaacggttagactacttattgaatactgtgagtgagggataagaatgactaaagcagaaatttttgataaaattgcggatattattgccgaccgatttgaagtcgacagagacgctatcaatgatcaattgaacttcaaacaagatctggatgctgattcaattgattttgttgagtttgttttggaattggaagatacattcagcgcagaaatttcggatgaagacgctgaaaagttaaacacaattggtgaagtggttgattatatcaatgcacatcagccaggtgacaagtaaacattgagcgagtccgggccgcaacctgtcgtcccgggctttttcaatctaagtatacagaaatgagggatcagacgtgattgctggattaaatcaggaattaaaggatcggttcgatattcattttaaggatcaatcattacttgacgaggcgtttacccaagcgtcttatgtgaatgaacatccccaccagggcttaaagttctatgaacggattgagttcttaggggatgcagtgatgcagttagttgtttctaattatattttccgccgttacccggctatgcctcaaggtcggttgacccgactacgggcagcgatggttaacgaacaaagttttgccagttttgctcgtgagtgtcacttcgatcagtatattcggttaggtcgtggtgaggaaaaggcgcaagcccggcaacgtgactcgctgttatgcgatatttttgaatcatttatcggggccctatacatggatcagggcttggataaagttgttgaatttgtgacaacggtggtttttcctaagttggatgagggccgatttgatgagttctttgatcataaaacggagctccaagaattggttcaaaaaaatggaccagttgatattgactatcgcttattggatgaggaaggccctgataatgatcgggcctttaaggtagcggtttacgtggatgacaagctgttaggcgaggggcatggccattctaagaaacatgcggaacaaaatgcggcgcgacatgcgttagagaacttgaagtaaggatgaacaaacgatgcggttaaagacattagaaattagtgggtttaaatccttcgcggataaaactcgaattgacttcttgcccggaatgactggcatcgtcggccctaacggtagtgggaagagtaacatttccgaggccgttcgctgggtgttgggggagcagtccgccaaaagcttgcggggaagtaaaatgccagacgtgatttttgctggatcggcagatcgccacccgttaaatcgtgcggcggtgtcaattaccttggacaatagcgatcattatttaaagagcgactatacagagttaaccatcagccgactattatatcgatcgggtgactcagaatatcaattaaacggtcagagttgccggttaaaggatattaccgagctattgatggattctggtatgggacaagactcgttttcaattatttcacaagggcgcgttgaggccattttcaacagcaagcctgaagatcggcgaaatattattgaagaggttgcgggagtctacaagtaccgcaaacataaggaaaaagcgcaacgcgagttagacgacaccatggcctatctacaccgggtcgaagacattattgctgaactggaagggcgcgttgaacccctagaagaacagagtaacctggcccaagattacctggatcaacagcaaaaatttgcgttgcttgatcgaacacagttagtgcggcaattgcatacggaaatggcgcagaagcaaacggccgacacgcaagttgttgccaaacagacgcaggtagcagcgcatcaggcggcagcacaagagcaagcagcaacggtgcaagcgttaaagcagcaacaaactgagctattggcccaaaaggatgctttacaagaaaaattggttacggcgacacagcaagtggcgcacagtcagggacaagttaacttatcgggtgagcaacaacggcaccaagatgaacagcgacagcagttacaagcacagcttacgatgctatcccagcagttgacaactaaccagaccaatttggcagcagtccaggctgaatctgaccagcttgcgactacaatgaaggatgcccaaggtgcgattcgccagctaacagcggcaacggatcctcaagtggtcactgatttgcgtcaacagttggaagaccagcggaccgcttattttgaccagaaacagcaagtggccaattggcgcaatcaacggcaatatcgtcaacaggatcagcagcgattacagcaacaagggcagcgggtcgctcaacagttgacgcaattacaagcaacggcccaatccgcgcagacagcggtcactgagattcaggctaaagcgacggctcataaagctcagttgaacgaagcggagcaggcattagatgcagaagcgggtcagtatcagcaacaccaaaaacaataccaagcattgcagcacaactggcaggccgcattagaagtctatcagcgagcgcaaacgaaagtggctaatcaacaagcttcatcggctgaatatggcggtttttatcaaggggttcgggctattttaaagcaacggcaacattttcgtgggttactgggagcggtatctgaattacttgacgtcccccaacgttataccacagccgttgagtatgctttgggtggtcagctccaacaagttgtcgttgacgatgaaacgaccgcgaaggcggcggtcgggtatctgcgggatcaccgagccggtcgggccacctttttacctttaagtaccgttcggggccgccagattgaccgacaaacgctgcagctgttgcacagtatgacgggctatttgggggttggtagtgagcttttgaccatcaatgaccaagcccaagtgattctccagtatctgttaggaacaacgatttttgcggctaatttagatacagctgtcgccattagccagcggattcatcatcggtatcgagtggtgagcttggccggggacgtggttagtgcaagcggtgcaatcacgggtggtcagtccaaacaaagccatagcagtgtgttacggcaacaacaagagttacagcaattacaggcgtctattgctacgatgcagcaacagttgacggaccaagagactaagattaaggcccaacgtgcagccttacaggccagtgaacagcgtagtcaagcgcttcaagcaacgatcaatgagcttcaaccgcagtgtcggcagttagacgatcagttggctaacgcccaaacaacgttggagcaagctaaccggcgcgttaaggcggctgagttggaaatccaacaggcccatgcgggtgaaaccgatgaacaagcggatcaattggcagaacaaattgttcaaggtgaagcccaaatcactgaaactgaggcagcggttaagacacttcaagctaagattaagcaagtaacgaccgctcaggcccaacagcaaagtgagctgacggccaaacagacttggttggcaggagctaaagagcgtcagcaacaacagcgggcaacggttaagcaattgcaagcagatatagctgcggcgcaaacggatcaagcaactgccacaactaagctggcagagcttgaccgtcagcaggcgttaacgcccgctgatgcccaggcgcagttggctcaggcccaagctgatcggcaaacaatcgaacagaaacttgccacaaccaatgagcagctaacaacggtcaatgacgatctagcagccgcagaaacagctaatcagcgtacgagcggcttgctacaattagctaatgatgagctgcaacaggctcaagtcagtcaaactcagttagcggcactgattgatcagcagcaaaatcagttgtcagaaaaatatcaattgagtttagccgctgctgaaaaagatatcagtgatctgccagctgatgacttagcggtacagttaaaactattaaagcgcggattggatgaaatcgggacagttaatcttaatgcgattgacgagtatcgagaagttaaggaacgctatgactttttgacacagcaacgggatgatttattgaccgccaaggcgcaattaatgacgaccatgaccgaactggatggtcaagtcaaaactcgctttaaggctagctttgatcaaattgccgcgaaatttacggctacctttcggcatatgtttggcggcgggacggctgaattggtattgaccaatccggatgatctattgacgacgggcattgatattatggcgcagccgcctggaaagaagttccagaatatgggacttctctctgggggtgaacgggcgttgacggctatcaccttgttgtttgcaatcttgcaagttcaaccagtaccgttttgcattttagatgaggttgaggcagcgttggatccggctaacgtgacgcgttttgcccggtatattcatcagttccaagatcaaacgcaattcattgtcatcacgcatcgaaaagaaacgatggttcaagcggatattctttatggggtaacgatgcaagaatccggcgtctctaaaatggtcgctgtggatcttgatcacgaagaaacgcgtacagaagggaagtaaatcgtatgggattatttgatattttccggcggcgagcgaaagaaacaccagctagccaagcggaagaaacaccagttgagtcgaccgcaacaacgtctactgccgccagtgaagcgagcgaatcggcagctgataacgctacgtcagttgctagtgaagcatctgccgcagcagaaaccagcgaggttgctgaatcaacagtagctggttcagtaccggttgctaacagcgattcagcagatactaatgcatcactggcagcgaccgctactagcgatgcagcggttgaaactgaaacgagcgaaacgtctcgtgcagattcggcatcagtaacagctgatgtcttagatagtgtggcatcggcaactagcgcagcagcgacagttgatacgccaaccgaagtgctacagtcaacaccgccagcctcatcagcatctgctgaggtagagacgcctgcaacaaccgtcgaagagtcttcgacaactgacgcctcggcaccagaagcaagtgatgagcaactttatgacaaagggttggaaaaaacccggacgacttttggccaacgactgaatgccttattggctaatttccggcacgttgacgagagtttctttgatgacttggaagagacgttaatcggagccgatgtcgggtttgatatggcggttaaactcagtgatgagttgcgtgacgaggttaagttacaaaacgcgaaaaagtcacaggatgttcaaaacgtagtggttgaaaagctggtggagatttatgaggcagccggtaatcatgaaactacggctatcaatatggcagaaaccgggccaacggtgatcctattcgttggggtcaatggcgtggggaagacgaccaccatcggcaaaatggctaatcgttatcatcaggcgggcaagaaagtcttactggcggcggcggatacgtttagagctggtgcaactgaacaacttgatgtgtgggctaaacgcgcggatgttgatattgtgacgggaaagccacagtcagatcccgcagcggttgtttttgatgctgttcaaaaggctaagcaagatgattatgacattttgtttgttgatacggctggtcggctacaaaacaaggtcaacttgatgaatgaattggaaaagatgaagcggatcattacgcgagaaattccaagtgccccacatgaggtcttgttggtgttagatgccacaacgggtcaaaacgcgttaacacaagctaagctgtttaaggagtccacggcagtaacggggattgtcttgaccaagcttgatggaacggctcgggggggaattgttctggccattcgtaacgagttacacgtgccagtcaagttcattggtttaggtgagcagatttctgacttgcggccatttgacccgaacgagtttgtttatgggttatttaaagggttgattgatgtgaaggctttagataataaataaagcgcagacgtgctaattgcctagctggcgattggtacgtttttttggttaaactgtgagcgataattggtcaaatagttgacaggagttagccaataatcggtgaaaaaaattgacgtacccgctaaaaatcggtactctaatagagtgtgactaaagtgggaggacccagcatggaaatcgaaaaaaattatcgaattaattccctatttgcgttctaccagccgctattaaccgctaagcagaataattatatgcaattatattatggtgatgattattcattaggcgaaattgcggaggaattcaacgtgagccgccaggcagtctatgataacctccggcgcacggaaaaaattctggaagactacgaagaaaaattgcacctctaccaagaatttactgctcgtaaccggcaagctgatgagattcaggcttacgttgcgacgacttatccgcatgatagtcggttgaatcggctggttgcgggacttgaaaatctagaagaacaatgaaagttaggtggcaaaacgaatggcgtttgaaggactaactgaacgattacaaaacgcaatgcgtaagttacgtgggaaaggtaaagtctccgaaagtgacctgcgagaaacgatgcgtgagattcggctggcattactggaagccgatgttaactttacggtggttaaggacttcgtcaagcaagttcgggaccgggccatgggcgctgatgtgctcgaagggctgaatcctgcacaacaaatcgtgaagattgttgatgaagaattgaccaagacgatgggggaagaagccgttcccctgaataaatccgctaagatcccgacaattatcatgatggtcgggctacaaggggccggtaaaacgactacagcgggtaagctggcacgcaagctaaaagaagacgaaaatgcgcgaccactgatgattgcggccgacgtttatcgaccagccgccattgagcaattggttcaagttgctggtagtattgacgtaccggtttttgaattgggaacggacgtcaatccagttgaaattgtacgtcagggactcgcccaagcagcggataatcataatgactacatcattattgatacggctgggcggttgcaaattgatgaacagttgatgaacgaattggctgagatcaaagatcttgcgcatccagatgaaatcttgctgaccgtcgatgccatgactgggcaaaatgcggtagctacggctgaaggctttaatgataagcttgatgtgaccggggttgttttgaccaagttagacggtgacacccgtggtggggcggcactttcaattcgagccgtaacgggtaaacccattaagtttattgggcaaggtgaaaagctgaccgacttagatgtcttccatccagaccggatggcgtcacggatcttagggatgggcgatatgctgtctctgattgaaaagacgcaaaaggaatacgatgagaagcaagcccaagccttaacggaaaagattcaagaaaattcatttgatttcaatgactttttggaccaactggagcagattcaaaagatggggccaatggatgaactgatgaagatgattccaggaatggctaacaatccagcaatgaagaatgttcaggttgatcccaaagacatgaatcatttgaaggcggtcgtgtattcgatgacgcctgctgaacggacgaatcctgatttgctgaatccatcacggcggcggcggattgcagctggtgctgggcgaccgattcatgaggttaaccggatgattaaacagtttaaccaaatgaagaaaatgatgaaccagatgtccaagggcaatatgtccgggatggaacaactcatgagcaacacgggcatgggtggcggcggtatcggtggccggatgcaaaagatggccttgaaccggatgagccggcaaatgaagaaaaacaaaaagaaacgattgaagcgtaagaagcgcaagtaacgtctaatgagttttagtggacaggtgagttgtttttcgctatactgtccctacagcaacataagggagtaactagcagaacgtttctgcggcaattccgtcagcaagaagccaatccgggattgccttaaatagtgagacttatgtgtgttcacaattatttgtgtgcatgcatgggtctcattttcttttacagaaaaggatcgatgcacactctgaggaggaatgacgatggctaaaccaccgttttatcaacaaactgtcgcaacgctttttcaagatttacaaacgaccgatgctggcctaagtaccgctcaggcacaagaacgcttagcccgcgatgggcataatgcgttgaatcaacaacgacggacaacgctcgttcaaaagtttattgcccaattcaaggattttatgattattgtgctattggtcgccgctctgattgcgggcttgacgggtgaagtcgtggacgccgtgatcatcttgattgtggtcgtgttaaatgcaatttttggtgtctttcaagaggccaaagccgaagaggccattaatgccctaaaggagatgtcggcaccaaatgcaacggtccggcgagatggtgccgttatgacggttaagagtgatgaattggttgtcggggatattgtgttgctagaagccggcgatattgtcccagctgatttgcggttaacggatgtggccaccttgaaggtggaagaggccgcgctaaccggtgaatcagtaccggtggaaaaggcgagtgccgttctcactgctgatgacttggcgattggtgaccgggccaatatggccttcatgaacagcaatgtcacatacgggcgggcaacgggggtcgttgtggcgaccggtatgcagacggaagttggccggattgccgggatgatcgaagctgcagatgaaacgaccacaccgttacaggaaaatctgacacaattagggaagtcactaacgattctgattttggtcattgccgcgattgttttcgtgatgggtatgtggcgccaaacagaaacctggattgacatgttgcttacggcaatttccttggcagtggccgcaatcccagaaggcctcccggcaattgtgacgattacgttagccttgggtacccagcggatggccaagcgccatgccattgttcgtaagttaccagccgttgagactttaggaagtaccgacattattgcgtctgataagactggaacattgacgcaaaataaaatgacggtggagcgggtctatcaattcgggcagttgcaagatgcccatcagttaacctttagcacggacgatcgattggctcaaacgatgatcttgagtaatgataccaaaatgacagccgatggactggtcggtgatcccactgaaacagcactagttcagtatcagttagatcaaaagtatccagttgaacaggttctggcggatcatccccgagtggcagaaattccctttgattcggaacgaaaattaatgtcaacgattcatccgttggctaatggtcagttcctcattgcggttaaaggggcgccagatgaattgcttaaacgggtgacacaggtggcaacagaaacggacgttgtgccctttacggctgaaattaaagagcgcattttgaccaccaatcatgaactggcgacgcaggcgttgcgggtattggcatttgcgtatcgccttgtagatgctgtcccaacaactttgaccagtgaaacagtggagcaagggttgactctagctggaatggtcgggatgattgatcctgaacggccagaggtcgcccaagcggttgctgatgcgaagtcggctgggattcggccgctgatgattacgggtgatcacaaagatacggccgcagcaattgcggcgcggctgggaattattgacgcgggtgatcaacaggcggttatcaccggtgctgagttagatgaactcgacgatgatacctttgccaaacaggtaaagaattatgccgtttatgcgcgggtggcaccagagcataaagtccgcatcgtcaatgcttggcagaagcaaggcaaggtagttgctatgacgggtgacggtgtcaatgatgcgccagctttgaaggctgctgatattgggattggcatggggattactgggaccgaagtctctaagggtgccagtgacatggtgttagctgacgataatttttcaaccattgtggttgcggttgaagaagggcggaaggtttttgctaacattcaaaaagccattcaatacttgttatcggccaaccttggggaagtcctaaccctgttcatgatgacgatgcttggctggcagattttggccccggtgcacattctctggattaacttggtgacggatacattgcccgccattgcgttaggaattgaacccatggaacgtaatattatgaaacagccaccgcgtgggcgtcaatcgaatttcttctctggtggtgtctttggtggcattatctaccagggactcttagagggtggcatcacgctgtttgtctactggttagcgctaacctatccagttcacgcagctactgatttggcgcacgctgatgcgttaaccatggcctttgccacattggggctaattcaactgttccacgcctttaactcaaagtcgattcatggctcaatctttacggtcggcttgttcaaaaaccgattctttaattgggcaattctgatcgcctttgcactgttagcgatgacgatcttggtaccgggcctaaatgacctgttccacgttgctcacttagatgcttatcaatggggaattgtcttgttggcttccttcatgatgattgtcattgtggaaatcgttaagtttttccagcgtcgcgtggtaaaatagcgtcaagtttatcatgaggcgtgttggtataaaagattaactgaaagttgcagcgccttgctcgatcattgccgtctcacaatttagtgagtagcagcgactgagctgggcgctgttttgtttaaagtaatgtgaaattggagggattagatggcgttaacatatcaggcttgtttagaagccacccaggtggtattggcaagtggcgctgtgcccactattgttggtgaagcaggaattggtaaatcggcgttagttgcggaattagctgtgcaacgtcacgctaaattattcaccaccgttgtcagtttggttgaaaagggggatttagttattcccgtgccgccattaaccgcggattcctttattcaaacggaggcctacggttcgctagcggatgtgcagtttggctactcgcatacgctagttgccatgatccggtatgctgaagcgcatccagatcaggaaattatttggttcttagatgagtttaatcggggcagtcaagcggtccaaagcgaattaatgaacttggtattacaacgtcaaattaatacgctgaagttaccagcgcaagttcacttggtgttggcagagaatccagacgcgacgatggcggggttttcccgtagtcattacggggtaaccccgggggacgccgcaattgctgatcggacaacacgactggttttagaagcaggtattcgttcgtggctgtcgtgggcgacagccactgttgatggtcatccccggattaatgggctagtgacggattatttaagcgagcatccccaagatttgcacgttgtgggcactgatggtctgagcgacgatgacttgcagccaacgccgcgagcgtgggagcgggtctcccgagcaattactgagttgcaacgtcaggaattattgcaaaatgccgcgattacggccgctattatgcagggaaatttaggcatggccgttgggacgacgttcgcgagttatttggcgcagcgtcgcccgggtctgacagtcactcaggcgttcacgcaagcagatgcggtcacgacgctaaccgggttaccggcggctcaacaacagcgggtgctccggcaatgcgcgacggattcagattggcccctgacaactgatgccaatgcccagcgattcagtgagttattagctgtttgtccagctgatggtcagtttgcgattgcccgtgagttggccgcgcaaccagatgtttttgaacacttgtcagctgctacgaaccagccgggagttgccacactgtatcagttactgacgaacatcggacaacgtggtagccaaatcgaggtgtagccatggtaagcttgacgcaagatcttcaccgggtcaaaacggcgagcgacactgttcgggttaagcagacacgcattttatatcaggatgccgtgatgtggctattacaacatgatgcgttttatgggcgcgttttgagccaactgactttaactatcactgacgatcgggctccgctacagttacggccagttgctgatgaatggcagttagcggttaatccagctgccttacaagcgaccacctggacaggggctaactggttggcgatgttacggcatacggttttacatctgctatgggatcatccgcaacgttatgctacggctttgcaaacgcctaagcaagcggcactggttcgctgggcgacagatgcggcgattaacgattatttaacggatttacccgaagaagccctgacaagtcgtcagattgcgacggtattgaagcagcgggtatcaccttggcaggactcagccgtttattggcggctcttgcaaaaatggcaggccacccctgaacagcaggcgcgacgattgtcacaggctggaccgatgacaaatactggccagttgccagtggatggtcatgccacctggcaactggctgacccagagacggctgctaaccgtgaacagtggcgctctcagctcttcactacggtggtagcagccatgagcgataaacaacgcggaacgttaccaggagcaattcaggcggcactcacgccacttgtggcaacgcggccgctagattggcgggcgttaattcagcgggggctgggacaggttccagcgggacgacaagcagcatatggtcgctttaatcggcggcaacccgcacgaatggaactgcccgggagcattgtccaaacgtggcagaaaattgcggtttttgttgatgaatctggttctatggggaataacgaagtgcgctatctattgggacaactcgcggccttattgaccgtgtatccaacccaagttactgtgtatccgtttgatacgcaagttcatgaagatcaacggttccaactggaacggcatccccaggatttaagacggactgggggtggtggtacccgattccaagcggtttttgacgccttaccccgggtcctagctggtcaggccggtagcttagttattattttaacggatggttatggggaaaggcgggtgcaaccaaccctaccggcggcgatagtctggttactaaccagtccgattaccgcgttttcggttaaagaagcgccgggaagctgcattagtttggcaaatgatccgcaatggcaagcacttaggaggttgtcatgagttacttaaccgcaacagaattacgggcgttgattcagcaaacgccggcatatcgcaatgcccaagcaattttgaatgatgagtgggcggctcaagccgcagagaatccactctttcaagccccgatgacggtagcagatttaaagtttgctcgcgatttgcaactagccggggttagtcaaatgggtcccgattttacgaattatgcggctgttcagcaatggattgcggctaatcggccctcattaacagcagatgatattgcctggttgcaacaaaattgcgaataatttcaaggtgtaaagaaaaacctctttacatcatatcaagaaactggtatattattacacgttgaaagaaatacaggaggtgtctacatgtcagtaaagattcgtcttaagcggatgggttcaaagaagcgcccattttaccgggtcgtagttgccgattcacgaagccctcgtgacggccgcttcatcgaacaagttgggacttacaacccagttacggaaccagcccaagtgacgttgaaggaagaaagtatcttgaactggttgaacaatggtgctcaaccttcagatacggttaagaccttgctttcaaacgccgggatcatgaagcaataccatgaagctaagtacactaaaaagtagtgattagccatgaccgattttaagggattaattctcgcaattgttagcccacttgttgaacatccggaagatctggtgattacaccagttgagacggaacggttctacgaatatcggttggccgtaaaccctgatgatatcggacgggtgatcggtaaacagggccgcgtcgcacaggcgattcgtacgatcgtctatagcgtgcgggtccaaggcaataaacgggtacgactcatcattgatgatcgcccagcaaagactctcgagtgaggcggtaacgtttcctcgagtttttttgtctaaaaaaaactgacgtagataatgactaatcaaaaaaattaagtgaaatgaggaggccgttaggatgacttattatacggtaggaaccatcgtgaatacacacggtattaagggcgaggttcgagtagtcgccaccactgactttccagaaagccggtttgcggtggggtccacgttgtacgcatttcaaaaggatcaagcgacgccggttaccttaacggtagcatcggttcgccaacataaaaatttttatttgttgagttttgaaggtaaaccatccattaatgacgttgaaatcttcaagcaaagtacgttgaaggtaactgataacgaattagagagcaatgacttgcggccaggtgagtattactaccaccagattgttgggttggatgccgtgacggttgatggtgaaaatttgggtaaaatcaaagagattttgtccccaggagccaatgatgtctgggtagtggctcggcctggcaagagtgatctgctattgccgaagattgatcaggttatcaagcgcgttgacctcgatcaaggtaaggtaatcgttgaattgatggagggattagattaatgcggattgatgttttaagtctatttccggatatgttttctggtcccatgcacgattcaattgtgggtaaggcgattgaaaatggtcatttaactatgccggtaacgaatttccgagattattcgaccaataaacatggcaatgttgatgattatcctttcgggggcggcgctggtatgctgcttcagccacagccaatctttgacgcgctcaaagcgaccgaagaacaggctgcggcagaggggctccccaagggacgggtcattttgcttgatcccgctggcgtgacgtttaatcaacacgttgctgaggagtttgcccatgaagaccatttaaccttcttatgtggccactatgagggctatgacgaacggattcgcaccttagtgactgatgaagtctcgttgggagattttgttctcaccggtggtgaattggcgtcgatggtgatgattgatgccacggtgcgcttattacctggtgtactgggtaatgctgaatcggcacctggtgattcattttcctctggcttgttagagtacccccaatatacgcgaccagcggactttcgggggatgactgtgccagatgttcttatcagcggcaatcacggtaagattgaggaatggcggaaaaaagaggccttgcgccggacgtatcaacgacggcctgacttgattgaccatgaccaactgacggcggaacagaagcggttattggcggatgttcgaattgaagaggaagaacgcgcgtcaagaaactaacctttacaggtatttgcgaatatggtacacttgtttttggctatttagccacagcaacaacattccgctgtcgaacctgaggatgaatgttggcgaaaggataggaatatattatgcgccaaaacaatttaattgctaagatcaaccaagaacaattacgggacgatgttccagaattccgtgccggagatactgttcgggttcacgcccggatcgttgaaggctcccgcgaacggattcagttgttcgaaggtgtcgtaatcaagcgtaagggtgctggcatccaagcaacttacacggtacgtaagatcagtaacggtgtcggtgtggaacggattttcccattacactccccacgcgttgctaagattgacgttattcgtcaaggtcgtgtacgtcgtgctaagctgtactacctccgtgaacttaacggtaaggcagcgcggattccagaacgccgtcgcaactagtttcactactaaaagtatccgcaagtccaaggcaattttgctttggttttgcggatacttttttgtaagtgtgaattagacaatcggttgggttgtcgggacatcgcgaataagtgaaagaattttatttatatggccgacacattgctgatttccgttttgtgacacggctgtggtgggttcatgtttttgccattgtttgaaggcggccgaagccgttatttgatccaatatttaccatgcttgttattacttgccactttctcgtttgaacgggcagtggccaatgtccgccaattgtatgccgggtatcaccggcgagtggtagctgcgatagcagcggataacttggaacaagaaaaatgataaactgtgtctggcgcgtttggcgcagacacagttttttgtcggcattacgattaaagtgaggggaattgaaccggcgtaagaaaatcttaatatttaccgtaaatttcggtttaaatcacggtatttggttattttccgtaacgcctaagatttattttttgcgtaatggtttgatattcaaattaatatgcgatatgatgactttgctcaaaaaatttggttagttttgaattaatagtttgatattacgactaatattatgaattcgagataccttggtatagcggggtacgtagtcattagctttttttagactaatagtttgaacatcaaattaaatgggtggaactttcgctaaagaaagaaggatggttatgagtgttttgacggctgccgaaattatgacgttgattcccaatcgttaccctattttattcatggatcgggtggacgaattgaatccgggagaatccattacgtgtacgaaaaatgtcacgatcaacgaagaattttttcaaggccattttcccggtaatccggttatgccaggcgtcttgatcattgagtcgctggcccaagccgcatctattttgattttaaagtcggaacaatttcaaggaaagacggcttatctgggcgccattaaacaggctaagttcagaaaagttgtccgtccaggggatgttttgtcattatatgttgaaatggtcaagcaacggagtaatatgggaacggttaagtgtaccgcaagcgtcggcgagaaggtcgcgtgttcggctgacttaacctttatcgtagcagctgctgacgataaaatttaattcagaagaagaggaaatagtccaatgcaagctaaaccagaaaacaaacgagcagattaccgctttattaacgacgccctagtcgatatttatgataatatcatgcgtattgaagaggggtcgattaaacaaagtcggtttaaagatattactgctaaggagttacacttggttcacgcgattggactacattctcacaaaacaacttcagaagttgcgaagacactgaatctgagtaaaggaacattgacagctaacttgaatgttttggaacgcaagggttatattgtccgaacgacaaatcagcaggaccggcgcatcattaatctgggactgacaagtaaaggacgcttgctatatcgtgcccatgatgcctttcatcgtcaactagtcgaaggctttttaaagggttttgaccaagatgaggtgcaattgattaagcaagcgatggttaacctacaaacatttattgatgaggtttcattgaaatgaaatttgagaattttaacattctggcaacagctggttatacacctgaacgggttgtgccgaattcagagttaacaacgatgatgacaacttctgatgagtggattgttcaacgaaccggtatccatcaacggcatgtcgttacggcggaacggaccagtgatctatgcacacgcgtcgcccagcaacttttgcagcgaagtggtttacaggctacggacattgattatattgtggtggcaaccatgtcacctgattatcaaacgccggcggttagcgctcaagtgcaaggcaatattggggcgactaaggcggttgccctagatgtcaatgcggcgtgctccggctttgtttacggcttacaagtcgttcaccggttgttgatgggcgattcacctaagacggcgttattgatcggtggtgaaacattgagccgattagtcgattggcaagatcgttcgaccgctgttttgtttggggacggtgccggtggtgtcgtgttgaccagtgcgttagcccaagatggggcatttattgccgctgactatcgaaccatgggtgaacaaggccgttatttgaccgctggtgctaatggcgttgactcgccatttgccagtgatccgcaactggtgctcccgttctttaaaatgaatggtcgtcgggtttataattttgcgatcaaacaggttccagcatcgctgcgacgagtgctggaccaaggccatttagcagttactgatgttgattattttatcttacatcaagccaaccaacgaatcattgagcggattgctgaggacttaacgggatcaatggctcaattccccgttaatatcggccagtatgggaatacagcagcggccagcgaaccgttgctattgaatcaactcgtcacctcacacgtgattaaacgtggcgatgtactggcgctttctggattcggtggtggcttgacgattgggacaatgattttacgctattaatttaaaatttggaggcaatacaatgacaacacaagcagaagtttttaatcaattaaaggaaattttggtcgatcaactggatgtagacgtagataagattacgctggcaaccaattttaagaatgatttggaattagatagtttggatgtctttgaagtcattgaccatatcgaagatacttatgatatcgaaattgacgcggatacggatagcggcttagaaacggttggcggactggttgactatattttgaaagcaacggcaaagtagggtgagactgtgcaattagggtatctatttagtggtcagggtggtcaattccccgatatgggccaagacttatatcgccaggagccgcgttatcgtcaggtcatttcagcggccagttcggcgttatcagttgacttagcagatccgcaaatcagtaatgatccccgttacttgcaagctagtattgttgccatgagtaccggaatttttaacattttgactgccgagttgccgctgccactagcagccagtggactgagtttaggtgaatacagcggcttaattgcgagccagatgctctctcttgaagcgggcattagactggttgatgatcggtcacgttatatgacgttagcgggtactcaacaaccaggaaagctagtggccttgcccaagatgacggatatggctttactagaccaggcattaaaagtaggtcaacaacagggcattgtcacggtggcaaactataatacgcgtaagcaggtcgttattgggggaaccattgccggtgttgatgcggctagcgcttttttgaaggacaacgggaccaaacgtataatcccattagatgttaatgccgcgtcacatacgccattaatggcaccagccagtgagctgttgaagaagcgattagcgtcagttgtcagccattcggcagcctttccggtgattagcaatacaactaagatgccctttacccctgaaacattgccacagacactctgccagcaactcgttcagccgacgtattttcgcgactgtttacagcggctagcggcgttgggggtgacgacaacgattgaattgggaccggggcatgccttgaccggatttgcgaagaagacattgccggatgttacggcttggcatattgacagtctagagacactaaatgaagttcgacaaaaggtgggaaagtaatgacagaacaacgtgtggcaattgtcacgggtgccggaacggggattggcttcgctattgctgagcaattcctaaaggttggtatccgcgtcattttgaatagccatcatgaattggcgcctgctgagcagaccatcattgaccagtactcgacggcaattgttgtgacgggcgatgtgactcaggaaacgacagctgatgaattggtcacgcaagccatgaatcactttggccggttagacattctgattaataacgcgggaattactcgcgataagttattaacgagaatggcagctgctgacttcacagcggtgatgacaaccaatgtttttggggcatttaatttaaccaaggcggccatgaaagtgatgcaaaaagcgcgacaaggtgccatcgttaatctatccagtatctctggcttacacggtaatattggtcaggcgaattatgcagccagtaaagcggcaatcgttggtttgacgaaggccagtgccaaggaaggtgcgttgcggcaaattcgcgttaatgcgattgcgcccgggatgattgcaacggcaatgaccggtgcaatgagcgagaaaagacaagcagcagctcgcgaggtcattccattaaaacggtttggaacagtcgctgaaattgcgacgacagcactctttttagtgaacaatgcttatattaccggtcaagtgatcacggttgatggcggattaaccatttagaggaggaaaatcttaaatgaataatcgagttgtggtaaccggtatgggggctgttacgcctatcggaaatgatgtaaaaagttatttggataacctatttaccggcgttgttggtattgggccgattacgaagttttcagccgataccggcatttatgtggcgggtgaagtcaaagatttcgatgcgcaacagcgactgactaaaaaagcggctaagcgaaatgatctctttacgaattacgccttatattcggctcatgaagcaatgacgatggcggggctagatgagacgaccgttaaaccggaagatttgggagtcatttatggttctgggatcgggggcttgaccacgattgaagaacaggttattaagatgcatgataaagggcctaaacgagtatcaccattatttgtgcctaattccattgttaatatggccgctggagatatagccattgaattcaatgcacagaacacgagtcaagggattgtgacagcctgttcatccggaactaatgcaatcggaaatgctttcgagtatttaaagcagggcaaagcccaggtcatgattaccggtggttctgaagcgagtgttaacgagatcggaatcgctggatttgcggctttaaccgcgttaagtacagctagcgacgctcagatggcgtcaatgccatttgaccgggatcgacatggctttgttttaggtgagggtggtgccactcttgtgctagagacgctgacgcatgcacaagaacgcggtgccaatattttagcagaaattgtggggtatgggaccactagtgacgcgtatcatatgacagcacctgatccaactggaaaaggggcgcaacgtgcgatgcagcaagccatagacgaagccgaactagatcctagccaggtggattatgtgaacgcacacgggaccagtacaatggccaacgatagtgcagaggcccaggccattgctcacgtgtttgcccataacacgcacattaaggttagcagcaccaaagggatgacgggacatttgttaggggcggctggtgccattgaagccgtcgcaacgattggcgctttgcaacgacaacagttacccgtcaacattggtgttcgtcatcaagatgacgcttgcccagtgaccctagtaacggcccagaatcgtgagacgcccgttcactatgcgattagtaattcatttggctttggtgggcacaatgctgtactggccattaaaggggtgtaacgtgaatgaaaaacgaagatattgagcacctattggaaaaatttgatcactcgtcgttaaaagatttccacttggttcaagatgattttcagttgtcgttgagtaagcgagaagacaccaacgttccaacaccggcaacgattgaccaacctacgcctgagccagcgggtgaaacagcaaaggaatctgcagaaccgaccatcacggcgccattagttggcgtcgtgtatttggcaccggcaccggaaaaacccgtgttcaaacaaatcggggatcacgtggaaaaaggggacgtcgtgtgtgtggttgaagccatgaaaatgattaatgaagtgaagagcgacctgaccggcaccttaacgaaagtattggtgactgatgggagcatggtggaatacgatgaaccattattacaaatcaaaccagattaagaggcgttaaacgtatggatgtgcaagagattattccgcaacgatatccgtttcagttgatcgatcgattacttgatgttgagccaggcaagcaggcaattgctcagaaactaattacgattcatgagtggtacttcgcgggtcagacaaccgccaatccagtcgttccccgaccaatcttgattgagtcacttgcgcaaacgggcgtggcggcaattctgtcgctaccagcctatcaggatcgtaatgtcttctttggtggaattcgctcagctgaatttatgtcagatttttacccgggagatgatttaacgctccatgtcgcgttgacaaaaatgaagcgcaatatgggagtgggaacgggccaaattgtgcgtaaccatgagacgatttgccaagcagaattaatctttgcgatttcatgatgaaagtgagtgatgagatgtttacgaaagtattagtcgctaatcgtggtgagattgcggtgcagattatccgcgcattgcatgatatgcagatctcagccgttgcggtttattcgcaagctgatcgagagagtttatttgtcaagctggctgatgaagccgtgtgcattggtggcccgcaacccgctgattcctatctcaatatgacacaaattatcagtacggctaagttactcggctgtcaggccattcatccggggtatggttttctctcggagaatgccacctttgcgcggttatgccaacagtgtcagataacttttattggccccaatgctgatttaattgatttaatgggagataaagctcacgcccgtgcggctatgcaggctaatcaagtaccggtcattccgggaagcgatggggtactggattctgccgaccaagcggtccagattgctcaaaaaattgggtatccggtgctcttaaagtcagcagcaggcggtggtggcaaaggaattcgtgaggtacagacggcagcagagctaccagcggcatttgagcaagttcagcaggaagccaagctttcttatggggacgcggccgtatatttggaaaaatgtattggccaagccaaacatattgaaatgcaggtgattgccgataactttggcgaagtggtgtatttaccagagcgagattgttcgctgcaacgacatcatcagaaagttattgaagaaagtccttgtggcatgattgatgctaagcaacggcagtggttgggccaaacggttgcccgagctacccggaaattgggatataccaacacgggaacctttgaattcttaatggatcaagatcaccacttttatttcatcgaaatgaatacgcggttgcaggtggaacatacgattacggaagcagttacaggcattgaattggttaaggcccagattagagtggctgctaatcagccactgggttttacccaagcagatgtcaaattgaacggctatgccatcgaatgccgattgaatgcagaagatccacaacaccagtttgcgccctgtccaggtaagattacggcgttttatttgccagctggttcactgggcgttcgcattgattcgggcgtcattgccggtagtgtgatctcaccttattatgacgccatgattgccaagctaatcgttagttcccaacagcggacaacggcattagccaagatggaccgaattttaagtgaaatgcagattgagggaattaaaacgaatcgccaatttttgcggcagttgttaacgcaaagggccgtacaggccggaatgtttaccacgacgtttattgccgagatgcggcaaaaaggagatgaagcggatgttaccagcgaagttcaaaacgcccagtcagaagagccttaaccgacggatggcaagtattcccgatggattggttaggcggtgtcctgtttgtcatacgacctttttgaccgaccattgggaacctacgcggttatgtcccgcctgtggctatgggtttcggttaacggcaatgcagcggatcaaattaactatggataccttccaagaaacaaatgcgcaattgacggtaccagaccgttatacggatgctgcttatcaggccaaggttgctcggggccgccagctaaccggcttgaacgagagtgtgttgactggttttggcacaatcgatcaccagtcgacagcaattggcgtcatggatgcgttttttgtgatgggcagtttgggaacggcgacgggagaaaaaataacccgcttatttgatgaggcgacggctaaacggttgccggttattttgttcacggcttctggcggtgcgcgaatgcaagagggcattcactcactgatgcaaatggctaaagtttctgcggcagtggcgcgccacagtcaagctggcttattgtatatcgttgttttatgcgatccaactactggtggtgtgacggcaagctttgcgatgcaaggcgatctcatcttggccgaaccccatgccttagtgggatttgctggtcgccgggtgattgaacaaaccattcatcaaacaccgccggcagacttccaacgagctgagactgttctacagcacgggtttatcgatgctattgtggcccgtccacaattaaaacagcgattagcagatctgctacgacttcataagggggaatcttaatggttaaatcagcctatcagacggtgcaggcagcccgtagtcaagataaaatcacgactgaagccctgattgacgggctcgtgacggacttttttgaatgccatggtgaccgggtagatggtgatgatccgacaatcattggtggtatcggtcggctgaatggtcaaccaattacagtgattggtacccgtaaaggacgaaatctaacggagaatgtagcgcgccattttggaagcccgatgccccaaggctatcgaaaagttcagcggttattgcagcaagccgaaaagtttggccgacctgttttgacgctcattaacacccctggggcgtaccccgatgtggcctctgaatttcatggtcaaggagaagcaatcgcccaatgcctttatcaggggatgcaattaaaggttccttacatcagtctgatctttggcgaagggggcagtggtggcgcactggctttggcttgtggtgatcgggtgtatatgacagtagatagtatttacagtgtgttgtcaccagaagggtatgccagtatcatgtggaaagatgcgagccgagtgcgagaagcggcagcggccttggcattaactccgcaggatttgaaacgtgaaaaagtcattgatgatatcttgccagaggtccatacggccgctgagttatcgcaattgaccgacttcttacatgagcaatttaaaatactaggcaagttaccaatatcgaccttaatcgatcaacgacaaacccgatttgaccagtattaagaacatgatgaaaaaatggaggatgacagaatgaacggaatcttgacggacaaagtgattgtcgtgatgggcgtcgccaatcagcggagtattgcgtgggggtgtgtccaagccatcctagcacaaggtggcacccccgttttgacctaccaaaatgaacgactaaaaaagagtattcaacggttcgttccggaagatattcagttagtagcgtgtgacgttgctgaagatgcagctatccagcaagcctttcaacaaattggcgagcgctatggaaacatagatggtgtaatccatgcgattgcctatgctgatcccgaaacgttgaaacaaggactggttgaaacacggcggacagggtataacttggcacaggaaatcagtgcctactcattcattgcggttgccagatatgcgcgcccatggttgacgaaaccagccagtctaatcacgttgacttattttggggcaactcgagcaattcctaattacaacatgatgggcgttgctaaagcggccctagaatctagtgtgcggtatttggcaacggatctgggcacggagcagattcgagtgaacgcgatctctgccggtgcggttaaaacattagcggtcacggggattaagggtcatggcgacttactgaagatgtcaaccagtctgacagtcgatcaacagagcgtgaccacttcggaaattggtaacgtcgccgctttcctattgagtgatttatctacggggatgacgggggacatcctgtacgtcgataaaggtgtgcatttaatgtaagggggaacttctatgcagccaaagggcaatcaattagcggtggatcggattagggaactgcgccaaacgacgtgccccatcgcgattcagcttcgttcaacggttgattcgaccaatgcctgggcgaaacgagtaccggcggcaagtgactcgccaatgcaagcctttttggcggagcagcaaacagctggttatgggaaacgtcagcgtgcctttttttcgccagcctttcaaggtgtttatttgaccgttcgtactgcggtcactgcaccagtgaatccagggcgattgacaacggcagtgggggtcatggtggttagatgtctagcggctacctatcccaaacagacctttcagttaaaatgggtcaatgatattttgttgcatcaacgaaagtgtggcggcattctaattgaaaatttgctggatcggcaagaggttcttatcggaattggtttaaacgtgaccacgcggttttcaacagaattggcgaataaggccacctcaatcgttgggggcaattgggttgatcggaatgggttggttgccggactgctggatgagctggttatgggattaccacattatcaagatgcacagttcttggcggattaccaacagctatgcaccacgttgggacaagcagtgcgggttcaagttggaccggactgggtacaaggagttgcggttaccctgactgatcaaggagcgttagtgattcaactcgcgtcgggtgagcggcgaatcgttgcgagtagcgaagcgattaaggtgatgaccccggtcggtgattatcgtggataggaggaacgctatgcaagagcgtcagtcaattcccttagtgggattatttattgctattattgttatctttggtttttttccagcaatcccactggcaattagtccggttcccttggttttacaaaatatgggtgtgatggttgtcacattattattgccaacgcgtcaaagtctggctgcaattggtctgtttttacttctggtactggttggcctaccagtattggctagccgtcaagccggtccagccgtgtttctggggcctaacgggggatatttagtggggtggctgatcatgccgcttatgctgcaaggcttaacttatggccgagtaccacggttagttgccattctgcttagtgcgatgggtgttgatattttgggtgcggtgtggctgagtacagttacaacgatgtccctgccacaagcgctagtcgccacattggcctttatccccggtgattcgctcaaagcggttggcgcgtggtggttggctcagcggttacgaaaatgggcaccaaaaatgatataattaaaaagccttgactttttaagcaaactcctgtatagttattaattagagtttaagagatgctaataaagtgattcagagagattgattagcaagccggagtttcttagatttgaaaaacgctcgcccattcgtaggaatggcgagcgtttttttcagctattaagaacattgtgagccgttagtcgttgtaaatggaccagtatctggtacagttgagagtagagatgaaggaggcagacacatgtcaatcagtgatcatcagcagtggttagtggatttttatcgacaacgcaactggtaccaatattcgccctttgttcacctgaactttttaactgaagaagtcggtgaggtatcgcgagcaattcgcgccgaagaaattggccgggaccatccaggggaacgccaggcgacgatggctgaaaaacgcgcaaatctcaaagaagagttggcagacgccttggatcaggtgctggtgattagtagtttgtatgatattgatgcggctgacttactaacggcgagtgaacaaaagctgacccagcgatttaagcaaaagtaatgaaaaggcgatgtggattctggcataccttttgtgataaatgactagttctggctaaatcagttaatatgtaaaaactatgctgttataaagatagttggataatgtgttgtacaaagactattatagcaggaaatttggcttgattacttggtgaaacatgcttgctttattgtaatatacaaacgtactaaagggctgttggttgagcatggatattcttattgttaatgactaattgaacgactactgtagtactaagcttagtttgtgacacagattccctaacctaatagaaatgatgtgatcttatggctcaggcattaattgtcattgacatgcaacaggcattggcgaagattgatcgccgtaatcagatggtagcaacaatcaatcagcgaattgatcgctatcgagaggcccagcgaccgattatttttatccaacacacggaaccggggatggaagttgctagtgctggttggcagttatttccggatttacatgctgcaggatcggatgtctactataacaagactcgaccggactcattttatcaaaccggactagaggcctttttaaagatgaatcagctaaggacgattgaaatctgtggggcccaagttgagtattgcgtggatacgacaatccgggttgcctatcatctagggtttcagattgagttattgatggccgggatttcgacgcttgatagcgatctcttgacggcgacgcaaatcaaacagcatcatgcgcatatctgggagcatcgatttgcggagtttgtgacggcggacacggagttagatggtcagtatcaaaaatagaaagtctgttaaatgaaattgggggctagatggacaaaagccattgcgaatcagtatcgccccaaaaatccagctaaaattgctaatcaggaaaaggtcaacgctcagaagcacatattctgaacgttgaccttttagattgagagaattgaaattaatttgtgtatttgtggggtagtaatacgtcatttagatgttggaccgttttgcgggcgcgcagcatgctgtaggtccaaatgacgaggtaaataccaacaaagattagggtgtatagcagtaaccaagtcacattcagcgggaaccaaccggccaagatggccaatggtgtaaacccgagataggacaaccccaagtgccaaatggtctgacgagcgatactccaatgctcattgaagaaaataagactggttaggctaaagagtaacccgatcgccgcccacaagccggccgcggctagggtggccatcgtatttgaactaagatgggcgacgaaatctggtgatgaaggcataaaagtcgtggcgtggttggttaacgagaagaataacgtacaaataaatccaatcgagaggcctagaaaggcaccagaagtaagaatccctagtcgtttcattttaaaaactcctttcgaatttgttgcatgcagcgtcgtgagacgaatgtggtggcgccagttgagagtaagacctggccagaaggggtcaaggaaaaatggcgaatgtgctgtcgattgaccagttcgccactcgaaagctgtagaaataggtcactgggtaagagttgtttgagctggtagattcgctggggaagtgtataggtggtggccttggtttccatgaccatgtgtttagcatcggtgtggatacggataatttggtccactggtactagctcgcgagtcccccggggagagattccggcgattagttggctattcgtcaattgcgagatattagttgctaaatgctgaagctccggtgtttcagcaggagcgttaatggtaataaacggtgagataaaactggcgttgagattaaaggtcacgtgcatggttaccgcctgcctttctgataagttcagcatacgcagttttacagtagtcagcaagctttgcggagtatgtggttgttagtaccggatatttggttaacagcaggtgaatgcatttatatgctggatatgtatacgaatccgtagcttgtggtactctgaacagcttatcgtttgattcatgccaacttaattaattgggctaaccagcgattgctatgtttggaccaagtggcgtacaatgcggctatcgtaaatgaataagaggtgcaaaaatataatgacgaaatcaaatatcgttacgtatccggctgtattccatgataatgaagttggcgggtataccgtaactttccccgatattgaagacgctacaaccagcggccaaaccctaggcgaaagtctggtcaatgcggcaattgttctcggtcagacactccatgatcagccaactgtattaccatctgcgacgactattactgaattaatgcatcaataccccatggcatttattcagtttgtcgcggtggatttaaaccaagtcattgaatcagcagtaccgactgatcaagtggacctacaattgattcagtaactgatgaaataaagcgttgtgagctggttccgattatggggaccggctttttattaggtgtgagagtgagttgtcgggtggtgtgccagattgccgttgccacgtttctgcggtatgctataaaatataaatgagtctcacaacgaaactcataaaaaatggcggttttgaaattttggaataccggtttggcggtgtttctttagtgtattccccacacatgtgggggtgatcctgtaactgaatttgtgccggtgttgtcgctgtttgtattccccacacatgtgggggtgatcctgtcgaaggcgatgtacgtgaactgaaaagtaagtattccccacacatgtgggggtgatccctcccggttgactgacaccataagcggccacccgtattccccacacatgtgggggtgatcctagatggcctttttcggcttagctgccttagtggtattccccacacgtgtgggggtgatcctattagttggtcgaatagaaaaaagctaggtatgtattccccacacgtgtgggggtgatcctggctgaaaacgagcttgtagcatttgaaccaagtattccccacatatgtaggggtggtctcaatactggggatggctctaacaccgggggcaacactgataccggtaatggttcaaataccactggtgatgacaacagttcaagcatctcagtatcaatcagttcaaacgattctgacgaacagatcaagcaagctgtcgcaagtcttaaaaagattgccgctcgttacagcattagcactaccgctttagataacgtggttgctaaggcatcagatccaatgtcagcaactgacaaggcagaaattgttgccgcgttcagtaacgtggtttcaaagattaaagatattcagaactcagatcaaaacactgttgatcagaatactggtgacaatgcttcagatcctaatcacgccaatactggctacacaactaatttgagtggaacggcagcggctaataagcgtctttccgagaataagttagtgccagttaagccagattacgatactacaccgattaacccacacgataagaagtatctgattgatacaactgctcttcgtggtcaaaagatggtgatgattgaagatatgtcaactggacaaggaactaaggaagatcagattacttctgaagttgacgtgaacaacgcgaaacaaactgttcgcgtgaccaatccagcaatccataccatgcagaccatcaataacaaaaagaactttgttttgaagggcgatggctcaaacgtgcaagaaccaatcgttgataaagtttcatttactgactttgcgccgggtgaaaagatggtattaacggccgttgaaatggatgctggaacacaacaaccagtaattcttgataatcagtatttgattggacgtaagacactcacgccaacgacttctgatggtgtggccaccgttcaatttaatgaatttgacggtgccccaaatgcgcgttacatgactccggtactaaatagcgccggccttgttaccaacaatgctgtaaacgatggaatttcatctgcacaagacagtgataacaatgccgatgcggtcaaccgtgacgaaactaacgatgctcaggctgatggaacaactacaggtgcttaccaaggtgttgccggtttaggtctggggacagatgatacggatgctgaaaccgacacaacggcgtacaacatcaatctgcagtcccttaactcattagcagcattgtcagatggcgaccaagctaaatgggtagcctatgaaacggcacaaagtgccgatggtagcattgttgccgaacataaggatgcctctgatacgggtcaaactatctcaattacgcataatgctggaaccacagataacaaggcgcaaggcggattgacggttaataaccaaaatggtcagaaacaaggaaacgatggcagcttagacagtcacaacaacaataatccatcgaatggtagcaatccatcaaacggtggtggtagcttgtctaacggcagtaacccaacaactggaagtagcacaacgccaggatcacagtacacaactactcaacctggtcaaaatggaatgacgcctaccacacaagttcctagccagttgccttcgcaagcacgttcagtgttctcacaagggcaaccacttcaaggaacaacatacgtccgtccaagtgttacccgtccaacttttggacaaactggtggaaccgataagctaagtaacaattggttctacaactttatctaccgcttcatgaaataatttccttcatgtgaatatttgcttgtgttagcaagtaaaaaagaacccacattgctgttttacatcaacagcgatgtgggttcttttttctattattttattattgactagtacattacaatggcgtttgcaatagcttgaccatcatctatggtcacagcgccaactccaatgtgagtaaaggacgatttcagtaaaatgtcacgatgtccccaattgtgtgcggcatcctgatagatataatcacgaagactctgtcgcacagccatccgagctggtgcatttgcaacccatcctaggcattccccataggttgacacgttaattccagcttctttcatgtataacccggcaatgatgtttccattactatcacggtgtacaagcttatttgccaactttgtatcttgtgctcttttatcagcaatgcttgcaagagtgacatctgctgttactggcaaaagtccccttgattggcgttcttgatttagtagctcaacaaatatggacttataatcgttcagattagcggggtacttagagaatatttctgtatcgtagtaggcctgtccgctatcatctcctgttttctgagtgggattgtttttgctattagtcccataactgtaaaggtctttaagcggcacatttgcatctgggtcaaccggaaccttgtttgttgtcttggttgacgtttttccgttagtcgatgatttcttgatgacctttaggtaattattgtagacgtaaccgttcagttttttgttctttgaacttacacgatcataccaaaccgccggtttgccgggtaccttaatcaaataagccttcttagtagtcatgaccttatttttgtacttggtaagatgcacaccacgcttggtcaatttggtgctggtgtaaacatatccctttttagccttgaccttcatagtcttgtacttcatggtgcggactaccttgccaggttttcgttttgcggcctgcgatgtagttgggatagctgcagtgatactgagaccaactaaggcactgaatgctatgcaaagtaacttttgtgctttattagacaatttgaattccccttttcgtattgttttatacacttatattattcaacatatatacgagtaataccagtgaattttaaaaattccttaaaatagtcaacatttttttgttgagaaggttgaccgaaatcatcccccccacagcgtgccggtaataggcgtggcatggcgtgaaaaccaatatacgtataattagccatgaacatcttaaaacgcctaaaacgggcaaaatatgccgtgtataggtgccaacaaaagtaaattgacacagaaaagcatcaactccaaggacgtattgttcctgaagctgatgcttttaaggcaaaatattttttgtaagcgctgataggggaaattgaagtgggtggtaatggctaatttatacctgacagaatggaaacaatcacagagtctaactcattttgggctctctgtattttttttgtaacgtgccttttcttgcattgctcgatgaaccattttctcaatttcgggatcatcgtgagattcaagaataatacagagatcatcaatatgatcctgtagttccactgccttgttttcccaaagaacgatagaatcgtgtgccgtttcaatactcataattaagaccctccaattttgtagttagataatggcaatgcagggtgtgtaggccatcatctggtatcagcaattacgaaaatcattttacgtgcttactactgagttctaaagatcgcgatgacaatagggacattgcgtgtctgaggaactgacgggttgaccgcagtagggacattccatttgaatcacctcctttcatagaatcatattaaaatagcccgatgatggtagtcactacggtaattacgaaacgaatgacctcaaaggcaccaattgcactaagaacaataatagcgtttccaaaagacttcaaaaagttaaacatatcgcgactcctttctgaccgtattcacaaaacaaaacgggtgccaatgacacccgcagggactaatcttttatattttcgagagcgtagctcaatgctttattgacggtgtactcgatgtaagactggttacgagttgcaggacgatcccacttttggcgactgtccaaaaattcgtaagtatattgcagcagtacccaggccaagatggtcgtatcgtctattgacttgggattctgtagttcaccgtcagctctgcctgtagctgttcagaacatacgttctttacattgcttacatcttcctatatactgaacttaagtcaatttgagagaaggttatcgctaatgaaacaggcaatatttgtcatgatggatcagtacgccgattgggaaggggctcacctatccagtcagttgaaccaaatgaccgattggacagtaaagaccgcctctaatcagccggaggttacttcaattggtggttggacaacacgagtggactaccagattagcgagcttaaccctgagatgacgttattggtactcattggcggtaacgcttggcaacatgacgatcctaggttaaccgctttaattcagcagtgccttcaacgaaaagttattgtcggagccatctgtggtgcagttgattacttggcccgtaatgggttactgacgggatatcgccatactggaaatgcacagttttcatggcaatcatttccaaaatatcaaaatccaactgattttgaattacagcaagtggtcgttgatcgtcaactagtgacggctaatggtacggcggcgttgtcttttacctcggccgtcctgaaggccagtgggcaactaactatagcggcaaagcaggctttagacttgcagcaactaggctattacgacaatacggagacccatttaaactgtagaggggataggtcttggatcagattagtactgaagaaagttaccgattgctagaacacagttatacgttggtcagtgggtaataggtactgaggcggcatctaatgatgaaaataaaaatcgggtttccacgatggaaaacgtcgcggagactcgattttttgagccgattcaatttagactagaatgtgattacgggctttaaaaccgaaccatcttttgaagcggcaaagccatcattaatctggtcaaagtcataaaatttaattagcttatcaaacgggaagcggccttgtttataataatcgaccaacttagggataaacagttggggaatggcatcgccttcgataacgcccgagattttcttaccttcagccatcaggtcatccatgagattaaatgttaagccacgacccattccaacgacagcgcattcgccacctggttttaacgcatgcagagcattcatgacaactggcgatacacccgttgtatcaatggcatagtcggcccctgttggtaaaatttctttaagtgtcgcttcgacatcagcttgatgactattgatgacttcggtagcccctagctctttagctagggctagtcgattatcaaaaatatcaatggcaataatgtgattagcccccgtaattttggccgccatgatggcggaaagtccaacagcacccgtaccaaaaataaccagtgactcaccgaacttcggttgaaggtaattcaaaatggttccggctccggtttggatgccacaaccaagtggccctagaagacgtaagtcaaccgttgggtcaaccttgatcacgttgtgttggtcaaccaccgtatgagtcgagaatgaggactgaccgaaaaatgtagaaataggttgaccgtctaaagtgtggattcggtggctaccgtcaaagttgtgtccagcaaagttaagttcgttaaaatgctcacacatacctgggtggcccgttaaacaatgctgacagcgaccacagtatgcaaaagataaaacaacatggtcacccggttgtaaatccatgacgctagaaccgacctgttcaacaataccggcaccttcgtgacccaaggagactggtagtggggttgtaaggccatcacgtccagcagtatctgtgtggcagacaccagtagccaccattttgatgagtacctcattagcttttggctcgtctaacgttgcatcaataattttaagttgttcactggtaccgtcagaaaaagctgttttgatttgcataaacataaccaccctgtcttgatataatattcacaattacagtatagccatggaatcttaatctgtattctgttaaaatcagtcgggacccgaaccaaaagttcgtctggaggtaaatatgaggaacgacaattaatcttatttgtagaaaccgcacaactcggtagttttcaaaaaacagccgagttaaatttaatgtcgcagcgtgcagtgtcaaaacgaatcagcgcgttagaagctgaaataggggcaaccttatttgatcgtcaaaaaaacaagatcaatttaacagctgctggaaagcattttttaacacgggcgacggaattgctgaatacgatgcgcatgacgacctatgaggttcagcagtttacgcaacaagctaaagagcaatttagtgtgggttatttctcaccgttcgaaggggcgttgttacgaatggccttattggatttgccaacaaccacgaactttttaattgaagaggcgggtattgaacatctaatttcagatgtgctcctaaagaaaatagattgtgcagtcattattgacaatccgttgtttaatgcgaagatcgatcaaaccaatttggatagtgtcacgttggtcacggatcatatgacactggggctcagccctgatttaataagcgatcaaaccgattcgccggcagattatttagccaaatttccggtgatttattacagtagtgaggagtcgacctacttagaagaggttttcaagagtagtatcggtcagttagctgacacgtttaacgctcgtcgggtgaactcttatgaacaaatgcaactgttagtggggatgggaaaagctatctcattttatccgactgaactcattaaatatatggcaacaccgtatgaccacattgcctatctgtcattggatggtgtgacgaccgcccattctgaatttaagctcatttatcatcacgataatcaccagccgttgattaagcagattcaacggtattttgacactcatcaattttaagcaggtcggaacaacagtcataaattgccgaatataataaaatagcagcgtacctcaatcatgggtatgctgctatttttagtttactcagcaagacggatgtgaatatcgccaatcttttgctttagatggctaatggactgggttaatgttgtgagttgctcttccgatgcgcttaactgggtttggagaatagtcaagcgttcacgcagcgtactatcaccttgttcgtaggtagcgatgaactgcttcatttgcttgatcgtcattccacattgtttgacgcagaggatgaagtccattctttccaaatcagtagtgttgaagtcccggataccgttgatgcggttaatggggccgataagtccctgttgttcgtagtaacgaatggctgatgttgagatgtggtaacgttgagccacagtttcaattttcaaagataatcaccttcttgacttaaagtttacttcaagtggtaggctttgcaatagcaggtaaatcagctagacagttggcaaatgatcgtaattttaggaggatagacacctatgcaatacacgaagttagggcacacagagattatggcgtctaagatttgcgttggcgcgatgagcttcggtcagccgggcacgatgcatgattggacgttagattatccggctagtgaacgggtcattagccacgcgttatccttaggcattaatttttttgatacggccaatggctattcggctggaactagtgaaacgtatttgggtcgggcactcaaggcgcaacgagttgctcgggatcaagtagtcttggcatctaaagtttatttcaatcccggacgattgtcagctaaagctattcaccatgaaattgatggtacgctgaagcgtttgggaactgattatttggacttgtatatcatccatcgctttgattatgacaccccaattgaggaaaccatggcggctttgaatgaactggtaacggccggcaaagttcgggccattggggcgtcagctatgtacgggtatcagttcaacaatatgcaacaggttgctaaggatcgcggttgggcgcaatttcagacgatggagaatcattataatttattataccgagaagatgagcgagaattgattccgatttgtcaacagcagggagtctcgttgacgccttacagcccactagcggccggtcatcttagccattctgcttggcaagtggataccttgcgcagtcaaacggatcgggtcgctatgggaaaatacgatcgtactgaaacggaagaccagcggatcgtggcgcgagtcgctgaattagcccacaagtatcaggtatcgatgacgcagattgccttggcctggcagtgggctaagggcgtcgccgcaccgattgtcggttcaaccaagactagccatttagacgaagctgttgccgcattatcggtcaaactaactacagccgacattgattacttagaagatttatacaggccacatccaattgtcggggctcttgaccataatccagcggccgggacgattttaattgaccagaaaaagtaactcagaaactggttatggtactgttttcgaaaatgaaaagtaatctaaaaacgatggttaccagttgtggtagaccatcgttcttttaatagcaatcaattaaaatctagtaatgtttagggtgataaatttgtcagatttgtttggcattagctacttcagtacgttgtttttgtgccaaataagcctgagtatcatgactataggcattttcggcctgaagcttttgataggattgcccacgttcagtagtcagttgtcccgttgctaaagccgctttcacggcacatcctggctcagtttgatgatgacaattacggaaccggcagtggcgaattagatcagcgacatctgaaaaattttgcgccaaacctgtatccgccccccataatcccaaagcccgcatgccaggggtatcaatcatgagagccccagatgataattgatacaactcacgggaggtggtggtgtggtgtcccttatcatcgtttcgcaaaccatcggttgtaatgatggttttccctaataatcgattgatcaagattgattttcccacacccgatgagcctaacagggcaaatgtttgtccggcttgaagaaacgtttgaaggggagccaacccatttgcagtcgttgtcgtggttgttaaaaccgtcactcccaaagtcattggtgcaatgactgcgagtttggcttcagtgtccgaacataagtcggatttcgttagcacaacgactggcgtggcgccactatcccaacaaacggttaagtagcgttccaatcgatgcggattaaaatcatggttgagtgacatgcaaattagtgcgacgttaacattagcagctacgctctgaacttggtgagtggttcctgccgcttgccgcacaaacaaactgtttcgaggaagctcttggtgaataattgccgcatctttagtaggcgttagctgtataccgacaaagtcaccaatgaccgggaaatcactagtatcgagaacgtggtggttaaatcgaccactagtctgtgccgatacaacgccaacggcggtgatgacctgatattgttgccgttcttgacgaacaatgcggcctacttgacgatcagaaatatcagcaaattggtggattaatgttgacgttacaccataggaaagtagattagaattgctcaattttaaaagtccttacttttggttgtcatcttcaaaattgatttacattagcgccgcgtgttaacgataacataaatcataagaagcctatcaacagcttagaagatcacgccaaccgagtgctgtgaggacacacgttattcaattattttggatcgatccatttcgtaatcgtttcacagcaacgatgatggtgtgaatcggttgcgtcaatcatatcgcagttcctcctgagtaaatatcttaattgcggttaaggatagtcaattgataggtagttgtcaacgaaattaacgggaagaaagtagtgctaaagcgtttcatttgttcacggattacttatcacatagagctttcatcacgcaaaaattggcaatagccgtaataaaaattgattagtttgtttattgaagtaagtatcagttaacccccaacaaataagcgatagagtgattaatagtaccccggtataagttcacaaggtgtcttttctttacatggatttaccaaatgaataaactaggtttgtaccaaaatcactttagggggaatttctaatgcgtgaagatttaaaaaactcagcgggccaaccgtggggagacaatgaacactctctaacggccggacaacgcgggcctgttctcatacaagattataatttattggaaaagttggcgcactttaaccgcgaacggattccagaacgagtggttcatgccaaaggtgccggtgcggaaggtacttttcgactaactaaagatatgcatcaatataccaaagccaagatttttactgagatggggaaatcagttcccatgcggattcgcttttctcaagtggccggagaaatgggttcagcagatacagttagagatgtccgggggtttgcactccggttttacacagatgatgggaattacgacatcgtgggaaataatacaccggtattctttgtcaatgacccattgaagtttccagattttattcattcacaaaagcgtgatccacgaacacacgagcgttcacaagatatgcaatgggacttctgggcccactcacccgaatcggttcaccaagtcacgattctgatgagtgatcgggggattccggcttcctaccgtaagatgcatggttatgggtctcacacattcaaatgggtgaatgaagcgggtgaagtcttttgggtgaagtatcatttccggacggctcaaggcattcagaacttatccaacgatgtcgctcagcgtctagccggagagaaccccgattacctgcaagctgatttatatcacgcaattgaagccggcgattttccaacctggaaagtttgtgtacaggtgattcctgaacaggcaggtctcgattatccagctgacatttttgatgtgacgcaagttgtttctcaaaaagattatccgttgattgagattggtgagttcacactaaataaaaatcctgataattactttgaaggtgttgaggaagctgccttttcaccggctaatttggtacccggaattgaaccttctcccgataagttattgcagggtcggctgtttgcttataaggatgcagcgcgttaccggttaggggttaactacgagcagttgccagctaatcgaccacttaatcatccgaataattatgagcgcgatgggttcatgcaaacggataatcacggggatcaagttaactatgaaccgaatagtcaggggggcccgcaagaagatcctgctggtcggctgacaccatacactgtttctggaaaggccggtaactatgcctatcaaacagattatggtcgggccgctggaaaactttaccgtttgttaccagccgatgaacgacaacggttaattgaaaccattgtcatgaatctgggacaagttaagagccatgacgttaagcgattagagacggctcagttctatgaagcagatcatgattatgggttggcagttgccaaagggctgggcctaaaattagatgaaattaaggactacccatttgatacaacgcactagatcagataactgggctgattagggcagtcattaaaaataaaccggtattttcagttaagtgctgaaataccggtttattttagtggctgcggactaaatttgtgttaaccagtcttgacgtaatttggaaaagataatagcgtcttgatagtcaccagctaacgtggggatatgtttgggcagtcgagcgtcgcagtggtaatgattacttttagccacagcttggctggcgatattgtcaggaaccgtgagaatctgaagcttgtttagttgccaatcgttgaaagctaacttttccagtgcttggagactttgactgatgtaaccatgtccccgatacgggcgtcccaaccagtaaccgacatcagcatgaccatcctttttgtcgtgcaagtcaatcatgccggccggcttcccgttgacggtgatgatagctagccacagctgatgagctgctatttgcccttgcgcgtaggtaagaaatgccgcttcatcggcgacctcatgcatggtgttggcccaaggtaaccagcgacttaaattgactctgtcggcggcaattagcgcatacaggtccgctgctagcggtgaaataggagcaactaacgccagatggtcagtcagatgtagattttccatagaattcagctcgattcaagttattataaaatgaataattaatgagaaaatgagtttatgattaaacgtgtatatctaatatagcacatcgggaggttttgacaagttgactatcagttgacgcactcagttgcacaaaaatgacccaagattgccaaattgataatctcgggtcattttagttgtctgtcaatccgctattagttagtctggcatggctggtcggcgcaacagtatggcgagcatttctaggttttgtttcaacgcgtgtttagcgattggtgacagtaatgtcaagggtaggccagtattacggggcacgaacaaggtttcctgcagcaaggtttggctggcttggccaacgattgtgaagacaagttgataaggcaagcggccctcacggctcgtataagtgacagtggtcgcgttactagtgacggtcaggacttcatgttgattaatggccgcccgggttcgggtgatgacaaatacattggtttcggggtcaacggccgtgatttctggtacccatttcagtagattttgtgggttagtcagtgtggcatgaacccgagtagcatcagcagggatgagaacggtattaataaaaagtttttggtcagtcataagcgattacctcctttagatgatgaggttattctagctgactgaaacgcacgaagaaaatcagtatcctgataagtgttatttttcctgacggtaggcggtcatagcggcggcatttatcagatggggagatcatttttacccggtgacatataaaaatcggcgacggctaggtccgcgagtgtttgctgagcttgcagtgctagtgccaataggttgattagttcgtcaatattgccatctgctagaacttgggcgcccaggagctgtttagtttgtggatcgtaggtgagtctgagctgaacgtgttttgtagggatagcagggttggatgattgccgttggtcctgcgtaagggtgacgcttgttgggaacgtcatttgcacaagcggcgacggcgggtgtttcccaatactttcggcaactttttagcttagctgttgatgagcaggatcaacggcaattagctaaaatcttatcgttatcaacaacggctaatctgaccttaatgcagcaagtcgtagaaaacgccagacgccgtcatgagcttttacgcacgccaccccaggctacgttattggccatgtttaatcagattcggtatgtgacaatgatcggtggggcaatccctggagaaattgaaatcacacgattggtaaatgatctcatcttaccggccatgcagcaattaggtcgataaatggtataagatgttacggttcattacttaaaaagcgactgcggaattgtcagaattctgcagtcgctttttaagttgaacgtcttagtctagtcgatcgtaaatggactcgtgaaacaaagtggttaggacgtgttcagttgcttgggcggtccgttgctggtctatttgttcgcttcgactggcaataaccgccagtaaatgataatcattggctagcatgtaatgtgagtcatggtcagtcgcaaagtcaattccccgctcgagccactgagctgcgatcgttagttggtttaactttaagtggctaaccgctgctaagtagaagagactatttaagttagcttcatagggggccgttttgagttgcgtgactgcctgtgtcatggcttcctcactggcgttagcctgttggcgactcgcatgaataagcgccaaggacatccaacataaccgactaagggtggtccggtgttgtgctggggcactggcgagggcgagctgaaattgctgctgtgcatcggttaggtgaccgagttgaaaatcggtgatgcctagataatagtaataggctgcaagctggacatctgttgtcaagcgtgcttgaacggcatcagtcagtaagaattctcgtagatcggcgtaacggtggtgattacataatttggcgagtcggtcgtttatctgttcaagatcactgatggtaaaattctcagcgagacttaattggtcaaggctaattttcagccgctgacacaggcgcattaacagcgtcgcgttaggggtgtatttgccgttttcaatggccgatagcatggactgagcgcaaatgccggttgccacggtagcttgtgataggtgttgctgcaatcggacttgttttagggtaatccctaattgtgaaggcattctcctcagctcctctcgtttagtctcaataatagcaaaggttagcgcgatatgaccatagaatgacttccccctggtaaacaacgccgccgtttcagttcccgatatttaaaaatacaaagagtccggaactgctgtcccggactcttgaaagataaattgacttagttttcgttagctgagtcgactgaagtagaacgcttttgtgcgccacgatagaagatccaagcgacagccccgaagaagattggaccgatgatggtccagaaagccgtcatataatcatgttccataattggttggagacaagtaaatccaatcccaccgattaagacaatcatcacgaccgtgacaatggcatctgtccagaagcgacttttgaagatgacaaatggtcgttccaaatcttgccggcgtttaaagaaaggaaaggcaccaatcaagaagagataagggaaggaggtggagacattccccatgtccgttagaatcaagtaaaattggttagctgcggagcctccaaaggcgactaggaagatgaagacagccactacaattgcttgaatccacatggagtaagccggcatgccagctttattgagcttagtcatctttttaggccataaattaggcgatgatcctaagataaatgatttcagtggtgaatagatgaggacaaagaaggaccctaagtaagccataaacatgcttaacccggtcaaacgagctaatagatgacctaatgtgatggctgttgccccagataagcccatcgctttacccaattcaagaccgagattgttcattaagacgtaagtaatgtttcccaagttgacttggtttttaccaagcacagccgtccagttagtactgatcccccagaggaagatagagagcgagtacataatggtaatggcaatggtagagataatcaagccgcgggggaacgttttttcaggcttatccatactatccgtaatcccacccattgattccataccggcgtaggcaaagaccgcataagtaatgaaagaaacgagggccattggcgaggagaattggggatttggtgaagtggcaaaactgtgaacgccatcgatcggttcagctagctgaccaccatttaagaagagaatgacgatactagcaacaaagaagagagcggtgagaaacatcacgaacatcccgccgatagaggagatgcgggcgattgacttgacgccccgagaggcgaagaaggtgaccgctagaatccagataatcccgaggagccccaccgtctgtgtagaggataatcctagaaatgaccacgtttgcgtttgatcactcccagaaattaacgttgataaggggatccagactttagtcgccgtggataacatccaaataatccaagaggataaccaaataaatgtgccaataaaggcccatttttccccaattgatccggctagccacgagtagatgccccccttggcttccttgaaggcggaaccgtattcggctagcattaatgcactcggtaagaagaacagtaaggcggctaagatgtaccaaatgatactagcgtagcccatttgatcaaaggccacagttgtgttggcaaaaccataaattgacgaaaagatcattaagatcagactaaagacgccaatctttttttgcttttccatgattaaattatctcccatttgaagtgaggattgtctcagcttcgattataagtttaaatcttggtggtagttcaacggcccaagatcggtcgctcgtgtaattaacgttgcagctagctcgcgataacgcttcaatcccagttcagcgacttcgttagagcgttgggtcaggtagcgactaagttcagtgccactgagagtctgtgccccacggtccgtttcttggactgcctgtttgaaggcaattcgcaaggccttttgcgtctcactgactgtaggcaaagcggtatggtagtgggcatctagcaacacactcactaacttgtaagtccagtaggcagactttgaatcgtaagtttcggtgcccaagtgataggcttccggagtactatcgatgccagcgtagaagggcacgtaaacactttgggcaccgacgcccatggccaaccactgaatgccggccaagccgggagtcatatttggtcgcagctgtaagacgtgcgattcttgcgttttggcgagactaacgggtcggaagcgatgtttctgttcagcggtccctgatcccacaggatcgtaaggtgtctcctcaaagtggctacttagatattgttgcgcgtcatcaaccgataaaagtcgatcggcgtattgaataaaaggcaaatcaaatgattgcggttcctgtgagacttggggtgtgaatcgcttctgaccgtaccaaacccgtggggtattgtagtacaaatcggattgatcttgggtcccaaagatttcacgccaaataaaacggtctggatggggatttaagtgattatcggtcacaaatgcttgcagatttttagcaaacatgaagttatccgcatcggcaaagtcgacggcttggatagccatctggttagctacgactgcataagcgttagctgggatacgttgagctacccagtaatgaccagcaccggtctctaggtaccaggcttcttgttggtcagcaaacaaaatcccattagattcatttgttccgtattgttcgatcagttgaccgagtcgggcaacaccttctcgggccgtcttcacgtagggtaagacgacagtaaccatagcctcttcacctaggccgtccttaactagcggatcagcgcccaagacgcgttcattagaataggtactttcagtggcactcatggcgacaccgtattcattaatgccgtcctcttcgaatagaccgtacttgtcagtccattcaggtgtggctgtgtatttggcggcctgtgttggcaatggcatagtgaagccattgtctgtgctgacaaactgtggtggggtagcaacggttgtggcgggatgtacgatgaaatgcttgggccaagcggctttagcatcttcattacgaccgatcaaaacggacccgtccattgttgcctgcgggccaactaagatactggtacaagcggaataattcatgggagcgctcctttcaaaatcttgaataaaattacattcctattttagcatgattagattattgtcgcttaatttcgggagtattttaattattttgtttattattctcataaaagcaaatatttatacagtctccgtggagaccgaagtaccgggtaaattgccatttgggttttccaagtggcccaaccagacgtatagtttcactggtcaagtgctgggggatgtggttaaataatgaaaacgactatcctgcgaaaggggcgaataatgagaattatgttagaaaagagtcgccgtgaggtgggcaaacaccttttaattatgattggctcggcattgattacggccattgcgctaaatgaatttctggtaccgggtaagattttcagtgccgggattaacggggtctcacaaattatcgcaactttgctacaaatgggcggtattcatgtgagtactgggtggtttattttgctgtttaacattccaattgggttattgggatggttcaaggttggccgtggtttcacagtctattcaattatggtcgcggttttgacttcggtgttagccattgtggtgcccgtttcaaatatttccaacaactcgttattagcggcactgtttggtggtatcttaacgggtgtcggcgtggcttatccgttgaagaatgggttttccactggtggtatggatattgttgccgtggttttggagaagacgaccgggcggacaattgggacgctgatgatgatcattaattttggcattgtgattgtggcaggatttctctttggctgggaaagtgcactgtatacgattatttcgatttatgccatgtcacgggtagttgatagcattcacacgcggcatcaaaaactgacagcgtttattgtgacaacccagcaagatgccgttattgccgagttgaatcaacgtttaattcgaggtatcaccgtgatgccatcgtttggggcctacacccgtaaagaaagtgccgtgttgatgaccgtgatttctcgttatgagctgtacgaattggaacatgcggttaaagacgttgatccccatgcgtttgttaacttagtgaacacggtcgacatcgaagggaatttttatgatgaaacggcccaattaaaattacggcagcatcaaaaataacgagtggttataataaaattgctccgagctaccagaaccggtataataatgggtatctaagaagagaagggaacgaaactcaatgccaatcgtaaacatcgacttaattgctggtcgttcacaagaccaactcaaggctttagttcaagacgtgacgaccgctgtgactaaaaatacaggggcccctgctgaacacgtccacgttattttacgtgaaatgcaacctaaccgttacggcgtggccggcgttttgaagagcgacgaaaaataaaaaacatttgtgaaaacttataaaccgccaccaatgccgataaattcagcttggtggcggtttcatttggaaaagtaattggcgtagccgtgacttttcggtatactagaagcatgtgcgacatcacggcaaaataaggccgttgctaacaacgaatgaatggagagtcgaacaatgaatgatcaacaatacatgatggcaattgacgaagggacgacgagtacccgggctattttattcgaccggcacggccaaatcgcgggacaggcacagcgggagtttcatcagtacttccccaagcccggttgggttgaacatgacgccaatgaaatttggaacgcagttcaatcagtcatttctgatgctctaattgattctgatgttcaaccgtataaggtccggggaattgggattacgaatcagcgggaaacaacgattatttgggataaaaggacgggtgagccgatctaccatgcagttgtgtggcagtctaagcaaactaacgaaattgccgatcaactgaaagcagatggctatcaagaagccatccatgaaaaaacgggattagttattgattcctatttctcggcgacgaagattcgctggattttggatcacgtcgatggcgcgcaggagcgtgctgaacggggtgagctgttattcggaacaattgatacgtggattttgtggaaattaacgggcggccgcgtgcatgcgacggactacaccaatgcgagtcggaccatgttgtataatattcatgatttgacgtgggatcacgaaatcctagattggttaaatatccccgcggcaatgttaccagaagttcggtcgtcctctgaaatttatggctataccgctggctatacctttagtggtgttcaagtacccattgcggggattgctggggaccaacaggccgccttatttgggcaaacggcctttgacaaagggatgatcaaaaacacttacggaactggggccttcatcgtgatgaatacgggggaagaacctacgctttcacacaatggcttgttaaccacgattgcttacgggatcgatggcaaggtcacgtacgcgctagaagggtccatcttcgtagcggggtctgcggttcagtggctacgtgatgggatgcgcttcttcgatcacgctagcgagtccgaaaaaatggcggtggacgcacaaacggcgggtgatgtttatgttgtgccggcctttacaggtctgggtgccccttactggaatcaagaaactcgcggggctgtatttggtttgacgcggggaaccacgcgcgaacaattcgtgcgggcgacggtcgaagctatcgcttatcaaactcgagacgttgtggacacgatggtccaggaggccggtttgaatctacaatcgttaagtgtagatggcggcgcgtcgaataacgatttcttaatgcagttccaagcggatattttaaataccccaatcaaacgggcagcaattaatgaaacaactgcgcttggtgctgcctacttggctggcttagcggttggtttctggcctaacttagcagctattcgtgatatgcatcagacgggtgaagaatttacgccactgatggcggaagataaacggcaaaaatgttatagcggttggcaggcagccattaaggcaacgcaagctttccatcaagaataatggagcagatagcaaaaagtcggcgttggccggctttttttgtgccctcagaaaataggcatgggatataaatgctatggttagttaaacgttaaaattattgagaaacaattattgattatcgtttatcgatatgctattatcgaaaatgaataaaagggagatgctaatcatgtcaaagtggttgagtgcaggactaaacgcgattatgatttttggtaatattgcagtgttcttcatgtatctttgctttatcgtaccgttttattacctatacgaagcaatttccggccgtatcgttaatagtattttaaccggggatgattttttattgacgccaggaaggcatgtcatttctgcggccgtgatgcagagttttcccagttggccatatgctatttttgatggccattgggattgccatcaatgtatgggctggtattaagttcttgcgagcgttattggaaattttggaaaatattgatcaacaacactatttttctacagagaatgttggctcgttaaaaacaatggtgatggccgatgtgtttatggctagtgggaaccagctgcctagtagttggtttttccgcattaacaatggtgttgcttcggcaacgtggccgacttgtttcgatgatttgtttgtcgcgattgccttgggagccatctatgtgacgtaccagcatgcgatggacatcaaggctgagaatgacttgaccgtttgaatgatgggaaggtgacggtgtgattaaattaacgctaaacgttgtgatggcagaacataacatcagtagccaagaattggcccagttggtcggcattacacctgccaatttatcaattttgaaaacgggcaaggctaaggcaatccggttcagtacattagagaagatttgtcaggcactggattgtcagccaggtgatattctacaatacgttgaagagtaattgaggggtcggggacaaaagtctcgacctcttttgcgttgccgagtattgggtaccaaaacgtgcgctgaaagacaactagttccggcctaatcccgtcagccaggttccactctctttcgatgggggctcgccaacgcgtaaaaatcgcccagattcgcgtatctggtagcgttagttatgcttattaattaatgctgatgatgattgtgagcaatatatttcaatcattatataacgtaaatgaagataaaacgactggcgggaaagctgggtcgtgaactttttttgggagcagggactttatgaaattacaaaagattattttagctggagcagtggcgttaggacttgcaggaacggcaatcgtcacggaaccaacgttggcggcagcggctagttcatcagtgaccattgatggcaatttttccgattggcaagatgctaatttaactgaaggctataatggggacacggcacttgcgagttccgggaaatacgttgaggtttacgtgaagatgaaaaatggtcccgtacctggttatggggattataatttcacgattgacgggcaaaaatactacatttggtcagataatgttccaagtaacgtcagtaaaggggaaactaaaaaggtgacgtttactggtggtaagaccaatgaaggcacgcagtatggtactgtgggaactggctatgtatcaaatgatggcacgcacaaccttgcggaatttcgagtggatttgacggctttgggcttgacgaaagcggctaatggcaaatccgtcacgatggccaatcccaacattggtagtgactcggcttcaacaacggttgacgatctgacgaacgcggcgactagcgatagtgcgagctcatcaagtgaaactggtgtgattgcgggtaaagaagaccaatcgtctaaggcaacgactaccacggacggtaatgccaataacgataatgataacttaaatattgtgattgacggtaagtttgctgactggaagcatgtgaccttaactgaagggtacaatggctataccgccatggttagtgacggcaattacgtctacgtttatgtcaaaatgaagtatggcttagttccgggctatggtgactataactttgatattggtggtcagaagtactacgtctggtctaaggaaatgccaattagtccggtgagtgcgggcgatgctaaggttgtcagctttactggcggtaaatggaacgaaggcggccaatacggcaccgttggtgatggttatgtctcttccgaagatggtcataatattgctgaatttaaagtggatctaagaaagttcaatctatcgacaatgactggacaaacgattacgatgtataatccaaatattggtaatgaaaaagtgacggtggccggtggtttaactgggccgtatgtcattgctggaatcggtgtggttattgcgggactaggttactggcggttacgtaaatccggtaggcttggtcgatcaaaaacatccacttccggtaaatagtgtggtatgatgatggcttgtgattgatagttagtgattgccacgatcaaagtggtgagctgacggtaattggctaacgagaacgtttgataagttgattaattaggacggatacgtatgaatatcaaaatcctattgggcattgtgatatggctatatggactttcggtgctcaagcgagcgcggttatctgccttctattttattgtggggagtgccgggctttttttcattttaaccgcgattagccggccatattgggtatggttttttacgcatgccgtgattcacggtgtggctttatttggcaccttgtcacgttggtgtacgattatgttcaaaatgggattggtttatattactaatacgggcaatcccgtagtgatgtcaattgattacgagtgctcaggcattattgagacgtgtgccttcgtagccttggtggtcttcttcccgatgtatcagcgaaaggaaaaagtcttctacgcggtcttcggtgtgctgtatatctatgcaatcaatgttttacggctggtggttgtgattatcatcgtgcactttggcggtggtgagacctttttcctagcccactccgtgattggtcggttactattttatgttttggtgattgcactgtattacaatgtcttcacgtattcgcaattggcacgaggtatctatcgggaattcattgattggaggcaagaaaagttgtgatgtactggatcaatttaaccttgacgcggatgggcttctggattacttgggcgctgatccccattgtggttgaaattatcccggctttgatctcaacggctaagctgatgcactttcatcgtcatgagccgaaattaacgccgcctggtaagtggccgtgggtgacgatcattgttcccgtttataactcggaggacacgctgtttgagtgtattcaatcaattaatgagcaaacctatcctaaagaggccatgcaaattattctagctgacaatcagagtaccgatggcagcttcggagcgtatgcccgggcacaaaacacctttcctgaattgattttacgttatgtgaatactgataaggggaaagcccgggcgttaaatacggcgatttacgaaagtattggtatttacgtgattaatattgacaacgatgggttgttagaaaagaatgctgttaagaatatggtattgcgttttgaaaatgacttaagtattgcggctatgactggcgcgatcctaccaaaagaggaactggttcaaaaggtcaaggggttcggtcaccggttattggccaagaacgaatactatgagtacgcgcaggccttcttatcggggcgaacgattgaagcgtcacgcgatcagttatttaccatgtccggtgcattttcagcattccgacgggaagtcttaatggagacgttcttgtatgatattgataccatcggtgaggacacggatatgacgtttcagattcgtacccggttaggtaaaaaagtggttatttgtgccgatgccatcttttatgttgagccgatctctggtttttctgaactgtatacgcaacgccagcgtggtgagttggaagttaccgaaaactatatgaagcaaacggctagtttaaaacgattttttaaaaacttcttagttcgacgaatgatgattgaccatacgtttacatttcccagaatgatctggacatttgccacagtcgttttaattgcctttggttattcatcactgattctgctgttgtcatacctgttgatttatgccctatacgttgtcgttgcagtggtcaactttgtgagtgtgagcatcctgttacaaccgtaaaaaacggctattaactggtagcctcatgctcggggtggtgcttgctgggcaaattttcttaatcatctttgttcatccggccagtggttttgatgccgggatgcttcattatgcggcaaccagtgccaaacatgtccaagaagtcaatgttatggcttattacagtttgaaccaaaacaacctgccaatcatgttgtttatgcattggctaaccgaactaacgggtcaaacctcgtggctgttttttgattttgtaacgctattctttgtggatctgtcggtaatctgcaacttgattagcgtgtggttagtgcgaccgcgagcattgggggcagccatctatctgcatgttggctggttagcggtttttcccagcattattatgccgtacaccgatgcttggggattaccactggtttcaatttatctgctctgctattttgcgatgcgtaagtccgcgttacccgcgcgttacccgcgttagtgcgcgtgctggcagcgaacggctttggtattagcgtgacgttgacatactttatcaagccttctgccattatcccggtcattgcgattgtcattattgagttgctggcgtggctcattcggcgtaaaccagtatcagatcaggtatggtttatggcggtagccctcctagtcatggtcggtggaagcgcttggcatacgtatcagtatgctaaccagaaagtccagagtcagacttatattcagttgaacaaagcgcgggcaattccagccattcactttatggcgatgggggtctatggctcgggcggctatagtgccaaacaagctgttcagatggcagtattaccaacatctaagcaaaaaacggactactctgttaccatgttgacgaagcgattaaagaagctgggaccgatcggctacttgacctttttggttaagaaacaacgaaataatacggccgatggtacctttggttggctgaaagaaggacacttctttcatgataaccagcggccaaataatcgggggatcagtaacaagttaaagaatttcctctatctgtatgggcggcatatcgctgattttcggtttatcgcgcaattctggtggattatgctgttaagcatcattgcattgggatttgggccacagcgacacgtcattcaaattctacgattatcgatggttggcggcttcttatttttactgttgttcgaaggtggtcgtagtcgatacttaattcaatatttaccgtgtctgttactactagcaactttttcgttcgaccgagcggtggccaatgtgcgacaactgtggggttggtatactgaaaagttagccgcggcaatagctgctgacgaagagagtatgtgaaggtaagctgacggcagaaaagagcaaaaccagttgccttttgacatacgttttggcaccagatatttggcaacacaaaaaggagtttgagacttttgtctcagactccttttttgggttttatccggggtaacctaatcggcgcttagcgcgtcaatcggattcagacttgccgcatggcgggctggtaagtaagccgcgatgagggcaatcacgatggcaatcacaaaagttgtgatgatattgccaagggtaatctgaataaaggcatatgacgcaatcttagataacatcgtattagctaatgcacctaagcctaatgcaatcaccgttgccagtacggcactcagaacaccaataatgagggattcactgatgaacaggcgccgaatatcagccttgctttcacctaaagcgcgtaaaatcccaatttccttggtccgcgcactaacggacatgtacatggtgacaatgatcatcagtgcagagacaatcagggaaatggcggcaatggcggctagaatggaagaagctaagtgaacatacgtctgaacggtgctaatcaaactagtaattgatgtggcggcatataatttggtgccgtcatttttgagtttattaatttgcttaaccacaccgttgacactccccagcttatcaatagaaacggctagagcggccggcttagtactaacgttggccttgttgagagccttgaccaaggtgttggtgttaaccgctgtaattgacatcgccccagtggaactttcagcgatacccgctactttggctttaaaggtcaccttggtaggtcgattattcgcgttagcggtggaataactaaccgtaacggttttaccaattagtgatttccaatcctttttattgagctgtttagcaaccgcagttttatcaaggacaatctcgccagcctgaggtttgtgaccgactttgatggaagacgtcgttgcagaactggtccagttggatgcggtactagtggtgactgacttcttaccatgcttgatcttaacatcagtcagtgagtagcttttttcgactttagtcacatgtttgagctgtctgatctgactgatttgtgtctgactaaaggttttgggcttggctgtggtggttcccatccccattgctgcccgctgactttcagcctgtgtctgctgcttgttggcattactggttgaccttgtatgacgggaaacggaaacgacttgggggttcgccacattagtgatctgttcgttgatatagccactcaagccgttgcctaatcctgagaagagaatgaccgcaaacagaccaatagcagttcccagcatgattaagaaattttgaccaaaagtgaacttaaaatgtttgaaggcggtttggtaactgacccgggccggaagcttacgggccgttaagcgctcagcatctccagtcactggataaggctgtcggattgaggtatcactgtcgatcttgccgtcgaccagctggacaatccgggtcccagcatccgccacggcttgtgagtgggtcacggtaatgaccagtcgaccttctttggcaatatcatttaaaatgtcgagaacttcaaccgtattttgtgaatccaacgcaccagttggttcatcggcaatgatgatctggggatcgcttgccaaggcccgcgcaatggcgacccgttgcttttgtccaccagataattggttaggatatttcttagcctgctcggccaacccgacgcgttccagcagatggtttgcccggtcaacccgctgttccttagtcaaagtcgtcatgtctaatgaaatcaagacgttgtcgaggactgttaagtggttgactaaattgtaagcttggtagatgtagccaatcgtttcccgccggaatcgatccaatgatttttcattgcggtgatcgataggtttaccctttagctggacttcaccttggaattctcggtccaagccgccaataatattcattaatgtggatttaccaccaccagattcacctaagatagaaacaaattcacctaggttgaaatctaagtcaattccctttaagacgggaaattcttccttacccaaataataggacttgtggatatcctttaactgtaaagtcgccattcgcttgctcctcttaatgtgttaaggtttaacatcatatttttctgtttaacttttgtgaagcctaggttacgcttgacggatttgaaagtcaaattactttaacataaaattgaaatatttaatgttttggtgaaatgtggtacactaagacgactttaagttgacgtgggaggtggtcagtcatgaaacgagagacgaagaaaaaaataaatcgacaaaaattagtggatgcagcctttgagctaatgagtacgcaaggcattcaagagaccagtgttaaagcggtgagtgaggccgcagggatttcttttgtgacgatgtacaagtattttcccacgaaggatgacctcgtgatggctgtggtacaacgcttatttgaaaaacatatgacggccatgatggtcctcgccaaggatcagagcttgagttttcaagaacgattacacgcgtttttgcgatatgcagccaatttacgtgatgaattttcttcacacgtgggtcacgaattttttgaattttcccatcgccacccggagctaagaacgcaagtcaaccaatggcaagatgaattctggcagttgatcattgccgatgggcgacgaagtggactagtacgcggcgaaattagtgatcaggcggcgcgactctttattcaaatgatggaggcccaagctatcgcggaggggcctttgtcggagacgatgatggttcagttagaggatttgtgtttgtatggtttggcaggaaaggagcacggggcgcaatgaaacggctttattttttgtgtacaggaaattcctgtcgcagtcagatggcagaggggttagcccgtgatttactagatcccagttggtacgttgcaagtgccggaatagaagcgcatggcctaaacccactagccgttcaggtgatggctgagattggcattgatatttcgcagcagacgtcaacggtcattgatcttggttatttaagacagtgtgatttggtcgtgacgttgtgtggcgatgcgcgggatagatgccccgtgaccccagccacggttaagcgaattcactggccactagctgatccagctcaggctacaggaagtgtggccgaacgtttattaatttttcggcaggttcgtgatgaaattgctaggcatattaaagaaatttagtatgccgttaataagaatccctgacagttgccttgcgcaaagacggggattttttctataacggttatctgataaatgtttaaccgtcaaaaaagttatggcgggttgccagttgcaaattttaacggtatcgacaagaatatagtagatacgattgttagaaattggcgatcaggattgtgagagttgtagaaaaggtaggtcggggatgtgaaacgagacgactggcaaatagtttatcaggaattggcggatattattggggagacggctacgcgtaaagtttatcagcattttcgagggagtagtgtgagctttccgttacgtttgctgacgcaccaagcgctggtaacgcgtgttcagcaagactatacggtggggatgacgattcatgagttggcacataagtatcaactagccgatcggacggtccgtaattatttacgggaaaaagtgaagtaatcatacaatcaatttgacttgcaaagtgtaatgtcgaacgaatttttatctgccataaagatttgctactatgatgatatcaagaaaacatttaggtggtggaattttgtggaagtagataatgatgcattacaagcaacttataaaaaactggctgacttgttgggcgatgatttgatgatgaagttttaccaagaattccgggggactcagttgagcttgccgatgaagctttatgatcgagaaggcgcggccaaggcggttcgtcgacattatccggaaatgacggttaaagaacttgccgatacgtatggttatacgcaacgttgggtgaaacaagagttaaaacaggcaaaaacggatcagtagctaaagtaactggttccgtaattgtgaatcaataggtgttaaaatagttatggataaaattaatcagtcgagtaaatgaggagtgacgggtgtgaaacggtggtggaaggccacttggtgcatcataattgtgttgacggtggtggtagtaaccggacaggccttaacggcgacagctgctactaaagcagtaaaacccagggtcaatcggacggtcaaggcaccgactaagcaccaatatatcttagtgatggggcacggagccggtgatagtggtgcgcgaggcaatggcaccacggaggcaacgtttttgcggcagcacttattgcctcagctgagaaagtatgccataaaagtcaaacatagtcaggtgacgttttataatcctaaacaggatattgtgaaggatacattgacctaccataaagggtcctacaagctaaaccgccatgccaccgtcgttatgtttcatttggatgcagccggtggtcatggtggtcatgtgattattcacaagcggcggccaacggcacgtgataaacgactggcgcaggtgattaaaaagtatgttggcttgaatcgggcctatcatggctatagttatcgaacagacctgaaaaactgtaatgttttgcgaaaacgtgggattgactatagtttaattgagacggggttcattacgaatcggacggatatggctcatattcgtaaaaatattggtaaaattgcgaaggcagatattgaagcaattacgtatggaaatattcggtgaggttaattataattgggggtgtcgagaaatcaagggggatttctcgacaccctttttgcgtaaatatttagaacgatgaggtggagtgaatggctcatagcgattggcaagttatttatcaggagttagcggatgttattggtgaagaagcaactttgaaagtttttatgaattttcgggggagcacggccaattttccgttgaatttggtacggcatgatgttacgcttcaacacgttcagtttgattaccagcaaggttgctcgatccatcagctgagtcaaaagtatgatttggctgaacggaccgtgcggaattatttgcaacacaaccgacaaacaggttagaaagtaacctgtgaaagaccaaccagttttgcgggtcgaaaagttttatgtgaccaagtaggttgtgtgtagtgatagtagagactgttggtaattcaaaacaatacggataattgttttcctgccggaaacgatacgcaactaagagtgctgttttaagtgtagtgaacaatttatgtaaaattttgagttagcaagagttttaccccatcacaggctgaggatttcaagctggctataatcaagttatataatcacgaactagctagcgtaaaatactgcggattcaagattagatcattagatcaaatctgaatccgcagtatttttttgtggacttatattgacttacgccagagacgtggtatattagaagcaccaaaggtgagtaatcactcacctagctatttttacctacttgaggctaaaaatagctattatttagatcatttaggtgagtaatcactcactttaattaagggagtgttcatatggcaatgactatgattgcattaagtcatttagctaagaagtttggtgagcaaacagtgctaaaggatattaatttgacagttaacggcagtgaaattgttggtctaattggcccatccggtgctggtaaatcaaccgttattaaggtcgcattggggatggaagtcgctagtggtggcaatgctacggtgttagggaccacgatgcctaatcgagaattgttaggtcaaattggttacatggcccagacagatgccttatatgagacgttaacggcacaagagaatttaaagttttttggactgatgaagggcattaaaacagcggatatgaaccaggccatcagtcacgtggcccaggtggttgatttaacaccagacctgaacaaacgcgtggccgggtactccggtgggatgaaacgccgtttatcattagccattgccttattaggtgatccggaactcttaattttagatgaaccaaccgtggggattgatccagcactccggcgacaaatctgggccgaacttggacggctacgggatgcgggacgtagtatcttgattacgacccacgtgatggatgaagccgagttagctgatcgcgtggctctgttgcttgatggcaaagtgatggcctttgatcgaccggctgccttaaaagaacagtacggtgttgccacgattgaggatgtcttcttaaaggcagagggggtggaagcatgagaaccattgcgattatgaaccgagtgctaaaagaattatttcgggataaacgaacgctggcgttaatgtttgtggcacccatcctaattatgttgttgatgagcgtgatctttaataccaattcgaccactgatgttaatgtagccaccgtttctgtctcatcgaagcttaatgaagaactgggaagcctgaaacacgttaccgttaagagctatgatactaaagcagacgcgaaacacgcgttgaaccaagaaacggtggatgctatcgttcaaaagtcgggaaagaactatgatctgacctatgccaataccgattcaagtaagacgactgctgttaagctggcattcaaaaatgccttaacggcaaccagtatttcacaattgaaatcggcgcttaagcaaagcacaacggcgatggcaaaactgcaaacacaactggcgctggctcaaaaagcagctaatggtccgacagcgtcagtcaccaaccacgcgaacgcggtgacgccgaaaaccagtcagttcaatagtgcaccaaaggtaacgaaccactacgtttatggtgatcaggacaccgggtattttgctaaaatgttgccaattttgatgggcttcttcgttttcttctttgttttcctaatttcgggaatggcgctgttaaaagaacgaacgacagggacgctcgatcgactgctggcaactcccgtgaaacgatcgtcgattgtctttgggtatatgctgagttacggtattctagctattctgcaaacggtactgattgtgctggtaacggtttggttgctggggattgaagtcgtcggcagcttggtgagcgtggtgttaatcaacctcttgttggcactagtcgctttagcttttgggatcttattatcaacatttgccaactctgaatttcaaatgatgcagttcatcccgttggtggtggttccccaggtctttttctccggaatcattcccttagattcaatggctgattgggtcaaagacatttcctacattattccgcttaaatactcgggggacgccgttaacgagattattatgcggggtacctcaatctttaacctcggtggtgatattgctgttttactgggatttttgattgtcctaacggttttaaacatcgtggggctgcggcgctaccggaaagtttaaaagtcaggtagaataggtgaatggattgttaaaaaggagtgacaagcttggcaacggatatgtttcgaaattatcgtgactggttggaccagcaaaaaatgccacggggcaaacgagttgcactattagccgcgctggaactctttgccgatcaaggatttgatggcacctcgacgcaagccgttgctgatcgtgctggtatcagtcaagcaacgatctttaagtattttaaaacgaaacaggatttgttattggcaattcttcagccagtaatggacaacttctttccggtttaccgggatgagtttgtggcgggaattcaacgaccacaaacattggcggaaaaggtccatttcgtcgtattagatcggtacgccttctttaaagctaatcgtgaggctgtgaaaatatttgccgttgagatgatgactaatgctgaaattcgccagtcattcattaaaattgttggggttggtaattttgcgaccttcaataaaattatgacgactttccgccagaccggagaattgcgtgacgatattcaagcggccgatttaattcggtcgtttatcggtcaaattgtcggctatggcattcaaacaacctatatgccagtgagtgatagcaacgagaccgctgatttacaacgaattacggaacaactgattcgacttattcataaataagtcaaaggccacgagtaattgtggcctttttgctgtgcacgataaaattgagctggtaaaagggtcaaaagttggtacttatttttagtaagtgttgacaaaataattctaggtgttattatctacctgtgcttataaaaaacacatcaatgattgaggagtgatgatctgatgacaatgattaatggttatgaacaaagtgatcgcgaagaatctttagatattttgaatttaccgtccctggaagcacgagccaagcaaattattccagctggaggatttggttatatcagtggtggttccgaagatgaatggacgttaaaggaaaacacagaggcctttaatcatgttcagattatcccccgtgccttgaccaatattgaacatcccagcacgcagacccagatttttggggtagatctacaaacgccgattatgatggcaccggcagctgcccaaggtttggcgcattcacggggtgaaatggcaacggcacaaggaattgccgcagccggtgctttgatggcgcagagtacgtattcttctacctcaattgctgatacggcggcggcaggtcagggagcaccgcaattcttccagctatatatgagcaaggattggcacttcaacgaaagtctgttagatgaggccattaaggcaaatgtgaaggcgattatcctgacagttgatgcgactgtggatggctatcgtgaatccgatatcgttaataagttccaattcccaattccaatggctaatctgacaaagttcagtgaaggcgatggtaagggcaagggaattcaagaaatttacgcggccgctgcgcagaagattaatgcggatgacgttcggcggattacagaatatacacatttgccggtgattgttaagggtatccaatccgtggaagatgccatgaccgcaattggcgctggtgcagccggaatttatgtatccaatcatggtggtcgacagttaaacggtggtccagcatcatttgatgtgttacacgatattgccttagcggttaatcaccgggtacccatcatttttgatagtggcgttcgccggggttcacatgtctttaaggcactagccaatggtgctgatttggtggccttggcccgaccagtaatttatggtttagctttgggtggtgctcaaggcgtgacttcagtgattaatcacttaaacgacgaactcctaattgatatgcagttggcgggaacgaaaaccattgaagacgttaagcaggcgaagttactgcgccattaggcctaatctgaaatagaaagcaggcgattggtgtggaattagagatcgatgctgcggttcaagctaaattgctgtcaaagcttgggccggataaacgggttttactcagctacaacgatggggtagggccatactcgcatcacggtttaattgccttacaggtggactttcaaattgtcattattgcggctgacatgccgatgaccgattatgaagcgtcactgacaacgaacttaggaacgtggtacgttaaagggtattcaaccagtttattggatgagcgtatgcggctaacgttgaatacaacttacggaacgattcaattatcgggtaatgaaatgattgatgataacgttgagattgtagatgcgtcgcataacgtgtaatctaaaagcaaggaccgttgtctccgtggcgaagactaacgggccttgcttttctttgattaatggaggaattggatgaaaattgtgtttttggtgctgctattattagtggccgttgttgtgggaaatgttttggggcggcattatcagcggttgccgttgcctttcatcttgataggcctcggactgatattttcttttctgccactctatcacggctttcaattcaacccggatgtgtttacttttgccatcattgcgccactcatgtataacgaggccgaaaatgtctcacgttattgggttgggcggggaattgtgaatatcttttcgctggcaattgtcttggtcatcgtaaccgtgttattcgtggggatcatcttacatcaattatttgcgttcctaccactgagcttggccttggccctctgcgctattgtgacgccaaccgacgcggcagcagtgagtgcgattgttccggcatcagacgagttcacgattccacagattatcttacaaaatgaatcgctgtttaatgatgcttctgggattgtggcgtttgacttagccttggccacgtatttgtcaggtcaattctcattaggcactgcagtggttgactttgggcgagagttcttagggggattattggttggggcaatcctgggcttggtcattgcacaggtacgtttatggttaatccgtcagagggatgacacgccactgatcttggttaccatcgaagtggcaatgccgtttttactgtattacttagcgaccatcatgggtgtttctggaattttagccgtggtggcggccggaattattcaaggggttgaacgagaaaaactgcggttgactgcaagtcggatgcagttggtgagtgctaatgtttgggaaatgattgacggaatgttatcgagcttggtctttgtgttgctcggcatttcactgcctttggtttggcagtcagctttacagaacacgttggttccttggtggcaattagttctggctgggggacttatctacgtgatcaaattgggattacggttaatctggtcccgttatttggtttggatgcataagccgagccaacatcggtggcttgatagttggttaatggcattgagcggtgccaatggaaccataacgttagcattagccttttcactaccactcaccattaatttacggggatcgttgatctttatggcggcggttgtcatcttattgagtttattggttccgaccgttgtcttgccccggattgttggttcagaagaagacaaagttgatgatttagcaagttggagcaagcgcctgaaattagcggcaattacgcagttagaacagcaagttacaacgtctagtgaagcccagattgttattgatgcattacggcagcaattacaacaacagcagggttttaaaaagcaacaacaacgagccttattccgccaggcggatttggcagagcagcaagagatgacgacgttacgggtccaaggtaaaataacagcggatgagcagcgagattacctgaaattcttgacctatagtcgctttacggttgatcagatttggtggcgcaatctaggattacggctgtggtttggtctgcatatggggcacgtttcccacgatattcagacagcgcaggagacctttatgacgtcgccgttagtgatggagcaacggtattgggctgaccagtttacggctaaggggcggtcaattcgaccactggaaaagagcggctatcacgcagcaattgacggcagagcgtacggtggataatcgtgcagccgtggatgtggtgcgtcgttattatcacgaacgtcatcgccagatgaatttagctcctgctgattcggatatcgtgtacgagctatttttacaagcttttcacgtccagtatgaattagtacaagctgcttttaaaaagggccagataccggcgacgctggcgcaacagctccaacaagaaattgtgtttgatgaaacaggctacattcaaaaccaacaggcgtttttaagttaataatcgattggccaacgtgattcatggcgttggcttttttatcagttattgttgatgcgtagtcgtgactaaggcgtaaccaatactaacggttaagatcattaacccaccaatgaggagaagtccgggttgccaactagcaaaaatgtgattaagttgacctagtagaagtggcccaacagccgctaataagtatccacaggattgggcaatagcggatcgctgggcgactactgtgacccggcgactgctggtggcgatgagattaagggcgagcgtgaaaaccaatgagcatgtgagtcccagaataattgctgagagccagtgtccccaaccgcgccaaagtaggcaggtcaaaccaaccaggtaccccagtaaaataagcggaagtaatcgttggaagtgccagcggtaggtgagaacgagcgcggcagggataccgacaagctgaaagaccgataataaggtacctgcctcagcggcactggccccaaaggcttgataaatggtcggtaaccaagttattagcgtataaaaaatgagagattggcaacccataaacaaggctagtaaggtggttgagcgatcgagtttccagtgcacgttagttgtgggggtgacacgcgattgggtgggcagtgcgtgacgataaaaaacactggccaataatgcaaagccagccggtagtccaagcaattgcatggcagttgtccagccccaaatagtggccaacggtaagataatagcggtaccgatagcggcaataagattcatagtcagggaataataactggtcatttgggtgactcgggatggcgtggtggctgcaatcagtgtgggaattaggatattcaatagggcaatggccccgccaatattgcaaaacagattaatggtagtgtaactaatagagcagtagtcgtattggttatgtgaaggtgctgttgaataatgccgaatagctgaaacaacgagcaataaccagtgaaaatttacgtctcaacgaaaccggtagaagagtttaacgcttgcggatggaccttatggtaagtaacttcatataacaaagcgatagccaagacttatgcagataattcagtttaaggtcgtttaattacccaatcgtgaaaaaagctagtatagtatgagtcgcagattaggctgaaatgggggggaccattatgcgtaaagagcggctagaaaagggctcatggctcggtatgctgattacgttgggggtggtttacggtgatattgggacatcgcccttgtatgtcatgaatgcattgattaacgatgctggtccgttgaaaaatgcgacaccggattacgtgattggcagtgtttccttaatcttttggacactcatgctgattacgacagtgaagtacgtgctcgttgccttgcgggctgataatcaccacgaaggtggtatctttgccctctatgcgctggtgcgtcatcgtgctaagtggctgatttttgtggctttgattgggggtgccgctttactggcagatgggacgttgacccccgccgtcaccgtgacctcagcggttgagggccttaaaggcttaccggatctaagggccttttctcagtattcgtggttggttccgcttagtgttacgctgatattggtcagtctctttacgattcaagtcttagggacggcagtcgttgggcgttcattcggaccgatgatgttactctggtttatcgttatcgggggtattggactacttaacattagtcaggcaccggcgattctccgagcattttcacccgtttatgcgattcaggtgctgtttagtccaacgaataaaatgggtatttttattctggggagcgtcttcctggcaaccaccggcgcagaggcgttgtattccgatatggggcacgtgggtaaggctaatattgatgcaacttggcccttcgtttatgcgatgttgattttaaactatctagggcagggcgcttggatgttaacccatagtcaagggcccgcctggcgaaatgtgaccaatatcaatccattttatgaaatgattcccagtggtggtcggattgccatgattgtgctggccacagttgcggccattattgcctcacaagccttgattacggggtcctacacgttggttgatgaagcagtgggactgaagtttctcccgcgtatgattatcaaacatcctagcaacgtgcgtagtcaaatctatattggtgctattaattggctgctgtgcttggtaactttgagcattgtttggttatttcaaacctcggcgcatatggaagcggcgtatggattggccatcaccttgacgatgttgatgacgacgatattgttgagccagtgggttcaaatgaaaggccaccggttctggtcattggccttattggcgggatttggtttattggagaccctctttttggtggccagtttaacgaagtttattcatggtgggtatctgacattaggactcacgttgatgatcttcttaattatggtcgtttggttttttggtaaccggcggcgcctacgctataaccaagccgatgaacagatcagtttgttgaattatcggtcgcagttgattcaactaagtcaagacgataaccagccactatttgcaactaacttggtttacctggcgaaggtggatcagttgcatcgggtcaagcgatcaattctatattctattttagataaacgacccaagcgcgcgaaggtctattggtttattacaattaatgaaaccaatcgtccttacgactgtagctacagcgttgacatgttaggaacgcgcaatgtggttgaagtgcggctgaatctagggttccgtaagtcacaacatattaatcgttatttacgggcaattgtaaccagcctgattgccgatcatagtattgaccctcagtattcgaattatgggattacgcaaccgcgacaggtcggtgactttaaatttgtggttcagaatcagcagattatggatttggcgggaaatcccaccatgcatcaattcgatcgattcctaattggtggacggatcttcttacaaaatatcacgccgtcgccagcgatttggtatggcttggaatttagcgatgtgcttgaagaaacgattccgttatttaccaagccaatgaccgacccagcgctggttcatttagcgaaacgacagacaacccgtcatcaagtgtgaatgatcaaaaactttggttttgaaagaattgcgacgattttgcttaagtttagtcctttccaaatagtgacatcatgaactatgtttaacttaaaagggaggcaatatttatgcagatgatgcacgcagtggttgttgatcatcccggggcaccggacgttttatcgtatcgcgaagtgccctgcccagcgttaaagcctggttggagcttagttcgggttcacggttttgggattaatcattcagaagtctttacgcgtcagggcctgtcgccgagtgtcgagtttcctcggattttgggaattgaagtcgttggcgaggtagctgctaccacagcgcccgatcagttcaccactggtcaaacggtcatctcaattatgggcgagatgggccgggcgtttgacggtagttatgcggagtatgtgcttctgcctaatgagcagctatatccgattacgacggatctcagctgggctgaattggcgacattacccgaaacgggatacacggcgtatggggcactacgcggcttacgattgcagccacaagatcacgtgttgattcgtgggggatcaagtggcgtgggcatgatggctgccaagttggcccatgcgttgcaacccggcattcgcgtcactagtacgacccgccatgctgataaggcggcgacgttacaagaacaaggggctgatcaagttttgacgggtgaattaacgcatctgccagccgtagcaacctttgataagattttagacttaatcggtcctaagacggccaaggactctctacaacatttaacgcctggtggcattgtcagctcaactggtgaattgggtggtcaatgggctttcgatgcatttgaaccgattggcgatattcccaataatcggtatttgacgtcgttttcttctggtgaggtggaaccacaattgttgcaggagttagtggacctcgtgacggaaaaacacgtcgacattcacccgacgaaggtgtttactctccgtgaggtggctcaggcccacgcggaaattgagagccgccagggctggggaaagtatgttgtggtgattgaagcatagaaataatgacgatcggttaaataacaaaaatcagtccttccacattttggaaaggactgatttttaatttccaacactggtgccgttatagcgttggtttgagttgtttaacggcttcggttacagccgtttttgcactacttaatggggtccatcctaataccgttcgggccttctgattgctaacgtgatggctcaaatgcaacatgagatgaccttctttgatggcagaactaaagggggctaagacattaatgacaatattgggtagaaagtgcttaggtagtcggtccgctaattcagggaaacgggttttaaccaacgtccgaatttctttcatagaaataggatgatcttctactgccaagaaacgctgattggcagcggctggggtggtcattgcccggacatggatatcgcaacatcgcgaacgtcaacgacactaacggttaaattaggcatagcctggcccgtcagcaggcgttttacgagaccaaagctcccactcacatgatcgtctaatgcgggtcccaacatcgcgccggcattgaccgtgaccaactcaaaagggtgattgtggtcggcgacgtagttccaagccgccttttccgcgagtagttttgattgctcataagccgaaagccctgattgttggggatccgtccagtcgtcctccgtaatcacatgggtcggatcaagactactaaacccgaccgcaccaaagttagcagtcatgacaagccgcttgacgccagcggccgcggcggccttgagaattcgtagcgtgccggcttcggccgtattagcgacggcatccgtgacagtcgcgccgttaacaaagaccggggcagccacactcatcacatacgtgataccagtcatagcggctggccagtcggcgtcggtagttaagtcggcctgaacgaattctaaccggtccaaatggggcgtttgaacattggtgagtgcttggcgaacggctttggccttgtctaagcgacgtaaggtcgcccgaacgggatagttttggataagtaaatgttgaataatatggagggccagaaagccattgcccccagtaacgagaaccttttcatttgacatagtgatctcctttagcgcttgcatggcgcgatgaaattagttaatgtagacagcataaaccctagaccacactctagggcaagctaggaggtcaattttttgacgtatacgatcaaacaagtagcggacaagacgggattatccatctatacgcttcgattctatgataagcaaggcttactgccattcgttgcccgtaatcagtcgggttatcgggcatttactgagggcgacttgcatttgctccacacgattacctgtttaaagaataccgggatgaccattgctgatattcgccaatacattggttacgtgatgcaaggccccaccagtgtgccacaacgacagcgtctattgcacgctcaccgtgaagctattttagcccgattagctctcatccaggataatttgaaggaaattgattttaaactcaatatttatgatgatccggatgcggcggctttagttgcccaagaacaggcggtggcccaagcggaaaaaattgccaatggcttaccaaatccgtatttggcacctttaaattaagttttaaacaaaacagttgcatttaaaactgtttgtgataaactggacctacgtctaaggaagtaggtggtggtagtgcaaacgcagcaaaacttgatggggctgatttaccaactggcccaagcagaaacacaggcgttgaatcagcaactaaagcagttaaatttgaacaatgagcaggcccgagcactgaattatattgatcagcacccggggactaatcagcgagcagttggcagttacctggggcgccaagcggcgagtacatcaaatctgattaagcggttgttaacgcagcaattggtggtacgccaggtggcagctgacaatgatcgagaaaaacagttgcacgttacgactgccggtgagcaggtggcgcaacagattgcggctgcattcaccacggtcaatcgccaaatgatgcaggcagttcctgtcgaccagcagacgcaactttctgagacgttgaagctgatcttacagcgattatcaagggagtcctaacaatgtcattaacgatttcagaagaacaagcaacgcgaaaagaactacaggctaactttaaattaagtggcttaacggttgaccaggttgcggcagacctccaaaccacaccagattacgtggacgcggtattagagttacgggttagtcggatttgaagacccgtggattttacgaaattacctcaatgccgccatacaggcgcaaaaacagcatcctattccttacagccgtttaaacggatcgccattacggcattggtttttaaatcaaggccgcattcggcggggaagcttagcggattaatgccgctgatttaacagctaaatctgaacacgaaaaacaccaactaggtaatagacttagttggtgtttttaactgaatgactgtctaattagtcaacgacaatcaatgatttgattgcttcacgattggtcatggcttggtagccagcgtcaatatcgtctaagctaaattgcttggtgaagaccttgcctgggtgaatatcaccgtctaagacggccttcaataagacttgcttatcgtaggtcgtgacagaagcagggcccccagcgatgatagtgttgttgtagaatgatgcggtcatatccatcttgggttcatggggtaagcctacccggccaacgatggcgccaggacgaccagcctgcatggcggtaacattggatagttccgtgccgacacattctaagacggcgtcagcgccagcaccattggttaaggcattaactttggcgatcgcgtcatcgccccgttcggcaatgacatcagttgcgccgaattcacgggctagcttttgccgatcttcatgccgactcataataataatgcgcttagcaccgcgcatttgtgcggcaataaccccacaaagacccacggcaccatcaccaacgacgacaacggtatcacccgttttcacgttagcgacacgagcggcgtgataaccggtcgccataacatcggcgagagttaacagggaggccaacatatcttcactgtagtcagatggttggccgggaatcttgactaaggcccattcgccgtgttggaaacgaatgtattcggcttgaacaccattactgaagttgtccgtgtggttttggcaatcgccgtcaaaaccggcacgacaagcagcacagtgaccacaaccatgagtaaatggcgcaatcacaaagtcaccaggaacgacagttgtgatgtcagacccaaccgcttcaacgatcccaatggcttcgtgaccagtgttctcagaatgatgtggcttatcttctaaaccgcgataagcccacagatctgacccacaaacacaggtgcgaacgacgtgaataatcacatcatcaggtgcctgaacttgcggtttttcgatgtcttcgatggcaactttgccgggttccataaacatagtggatttcatcatgtatttcctccttgttgggttgagaagtggtgatagcccacatccaatcagcttaaccttagtgtacgccttcgagtccactcgaaagcaagtgaaaattgaaaaataattattttgttgcaggcatacccgtgacagcttagttgggccaatgggttgaaagttgggtaatcagtggctggactcgtgttttttcagtgcgcaagtaggtggcatagacggtcatttgggccgcaacatcattgatcggtaagcaaacgcgttgttctgtgacctgatttgtggtaaaagtggggtcaaatatagataaatttgtggtgaagaacggcaaattagcagatttagtcaaggcgagtaatgcggctcgctgttcctggtagaagaattgggcgttagggatggcctgttgaatgatgtctcgccacgggccaatatcgcgtaacacaataaaatttaatccttgaagctcagcaaaactaacggttgcctgattagcctgatacatgaattgattcagattgacggctaaacgctcaatgccgattgattgactcgtgattaatggcgtatcgagcggctgattggttaataccacaatggcttgttgtgatgtgagagccgctgtgactcactccggtgccagcaatgtggttggcaagtgcgttgtagttggtaagtgcccttggatgtgttgcaagtaaagtaacggaccgggtaaggtggtagcaatgggaaaggtttggtgtgatgagtcaaaattgcgaatccgagtgacagcctcacgctgggctgccagtaatcgggtagcttcggctgcggcgagtttccccgtggcgtttagagtgagtcgattgggatggcgttcaaaaagcttaacaccgagttgctcttctaatttttgcatgccccgagtcacggttggttgcgtgatattgagtttagttgcggtttctgccaatgtcttagtttgagcaaaggttgccaattcctccagcaagtgattatctaacatccgagttccactcctccgtagtatgcgttaacggtatactagcatgtttaagaagtaattttcaaccgtctcagtttgttctatcataggagccaatcaggtaacaagaaaggatttgatcatgtgtccgtaccaacaattgtgttaaataatggtgtgacgatgccccaattggggtttggcgtttttcaagtgccggatttagctgagtgtgaaacggctgttacccaggcaattcaaaccgggtatcggttgattgacactgctacggcttatcaaaacgaaacggcagttggtcgagcgattcagcagagtggcgtggcgcgtagtgacttgtttgtgacctctaaattgtgggtttcagaattcacctatgaacgagctaagaagggaattgatgcttccctgcaacgtttaggattagactatttggacctctacttgttacatcagccgtatggtgatgtcatgggcgcttggcgagcaatggaggaagcttaccatgcggggaagattcgggcgattggggtgtcgaacttctatgcggatcaacttaaaaatttggagctgacgatgaccgtccaaccagcggttaatcaaattgaggttaatccatggtatcaacagccacaagaagtagccgctaaccaagccgatcatgtgcgagttgaagcttgggcaccatttgcagaaggacagcacggaatttttacagatccgacgattagcacgattgcccaagcacatgggaagacaactggtcaagttattttgcgatggttattacagcgaggaattacggtcattcctaagtctgttcaccaagaacggatggccgaaaatttagcagtctttgattttgaattaactgcggcagaaatggcaacgttagcgggattagatcgtggtgagagccaattttttgaccaccgcgaccctgccacgattgagcaaatttttgggtcaagtcttaagcaattacgaaaggatgttgattaacgatgacaacaccaacgattcaattaaacgatgggaaccaaattccagcagttggtttcggtacttttcaaattcccaacgacggctcaacgtatcaagccgttaaagcggctttggcagcgggttatcgccatgtagacacagccgttgcttacttcaatgaagctgaggttggacaggcggtacgggacagtggcattccacgtaatgagatttgggtaactagtaaactgtggttacaggattttgggttcgaaccagcccaacgcgcaattgacgtatcactccaaaaattggggttagattaccttgatttatatttaattcaccaaccatatggtgatgttcctggtgcttggcaggccatggaagcggctcaaaaggcgggaaagattcgctcaattggggtgtcaaatatgacacctaagttgtggcaacagtttgttccagaattcaccacgattcccgctgttaatcaggttgaattcaacccgtactttcaacagaccgaattgcgtcagttgttggcaccgcatgatgtgaagcttgaggcatgggcgccgttaggacagggaaatcagtctctcctaaatgaacccgtcatccaacaactagcagtcaagtatggcaaagacgctgggcaagtgattctgcggtatgaaaatcaattagggattattgtctttcctaagtcagtgcatgaagcgcgaattaagagtaatttagatatttttgattttgacttaacaccagctgaaatggcgcaattagctgcgttagatcaagggcatgggcaacatgatcctgatgcaccaggtgttgcggatatgttattacgggcctttgacgtgcacgctaatgactagtgcaaaaaccatgatcgtttgagatcatggttttttgatacctggttgttgtaagagaaattggcgcaaggggtgttgcgccggtttatcgagaaaccggtatgcacgtggggctgtaaactgggggtccacttgacgcaagtcagcaagtgtaagtcgtggaatggcaatcacagtccggattggcagtgcaacagcctgggaaacattgccgagatagttgcgaatggcggtagcatcagtagcggtcagattggctagtaaacggttgggagctgccactagcggctggctaatttgaagaaataggccaataccgccgtgagtaccggttacatgaacgaacgcttgaaatggcccttgatggtaaaaacgacgtcgatactcgatacgtttagtgccggcttcgatcacttgtgcgggttccggatgtagggaaaagagtaacgttggttgagttggttcatagtagtcttgaacggttatcatgtaatcgctccgttagtaatgatttatcataacaaaatagctgattcttgcatggtagttgcggtatacttttttgtaaaaaggaggaatcagtgtgatgacagtttttacagatgaacagaaagttcaactgttggcagatttgatcgccattcaatcagtgaatgaccatgaggaattggtggcgcagtaccttaagcgggtactgacggatcatgatattgatgcgagaattgtgccggtcagttctggacgagctaatctgatcgcagagattggccatggctcgcccattttaggtatttctggtcacatggatgtggtatctcctggcgacgtcacacaatggcagagtgatccttttaagctcagcgaacgatccggcaacttgtatggtcgcggtgccagtgatatgaagtctggattagtggctttagttatcgcgatgattgagttgcaagcagcgggacagcccaagactggtcgaattagactgatggcgactattgcagaagaagttggcgaaacgggatcacaggcatttctagaacaaggtgccatggatgatgtagatgctttgctgattggtgaaccatccggctatcgcgtcttttacgcacacaaggggtcaatggacattcgattaaccgctcaaggcaaggcggcacatagttcaatgccggaaatgggcgttaacgctattgatcctttgctagtgatcttgaatcaagcgaaccaggtctttcggaatagcgatcgccataatgagctgcttggtgatttagcctttaatacaacggttttccaaggcggaaatcaagttaattcaattccagagatggccacggcagaaatgaatgtgcggacaattcccgaatttaataatgatcaggttgtcgccacgcttaaagaattggtcgatcagcaaaatcagcaaggggcccaagtatccacggatgtgtatatgtctcagtggccagtggaagaacccaaggagacgttattgagccagttagctgttaaaattggggctgactatgccgggacggctattcccaaattagccttaccagctgttacagatgcctctaacttgttgaaacaaaagggccacgaatttccatttattatttttggtcccgggagcgatactgctcatcaggttgatgaatatgttaacaagcaaatgtttttagatttcacgcaactgtatcaacaattgtttattgattacttgcaacaagcaacacgctcctagatggcttaaaaggacgctgactgttttccagatagtgggaaactgtcgacgtccttttattcggctaattttagataatcctgtaggtaagttgccaagccgtcatgatcattgtccaaaggcgtaatgtcattagccagtgccttgatggcaggggtcgcattttgcatcgcaactccccaaccggcataatcaatcatcgcagtatcgttatgttcatccccgaaagcaatgatgtccttgcgcgcaatgtggtaatggtttgccagaaactcaacgccggttgctttttgaaccccctttaccccgagttcaaccacggagttagggccaccccacggcgctgcatcgatttcgtcggcgaagttgtgctgcaaataactcaataggtgctcttgatggccacggtcaacggcaaccgtcaaactagttgggttttcctgaagggtcttttggttaagaatttggttagcttgcaagacggaagggaaaaagccaacttcgaccggctgatcgcggacagctaaaaagaggtttttaccttcagcagcaatcatgttaatgcccagttcttcacggtgggttaagagatcaaaggccacttctttgttgaatgtatactggtattcatcggcccaatcctggtggggtaggtatcccaaactgccattaaaattgatcatgggactgtctagccccagttcatcatagatgttggcggaaatccgatttggccgtcccgtgacgatactgacgatatgtccggccgcccgggcttctttcaaaacagctttggtgcggggagcaatctcagcagcagcgtttaatgtggtgccatccaaatcaatcgcaattagttttcgttccaaagagaacacctcacagttcttagtgtatttaagtcgaatcaaatgtaaactagccttttaaatgtaccacaagtattgaaaagttactaccattttggactagtgtcagctttaagaaacgggtataataggcaaagagaaaaacacgttttatgggattatgtatatagcaagtatgtaattgtatctaacaagatggaggaataatggtgaatttacctgatgactttgttacgaaatatcaacgcctactgggaacggaggctgccgcatttttagcaagctttgacactcccagtctaagtggctatcgcgtcaatccaactcaccatgacttaccaacgacattgacagagacaccaacggttgcttatgagcccttaggtcattttggttcagtaagtggccgtagtctgatgcatcaaagcggggcagtctacagtcaggaaccaagtgccatgtttgtaggcgcaacggcggcacctaaagttggtgaacgggtgctagacttatgcgcggcgcctggcggaaaaacgacgcatttagccagctatctgcaaggaaccggattgctcgtcacgaatgaaattaatcgcaaacgggttaaggtattggccgaaaatgttgaacggtttggtgtgcccaatgccgtcatctttaatgatgcgccggaacaactgagtccggtattcccggattattttgataaggtactggttgatgcaccttgttctggtgagggcatgtttcgaaaagatccagcggccatgacgtattggtcattagattatgtgaatgactgtgccgcacgtcaacgtgatattttgacagaggcgttgaagatggttaagcccggtggacaattgatctattccacctgtacttttgcgcctgaagaagatgagcaaatgatggcgtgggtactccaaaacttccctgaatttcacttggtaccgatccaaaaggtcggtggcgtggttgatgcgcgaccagaatgggctgatggcaatcccgaactcgctaaggccgcccggttgttcccccatctcatgcaaggtgaggggcattttgtggcaaaactagaacgtgacaccggtgacgcccatgagcttcgcgggtcggctaccttgggtcaagcattgacgcgggaccaacaaaagttatggcaagacttcgctgatcaggtgctcggtcaagcgacgtttaccaacttagtgacagtcaaagatcaactctttgctttaccagtaacactgccggatttgaaacacgctcatgttttccgtccgggcttgcatctgggtgtcttcaagaagaatcgatttgagccggcttacgctttggccttagcgagtgatccgcaagtcgttagtcgttcactaaccattacggcggatcagtggcgagcatgggtccatggtgatacctttactttaaccacggcaccggagaaaggctggtatttgctagtttgtgcgggtcaaccagttggctttggcaaagttgtcggtaataccgttaaaaactttttccctaaagggctacgattcaccgtctacgatcattaaatgaaatcaataaaagcgtgctcccaggttttggggaacacgctttttgtttaataagttaattgacgctgttggcagtagttgattagttctggcgacaacaggagacgttgttgccgaagctgcgttaagtcggtcgtgcccagtaaggtcatgatcgttcgcaaaccgacttgccagtctaacagcatagccgtggtggtggcctcatcggtcttgattagactgtgtagaatctggccagcactgccgacaacccgtgcccccaatgccaacgccttagcagcatccaggggttgacgaatgccaccggtggcaatgacctgtaagtcaggttgttggcgagcttcaaataaagattcgaccgtcgactgtccccaggtatcaaggtagttgagttctttttgatgacggcggaaattttcgatatcaacgaagttagtcccgccccggccacccaggtcgactagtttgacgccaacgtgttggagtttttggagagtctcttgcgccatgccgaacccaacttcctttacaataacgggaacgtctagtgccgcaacgatgtttccaatatgatccagccagtgaaagtcgcgatcgccctcaggcatgaccaactcttgcgctgtattgacgtggatctccagagcattagccgccagcatctggacagcatgtttggccgcccgtacatcgtgaccagcaccaatgttcgcaaaaactaggccgtcggggttgttttcacgcagagaagtaaaggttggaatggcctgttcatctttaagggcgatgctctgtgaaccactagcgaccgccatgccagtcgctgcggcaattcgtcccaattgggcgttaacaacgcccgttcgtgggctaccgcccgtcatggcctcaatcatgagtggtacctttagagataacgggccaagctgagtggaaaaatcaacgtcagtgagactgatttcaggcaagctctggtgaacaaaccgtaattggtcaaattgactagtggccgttggcgtgtaaaacttttctgctaaggatagatgttcatctttgcgatgggcatgacgtgataggtccataggataatctccttattcgataacgtgatggacgttaagttttagtggttcaattccgcgagcttcccattcagttaacaggtgagccaaatccttagcagcgttgataatgacaatcccgcagtcaccaccaccggcaccagaagatttagccgcaccaccgacatgctcagcaatgtcacacatggtcttcaacaaagttgtttcaatggttacatggctcaggtgagctaaatgattcagtaattgccgattgaccgcaatttcggtttgaattgcgttgaggtcttgatgatggaaaccgtcgatcatgcgttgtaggcactcacgactctcccgaagaaatgtgtgatagtctttgcgacgcgttgccttgaacagtgcgattttatcaacgagatgggaggtggacgccggtgttccggtccaaccaatcattagtcgtaggggttcaggtggcgtgagtaattcgatttgtaacccgggccattgagtatctagcaattgttctaaagaaagttcccgccgcgctgaagccaaccaatcgcgatcaaatgcttggtaggcaatccagccgccgtatacggaagcagcaatatctccaagcgagccgtttccttggacgtctaagtgagcgatagccgctagcttgaataaacgatcctgactcatagggatgtcgtagaattggcacagggccttgacggttgccacggtaacggcggctgaggaacctaagccgtatttcttcccgtcagcactgtctaactcgctattaacattcaagtgataaatgctgagaggcttgcccagtgtttgggcgtactgctcggtcagatgaatggccgatagaatatagtggaaggggttatcacgattatcaaaaaccagttccgttccttgccgttgccaataaagcgaattttcttggtattgtttcgatgcaatgcgaccgtagtctcgactagtctcgattgtaacggtcacaaattgattaagcgcgacaatgatggccggatatcccggttcaaccacagcgtactcaccagcaatgtataattttccgggtgcttgcgcggaaatcaaaaaatcaggtcccttcttgtaacaactattatgattattaaataatgcccttatttatgaaagaaagcgtaacccgggtccgggatgagcaacgatcacgtgttcagcaccgaattgttcggcaaatttctgcgtgatggtggggaggtccggcgtctggcaaaagactttcaggttagggccagcgtctaaggtatagtaacattcttgtcccgcttgccgtaagactcggaccgtgtccatggcccttaacgtgtctccattgaagtaactgtaagggggctgcgcacttaatgttaacgcatgcatccgcatggcgttactttccaagacttcgcccattgttgaaaagtcttgatgcaaaatagctggcttgatggtggctaaatcctgagcaacaacggtcttccacgctgggtagtagggagatgtggtgacactggattgcatcccttgacgtgagctaattcgcttgtgatggggatctagtacgagggccacaacagcgattggccagtcaaccgtttcctgcaagggaatggctagagaggtgtgatcatcgctaccggcttgccattcaacaaaaccaccgtaaatcgagcgcgtggcagaaccagatccgcgtcgggccaatcgtgataacgcccttggcgtgagctctaacccggcagcacgactagctgctccagccatagccgcaaaagccgaggccgaagaggctaaacctgctgcggtcggcacgtgattaacggaggttacatgtgcgaaagctgattggccactttgctcgcgcacgatgtttaagaagtcaacgaccttttggctggcaggagctgccagtaattgggcattgatccggaccatatcgtgggttaaacgtggatcaaattcaacggtggtatccgtgtaaaattggtcaagggttagtgataagctactggtttggggcagcatcaagtttggatcggctttaccccaatatttgaccagcgcgatgttggtgtgtgcccgtgcggtgaccgctgtcatgaatgtgcctcctcaaggttgaaagtttcaatccacgtttgcgtagcaccggcatctaaaagggcctgttgaacgcgttgcgtggttggtaagtccgagcatagggcaattaagcaaccgcccatgccgccaccggttaatttggcccctaaggcgccattatcggtagcaacctgcgttaagtgatcaagttcgcgtgaactaacgcctagcgcttgtaattgctgctgtgcttcggttaagatttgcccgagctgatgaatgttaggtgttgccaatgcctggcgtgcctgatatgtcaagttacccaagtggttaatttgcgtttgagtttcttgagggaaagcggtttttcgccgggccaccgctgctacggccttgccagtttgtcctttgatgccgctgtcagcaatcaccaagtagccggttaaagcaaatggaatttgcaagctttcttgatgggggatgaaccagattggtgcatttgagctggcagtagccgcgtcaataccactgggtttaccatgcgtgatagcttcttcaatggcggcactggctaacaattgttcacgatttaaaaagcggtcaaaaaaagcgtacatggctcgggtaatggctacggccgctgctgccgaagaacccatgccgcgctcagccggcagatcactggtaatcgtcatgtgaaatggcgtgttaaccgcgtcaaaacgacatagcagtgttttaatcagggtggctacgccggctaaattctgatgcatttgagcgatagggccgtcataataacgactcgtgagaagttgttcatgatccgttgccgtcatagtgacgtgggtggtgactgaagggagcgggagggcgatggcaggttgaccatacaccacactatgatccccgataagaatgattttggcattactactgccacttgccgttttccccaaggtcgatcgctcactttctttgtcgaatttatctaccagaatatcatactctactaggtagcgttgcgctagttttgcccgttaaaatcttaaaatctcgtaaaaattaacgttttctataaagtttagggcttgttagccgcagttaagcgactgaggatagatcggtcgtctggtcggcttttaccgtagcgttggcccgctaagtggtgtatcataagttccagttattatcgcaattgtgcagaaattggtgagcatattatggataaagacacggtttatgcggtggtggatattgagaccaccggaaccagtgtgacagatggcgaccgcattatccaaattgggtgcgtcttcgtccagcataatcaagtaattaatcattttgaaacggacgtgaatccccttaaagagattcccgccgcgatttcgcgactaacggggattaccaataaacgggtgcggcatgcgcccctctttgatgacgtagcgggaacgctatatagcttgttaacaaacacggtatttgttgcgcacaacgttaactttgatttgccgtttatcaatgctgagcttgaacgggtggggtatccggccttaccaattgccgcagtggatacggtttctttgagtcagatcttattgccgactgcaacgagctttcggctacgcgacctgagtcgattatttaatattgaacacgacaatccgcattcggctgatagcgatgctagtgcgacggccgaattatttatctttttatttcggcgattacgggctttaccaatggtgacactacaacgaatgatcgatttgcaagcggatttgccattgcagacgacgacactgttccgagtggctcagcagttaaatgagcagtcaccacgaaagctaccggattatctttacattaaaaatgggttggccctacggcaaccggcaccattaccggcgacaactttagctgaacctagtaaatatccgaaaaccaaaaagcaaaaacaaaagctgatgccggagaatttggaatggcggccggaacaggctaagatgatgaattacatctataataattatgctgaggcggatcggcatccggtaaaacacatgattgtagaagcgccaaccgggattgggaagagtctaggctacctattgccaatggcttatttaggacagactggtcgacccgttgtggttagtaccgcaacgaccttactacaagagcagttattgaaccaaacgatcccgctgctaaatcaaattgtcccctttactgtcaatgccgttttagttaagggcagtcggcattatcttgacttgcagcgatttgcaactaccttaaacgtcgcagagacctctaagcagacgcagttgttaaagctgcgtttactagtgtggctgacgatgacgacgactggtgatctcgatgaattacatttggcgacgtatcgggcgccttatttccaagagattgttcatgaaggtgccgttacggtggataatcctttctatgatgatgacttcatccggcggcgagaccaccgaatggcgcaggcccaagtaattattgtgaatcacgcttatttgagtgaacacgctttggcgttaggtgagcagctccaacaaccttatttagtcattgatgaggcgcagcatttaacagaaagcacgttgaaacaacggcgaactcaagttaagtttgcccagttactcaatgaattgcatcatattcagcgagacattaatcgagaaattggacccagtttactgcgtttgttcgcggcggacactcaagcaacattaacgttgcaccggctgttgtcggctagtcaaacgttagagacacaattaaccacattggtggaccatctgtttttacggtttttagccaataaacgactgaataatcataatcaagtcattgaagaactagttagtgcgcaagcgttgaccgaagaaattgatcgcagtcgcacaattgaccgcgcaacaatggctacagatgatctgttagccggactgaatgctttacggcaacgctatgatcagcaacaagcccaattcacgtcggcagaacgctatttgttcgagcaggttgatacgcgggtgcacctttttgacgatcagatgggccagttattagaaattttgcggcaggttgttgatcaggcaccagctagtctcttttggttaaccatgaaccacgttggggaccgaacgagcttacaattggctagtggcctattagctacagagggattcttaagtcagcacttgtatgcgggatttcagccggtgctcttgactggggccacgctcttttcatcaggtcgctcacaatatgtgttagatcaattcgatttacaacgtgagcaaaccgtgactcatcggatgcgttccagttttgactatggcaagcaagcacaattgctgatggcggattcaggccctaatctgagtcgagtggcgccggcagattacgtcacttacttgtcggcagcgattacccaaattgctggcgcggtgaataagcagactttgattttgtttaattcactcagtgtgattgaacaggtctatcagcagttggtgacccaaccagagtttgctcgccgagacatcttcgctcaaggtgtcagtggtagtcgtgagcggattacgaaacgatttgccaccagtcacggagcgattttattaggtgcggcgagtttttgggaaggaattgatttgccctccgagcaattggagttattgattgtgacacggttgcctttcgattcaccagatcgcgtattcgtcaaagcaaattatgcccggctggaagcggcagggaaaaatccgttttataatgcggctttaccagcggcgacgttgaagttgcgtcaaggaattgggcgcttgattcgaacgccccatgattatggtgcggtggtcatcttagatcaacggttagtcgaacgccagtatggtcaaagtatcttacgcgcactaccagcggagttaccgaaaacaactggagatattgggaccctaacacagggtttaattaatttttttgaaaaaaagccagccgattcggcgacacccccagaagtctgatataatgactgggattgaaatttgagaagtttgataagggagtacgatggaaaattgatgagacaacagtataagcgccaacgccgaccacgacactgggtgctcttaaccatcctgcttgtgattttagtagtcttgatcagtgcgggtgtcatgattaataaagcaaccaagccgttaagccaagcgcgcgttcatgcagaaaccgttgctaaagattccgggcatctgactagtacgcaagacttttattggaccaacctgaataccacgtattacaccgtttcgggtcaaaataaagctaaacaaaaggtgtacgtgatcgtgcctaaaacgggaaagaaagtcactgtcttgaaacaaacggacggaatttcacgaaatacggtcttacaacaggtttggaaacgtaatcccaagaaggttttatcagcagcgttaagcatctttaatggtaagccagcttggcaggtaagctatttgaatcagagtggcaagctttgttatctgacttaccaatatagtaatggcaaagttttacaacaaattgcgaacatttaaatcatcgtaggaggttgaccatgcgactttcacagcgagcccagcaggtggctccttccgcaacgttccaaacggcgcaacgcgcgcaagaattgcaggccgccggtattgatgtattaaacttgagtgtcggccaaccggattttacaacgccaacagcaatcaaatcagcgacgattgccgctattcaagccaatgaagttgatgggtataccgcaacggcaggcattttgccattacggcaggcaattgtcgatcggctatcgcaaacgcaacaggtgacggtaactccccaacaggtcgtcgttacaacgggagccaaaatggcgttgtatgcgctgtttcaggtgttacttgatccaggggatgcggtattactcccggcgccttactgggtcagctatagcgagcaggttaagctggcgggggggcagccgattgaagtggacccaactgctgatttgaaagtgacaccggcacaattagaagcggctgttacgccaaaaactaaggcaattgtgctaaattctcctcaaaatcccagtggtctcgtgtatacaccagccgaattgacggcgttaggtgattgggcggtggcccatcagctaatcattgtggccgatgaaatttatggggaactggtctatgatcggccaacaccggtaccatcgatgttgtcacttggtgataagattgcggcgcatacagtcatgattaatggggtgtcaaaaacctatgccatgacgggatggcgaattggatatgcggtgggccaaccagacatcatcagtgcaatgacgacggttttatcacacatgacgggcaatgccgcagcagtgagtcaagcagcggccttagcagcgttaactggcgatcaaacccctgtagcagagatgaaggcggcttttcaacaacgactagatcgaatttatcctttgttagcagcggttcccggggttaaactgaatcataaaccgcaaggggccttctatttgtttccagatgtatcggctgcgatggcaatgaagggaataaccaccacgtctgacttcgtggctgcagttcttaatgaggcgcatgtggcgttagtaactggcagtgctttcggcttgcccggacacgtcagattgagctatgcggctgatttagcaactttattgtcggcgattgagcggctaactaaatttatgacaaccccgtaatggttcattacggtatttgacgaaacggtcgattcgcagttggcgagtacggccgttttcaattggtaaaggagttaatcgaatgactgaatttatccagcattacgttcaggcaggtcaaactagcctggctaattatttactcgaccattttcgtgaggtggggatgacgacggatcagcttttagtctacctacaattacggcgatacatggatcgaggggagccgctaccagacgcgacggttatcgccagccatttaggttgggataaacaacgggtctatcagctcttgcacgaaatgattacccaaaaactaatggtgattacgaccgttacggatagtcaggggcaaaaacaagacgcctatgattttcggttgttgacggaaaagcttagccagttagcagtgaaaacgacgcaacaggtcgttaaacaaactgctagtaatgatcgttcggcaatcttcaatcagatcgaaaccgaatttggtcggccgttatcaccattggaaatggagagcatcactcagtggttagatgaagaccactatcgccccgagttgattcaattagccctgaaagaagcggtgttgagtcaagcctatagtttgaaatatatggatcgaatcttgttgagttgggagcgtaaaaacctgaaaacagcggcgcaagttcaacgtgaaaaagaacgacaagcgccacgccggacacagtcggcaacgacgccaaccacggccattcccgatgtcccaatctttaagttaacggatgattaggccgtgtttttctaatcgttagtacaacctatcagtctggagcttggcttcaggcttttttgttgttagaaggtttatcattggctttaaaaatataacatgggatactcttaaatatagttagccggctaattatattcagaaagaagacagcttatggaaaaatttacgtttgtcgatcgtcttgataatcaaagaattcaattactgaataatatttcggaaaaggattctgagataactgaactatttcttgattttcaatggggctatcggaatatgcaaaaggtctatgatgatgtcctagataagcatgggcttagtgagtcacgatttattatgttaatgtttttaagacaggcacctcataacgaattattgccatccgttatttcggaaaaactaggggccacacgagcaactgttagtaagctactaaaggcaatgacgcttaaaggatgggttgtaaagcaggcatcagataccgacaagcgctctgtgtcggtgaaacttacagagaatggggtgaaagttctacaggaatttttaccgcaaaatttccacacgattcatctgttacttggcgagttgactcatgaggaaatcgaacagttttcacatttacttgcaaagatcaaaacaggtactcagaaatgtacacaggaaatggagcaataaatcatgcagacagaaaaaattagcttactgaaaacttacttgagtttatatatcgatcattttacggtcttagagaacctaaaaaaaagaagattcgccttatgtgatattagatgttcgtaatgcgccagcacaagtcaaaaaggatcaaattaaaggtgcaatcgctatgccggcgaaggacctggctaaccatttggcggatttagataaaagcaagatttatgttgtgtatgactggaatggtggcacaatcttagggaaagcggcactcctcacgttattgtcggctggttttgaaggatatgaactggccggtgcaattgaaggttggaaaggtatgaatttaccggttgaaaccttataataatttaacttattaagcggtcggctgttgaatctgactgcttttttataggttgaattcaaaaggtaattaaagtggttggctatgaagaatggattagtgatgcaatcccttataaaagtgaagtgagcgtattaaaaaagaatcgttattctcaatcaactgagaataacgattcttttaatagttacctaacactatcggattaattaccggaactagcgttgtcattttgcgttgtatttttggctgacgatgaatccgtcgtggtattgtcatcattcccattaccactaggggtctgttcagtactggatgattccttactggtactagattcagttgtggatgagctggcccgagctgaactggagctagtcgttacctggttgttactgctgtaggccgaagaactagtcgtgttggtcgaaccatactgactcattgacgtggagtctgttgtggttgcatcagaaacggttccaggatgaccagttacgtaatattcggtgttgttgttaaccgtagtcttcgttacggtacttggctgggtccaatcggaattaacctttttggaagccaagtaggtcatttcgtacttatagatctcttgggcaatcttagtttcggtttcactgacgtaatggcccgtttggaactgcttatcgtaaccggtccaaacagaaacggcatagttcttggtgtaacctgtgaaccaggagtccattgtagcgccatctgggaccttatcagcgtaatcatctggataagagtcagtcccagtttttccggcctgatagaggccagaaattgccgctgaacggccagaaccattttcgttggtcataacgtctttcatcatgtcagtcagcataaaggcagtcgctgcggacatggcacgtttgccttgagaagagtagttatgggccttgccatcttgcgtgacgacttttgaaaccaaatatggtttgtagtaagttccaccattggcaaaggcggcataggctgcggcttcttgctcggttgaaatgtacaacccaatcccgttttgcagcgtcaaggtcttatcgaatgtcatacctaagcccttgaggaaggtcgttgccttgctaataccgacgttctgcagcgtccggatggcaggaatgttgcgggattcatacaaggctttgcgcatggtaatcgtgccttgatactgcctatcccagtcgtataggttcttggttgttcccggataggtgaaggccgtatccttaaccggctcataagtaggatagttcaggtattcaatggctggaccataatccattagtggtttagccgttgaggcactcgaccggtctgtctgaacggctcggtttagcccaaacgtaacattccctgttttccggcccccaatcatcgcaacaacttggccgttattcggattaacgatagttgacccaacttggaacttcttagaagggaagctgacataattttcagagttgacaatgttgtagagcttcttttgggcactcatgtcgaggttcgtataaacctttaggccaccagttgtggtgttgtagcccttggacttcagttcggcataaacttgcttgaggtaggcatcgataaccttagtatttttcacaccagtactggttgacttgtgcgttttgaccaatcccgaagtgatactggttgctttagcttggcttgcttgagctgaggtaatgactttagtttcaaccattgagtctaagactaaatcacgacgcttttgagccaaagcaggataagtcgtgggatcgtagcgggttggtgcctgtggcatcccggctaacaaggccaactgagccaagcttagatgtgtgagcgtggtcccgtaatagtattgcgcggccgtttgcatcccatagaccccattgcccatgtaaactttgttgatgtaatattccaagatttttgccttggagtatttatgatcaacctttaaggccaaccaggcttcttgagctttacgttttaacgttcggtccgaagcggcggttgagaagacggacagcttaaccaattgctgggttaatgtactgccaccttgcattcctaatgaggatccggtgaagtttgcaaacgcagccccgacaatccgaatggggtcaaccccattatttttatagaaacggcgatcctcagtggatacgaccgctgcggctagggttgcaggaatgtgctttgccttaacgtaagtccggttttgggcgcccattcgtgaaataacgttgccattggcatcgtatattcttgtagaagcgtcactggacagggcactctgggtgaccttaggtgcactttgggcgtaaaagaagaacaggccggctccggcaagaatggcgaagacgccaatagcgacgacgacgtacaaaatccggcgaaaggtccgccaaccggtatgtggccgtttggggccaggggtacgatcagcgttacgactcatccgggtttcccgtggtgaattgttactagacatggtaatctcctttacgtttcagcgtagtcactagactcgttagtttatgagagtaattgatctacggccttaagatagggaacgggcaattgtagctcagcgggaatttgaatcccatcttgcgcgatggttgcgtaaggaatggacttccgaccgccttgctgttgcgcgtcccaaaaagtaaacagatcttgcgcacggtacaagtaaatctcctgacgggtgacgaacttgataatagcaaaacaaattcccccctgggttgtacaagcacgcatgtggtcaatctgatgttgatgaaagttttgaagtggaaacgacgttgtattacgggtttccttagcatcaaaatctaaataatgaccccgatagacaccattataatcggtggtagaagcggtactaaagtaggcttctttaatcacggcggcactgcgtttagggtaatccacctttacaatgcgaatgggagtaggctttttatgaaccacagccacgccattgacttcgtaatacgtgttactctcattgagctcctcttctagtgtcataccgcgtttaccgtagttggtgttggtactagaaaactgggacccgatttttttggctggtgcacggtaggcatgcccattgggataccgaatagtcataaacgcttcacactccttgttttagcgggcatttgctcaccagattgtgggccagttattgacattataccaagctcactcggaaataaaaactcctaaacgcggctttactgatgaaaaaagcggattttaaacggattttaattgcccttaacgttttttttcgctacactgataaggagccgtcagaaaggggtggctaaatgagtcgcttatggttaacgggctatcggagctatgaactgggcgtctttggtagtcaggaccccaagttgttggtgattaaggatacacttaaaaaacttctaattggtaagcttgaaaatggcatggattggctgattacgggcggccagttaggggttgagcaatgggctgctgaggtgggtctggcgttaaagccggattatccagagcttaaaattgcaatgatgaccccatttgctgaattcgggagcaactggaatgagaataaccgggggacgtatgcccaactagctagccgggtggatttccaccaatcggttagtgagcagccctatcatggaccccaacagttaagaaactatcaagaatttatgctgacccatacggatgaggcagtcatggtttatgatttagaggttgaagggaaaccgaagtatgattacgaggcaatcacgcgatttgctgagcagcatgcttaccccctgacgttgattgatatggattggttacaagaaagtgccaatgaatatcaagaaaattcaaataatggttcccaatttgaataaaaactggtattatagatatcgccggtttgattacgataacgaggtgtaatgatcgatggaaaacgttaattttactccgaaggaaattttacaaaagcaattccgccaaaaaatgcgcggctatgaccctgatgatgtcgatagtttcttagacaatgtcatcaaggactatgatgcctttgtgaaggagaatcaacggcttcaagatgaaaacgaacggttgttggcaaaagttgacgagttgactcgtcaggttcaagtgggtgcaagtcaaccccgcgctgctgcaactagcccagcttcttcaaatgtaaccaacatggatattttgaagcggctttccaatttggaacggcacgttttcggttcacaattagataatgatccaaacgagtcacatcgtttgtagaattatagactggtgtagatcctgagtaatcgcggtcggcttatgtcggctgaggaaagtccatgctcgcacaggctgcgatgcctgtagtgttcgtgctcggtgaaaaaataagccgggggacgttagcaatagcgttacggcgggaaaaaacggctaaggcttcggctatgcttgagtatccctgaaaagtgccacagtgacgatacgcctagggaaacctaggcggtggaacgcggtaaacccctcgagcgggcaacccaaacttttggtaggggcgcttcacatatggaattgaacgaaatgtggggggagaggaaactctcgagatagatgattactgccagctgatcgtttgcctgaaacggttgggtggtacaaaacatggcttacagggatttacaccatgtcaggtgggtgggagcttgctcccacctttttttatagcgataattgggataaacacccatttgattagaaaatataaggaggacgtcatgaagacttttcatttatatgcagcgacagctagtgggattgaggcaattgctgggcgtgaattgcgcgagttaggctatgagacccaggttgaaaatggccgtgtccggtttgatgggacgatcaaggatattttgcgggccaatttgtggctccggacagccgatcgggtgcggatcattgtggccgagtttgatgcggtcacttttgacgaattgtttgaagccactaaggcagttgcctgggatgaattgcttcccatggatgccgcttttccggtagagggtcgttccaagaagtcacaactacacagtgtccctgatgcgcaagcaatcgttaagaaagccgttgcaacgaaactagcggccgtttatcatcgccgtacccgaatgccagaaacgggcgcactgtatccactagaagtgatgattgacaaggatcatgtcatgttgacgttagacacgacggggtctagtttattcaaacggggctaccgtgtgggtaaaggaggcgcgccgttgaaggaaaacatggccgcagcgttgatcgctttaaccagttggcataaagatatgccgttttgggaccccgtttgtggctctgggacgatcccgattgaggcagcgctaattggccgtaatttagccccaggattcaatcgagatttcacatgtgaaaagtgggactgggtaccgcaagaactcagtgatgaggtccgggatgaagcggatgcactggcagactatgacacgcccttacaaattttcggtagtgatatcgatgagaagatggtggcgattgcgaagcgaaacgcgcaagaggctggcttgtcacaggatgttactttcagtcagttggcggtccaagactttaagactgaactgaaacacggggtgattgtcgctaacccaccatatggggaacggttgagtgatcaagccagtgttcgtgaactgtacaaacaaatggggcaagtctttaagccactaactgattggtctaaatacatcttgacggctgatttggaatttgaacatttctatgggcagaaagcgaccaagacccggaagctctataacggggctttgcggacggactacttccaattctgggcacaacggcaaccgcgacacaatcggtaaggccaatgattgaagcggactgtattttttgtcaagaaacagcggtcgtgttggaaaatgacttggctaaggccttttgggacattcacccggttcgcaaaggccatttattagtagtgcccaaacagcactatgcaacgtactttgatgtaccatcggtcacacggcaggcgatggatgctttggtttttgcggctaaggatctactagatacgcgttatgctccggcggggtacaatattgggattaatagtggtgcggcggccggccagaccgtcatgcatgcccatattcatgtcattccacggtatactggagacgtgcgcgatccgcgtggcggcattcgcaagatgctaccgcacgccattcaaaaacgtatgtcataaaaattaacattcgatttaaaagggacaaaatggcgattatatcgctattttgtcccttttttgtggttgcttaatggtccaaacaacgcgaaagtgaaaatttaatgatgactttcttcaaaaatggtgttagaatttctaacatcaagggcagagagggcgttgatgatgaatttagcaaacacggcatttgttttaatcgcaagtatcctagtcttatttatgacccctggactagcatttttctatggtggcttagtttctgaaaaaaacgtcgtgaatacgatgttgtccgtttttatcatgacgggactagccattttgttatgggtagccgtgggatattcactggccttttctggtgatattggtggcgtagttggtaatttgcatcaggcgttgatgacgggcgttaatttaacgagcttgacggtcaatcatataccattgggcgcctatgccttatttcaaatgatgtttgcggttattacaccagcgttgtttgtgggagcggtcgttggccgtattcggtttaaattcttattgtggtttctaatcgcctggtctctttgtgtgtactatccaatggtccacttagtgtggagtccagatggctggttagccaaattaggtgtcttggactttgctggtggaaccgtcgtgcacattaatgctggggtgacggcgttggtcttgtcagcatggctaggaccgcggctaacgaagcctactacggcacgtcactataatttaccgtgggtgttattaggaacagccattttatggattgggtggtacggattcaatgctggtagtgcgttagcggttaacggtgtggcactgcaagcggctttgacaagtacggtcgccacggctacagccatgatcgtgtggatgctgctagacatgtggacgaccggaaagccaaccttagtgggtgtctgtacggggacgttatgtggcttggtcggcattaccccggctgctggatacgtgacgattttaggttcggtggcaattggggccctggcaacgttagccagctttgggtttgtaacctatctgaagccccgactgggggtggatgatgcgctcgatgcctttggttgtcatggcattagtggtattgtgggtagcctgttaacgggagtctttgcgacaaaagcagttaatcaaacgattgccgcgaatggcttggcttatggcggtggttggcatttactgggtatccaaacgttggcgacgatcatgacaattgtcattgtcgcagtgatgggcagtcttctgataggtctattgcggtggttaatgccaatgcgggtggatgcgcaagaagaacaactcggacttgaccaaggggagcatggggaacgggccgattacacggttggcctcagtgaacgcttaaccacagagtttcaaccggaccaagaacggtttgcgggtgaattcaaaggacaacttcaacggttgcaggggcatagtagtaaccggcatcatgaaaagaatcattaaagttagtgactttattaagcttagtcgagatgattgccgaaatcgcaaggacctgctaagctagagatgtggttaggggccacaaattttgcatatctagtttggggggaacgaagatgacaggagaaaaaattgcggtcattattttcgcagtattagcagtcgggttgctaagtctcgtactcatgttcatgaagtcggcgctgtgggcggttggttttccaattgcttttgccggcttgggattactttgctacgggattgaacatcacctggaacgcaaccgctcagacaatcacgatttgaaaacagactaaaataaaggaggccagtgagcctccttttttcgtacatttgatggggttaagcttgcatgatggtacgagaaagtaaaacaaccaattcatcagtgtgttcttgaaagcctaggttacggaaactgtcgataacggcactgagttgcccacggacagtttttaagcgtaggcatacggtatttctttggagctggcgtgttttgtagcgtgactttacaatctatagtcgaacttgctagaattaagccagctcgaaatgacaaaggggacggtagaatggcaacacgaacacagctagttgaattggtaacaatggtgatggtgacagatcccgagacacaacgtgttttggtggaagacaaggttaatgtgccttggaaagccggacatagctttccgggtggtcatgtggaagttggcgaaccctgtgcaacggccgcgattcgcgaggtttttgaagaaacgggtcttcgattatctggcgtgactttttgcggtacctgcgaatggtttgacgatgaccgccagcaccgtaagctgggcttgctgtatcgggcctcaaactttacgggaaccctaaaggctagtgcggagggtcagttaagttggctaccaatcacggccttaacacgagaaaacagtgccgctagtctaccggaattcttacaggtgtttactggcacggcatcaacgctggttagtgattcgtggaatggtaatttacgaattgacgattaaacagtgctgacaatcggtggactgcataaagatatttttatggtaagcgattacattttcaagtaaaatagaagtgtcaagtagatagataaagggagcgatcatgatgaaatcaactgttcagacgcaacgctggtacggttacttctttatcgggttaagtgtcgtcgccttaatactaacgggcttagtgaccatgccgctgattgatcgggcactgttgctgacgacagccttaacacttctggtctatggtttgacttatcaaccgcggatacgtcgtagctggtggcgactcttgctgtgggtaagcgtgggtgtaggtgtgattgatctgggattaaccattacggtagcaccagtcttactgacagcgtttctgagtttctgcttaccatttgcgtttttaagcgtcctgctgggcttcttaaaacgccggattcagacgacgtaaaagcgatattaaaaaatgcgtttgggacttaacggtcctgaacgcattttttagagtttaagcaaagagggtaaccaaaatgtcccaagtcatatgggtaacgatacctggccatagtgagtgactgcaggcgtataaccagccgaataggagacccagcgcaaaaacagagatcaggttgcctatccaactggtcaggctcattgctggtacggttgtcaggtaacgggggatgtgtaggctggcgaaagcgatagcttgcaaaacgttggccgtcgtcaaactggttttctttagtaggacgtttaaaaagtaaccacggaaaacaaattcttcagtgatcccaaccacgaggaaatagcgtccccagtattcaggaataaaaccgtgagcaatccgcaagccgtgatgtgctaaccaaaactggaataataaatagaccacgactgcgccaaagaccaggtagccagcggtgaagcgccaagccactcgccactgctgggaattagggacggtcaattgttgagcgggcgtttgatgtaagaaccaccaagcggcccccagccaaacaatgagtttgatgagatctagcaggatctcttgggaccagccggcaaaatgccgttggataggctggttgagaccaatctgaacaataaaccataataaccaaaaactaataaactgcacgactaagcgttttgcggaaacggtgtgcgttgcggtcataaataagccactcttttctaaaaagatctttaaacatattgtaaaacaaagcaacgattgtgactgtaaagtttccgtaaggattgctattttcaaatcaatgttactggtgtttacatttgatgtaatcagtgttaacattaaaatgtaattcgtggtacggacgcgtttgagggggggattaagatggttacacagccttatcatcggcaaaatttagcagccgctatccagcaggttgctcgtcaacaactagaggaagctggggccaatcaactctcattgcgccaaattgctcgagttttagcggttacccccgcggctgtttatcggcattttccagataaagccagtctattagctaacttgaaaacgactatccaagcagaagtcactgcgactctgcggatgggggtcttggactcggccgatgcaccaacgatgcttcggcaaatggtgacgaacttattaacctatcaacacgatcatccatatggaatccaatttgttttgaccggagatttatcggtaccgcagagtttaaccaccgttgtgactttgtatgtggcgcagcaacaactaacgcttgagccacagtcggctgcattggccgtgtggacctatctcgtgggtgttttggtcctattaccaaccatccccgttgatgaaaaacaggtaactaaccaattaatcagcctattgggtggataggcggttgaaagattgacggagggcagatgaaatactttactttcaaaaagtaagtgataaactgaaatagtgcattaaacttaaacataatttgcccattaccgggtattctaaaaagcgaggttttttaccatggaaacaaactttatcgatttagccaagaaacggcggagcatttacgcactgggtcgcaatgtgaagctatcaactgatgaattgacggatttaatcaaaaccaatatgaagcaagcaccaacgccgtttaataatcaaacgacacgggcggtgattttattcggcgactcacacgaaaagttgtgggacatcgtgattaatcgtttgaaacaagaagttcccgatgaagcagcttttgcgagaacagcagcgaagattaataacttcaaggcagcctttgggacaatcctgttttatacggagacgaagacggttaaagaattcgaggataacttcccactatatgcggataacttccaagattggtctgaacaagctcaaggcaacgcccagtactctgtttggacttctttagccgaaaatggcttaggggctaatctccaacattacaatccactaattgatgatgaagtccgggctgcctttaacattcctgctagctggcggttacgggctgaaatggactttggttcgattgaagcaccagccggtgataaggaatacatggctgacgatgatcgtttcttagttttcaaataactttaagcaaaaagcaaaaggactccgaatcacgccgattggcgggtacggggtcctttttgtttgggacaatgtccagtaagcaactttaccaggtaagttatgctaaaatgaaaacggtaaagctctttcttaaatgaggaggttcatgcgaacatggaaaaacaaattgctattattggtggcgggatcgtcggtgcgaccgctgcttattatttaagcaccttaccggggggtcaacaggttaaagtgaccttgtttgatgatggtctaggacaggccacgacggctgcggccggtattatttcaccttggctatctaaacggcgtaatcaacagtggtatcagctagcaaaggcgggggcagatttatatccccaactgatccatgatgcccaattagggacggatgtttatcaacaaactgggaccattgttacgagagaaattcccacggatttagagctgctatttgacttggaccaagagcgacggcaaacggcggtcacgatggggtcagtcacaacgttgacggctgctgaagttcaggccaagattcccttactggccaatgcccaaccgggagtctttattagtggtggtgctcgggtagatggtgcggccttagttgccggtctattggcacaggcaaccgctaagaatctgaccattcggcgagaacgggttcacctaacggcccagggtcaagtggtcacatcattgggtgctcggcaatttgatcgggtaatcgttgcggcaggagcttgggccaaggaactgttggcgccgttaggtattacggctgatgtgcgaccacaaaaaggccagttaattgaattggccgttaaggattatcctatccaagaaaacatgccagtattgatgccggaaggtgaacgggattttgttccgtttggtcatggtaaattaattgttggcgcgacgcatgaagatgacggcaagtttaatttacaagtggacccaacggtcaccgcggatctatttgcgagtgcccaacgactaatgccgtcattgacgacggctaatatcacggggacccgggttggtacacgggcttacaccagtgattttgcccccttcttcggaccagtccccgatcatgaagctattttggtggcttcaggcctcggctcatctggcttgacgaccggaccacaagtgggtcggttgttggcaggatcggcgttatatggtggaactccggattggagcgagtacgagaagccgttagccacttatttgaagccctccgcagaatgaagcgcctgattagccagtgtatgggcaccttgattttgtttttccggcacccattgggtcagcaccaactgaaagggtgcttgggcttgtaataaggcatcaactagggattggtagtgtttggcatagtgctttgccaagctgtcactgaccagttgactgtctgtgtagaataagacggtgacttgcgctggatcagtaaccacggctaatagacgttcgaagccgatacgagcggtttcaaattccgcttggtgattagtggtggcttgcaagggcgttttgacctgcgtttgctgatgatcatggataatgagaatgccaccagcactcagtcccgtttggggttgggtggcggcatctgtatataaggtgtacaagaagaatcactcctataattgaacgaggtgtataacccaatgataacccaagaacgacgttttttatatcaaccgaatccgatcagcagtgtcattaattggagctggaccttcatggtgctcttcatgggcgccattttctggctagaagtgacccattttaattggtataccctaggattctttattgcttttgcggtcctgtgttgggccgagattcactttagaaatatcaccatggcaaacggtgtcttgatggttagtaccgtgttgaaccaccggcacttggtcattccgttacaccaagttagcagcgttcaggtgtcccggtatcgattgggaattgtggcgcaaggaaagatttatcaatttttactgccacgaaattccgttattgaattggccggattaattcaaacagccatggcagcgaatgaacgtcaggaggaaacagtttgaaagatattgaaatttcgcaagcaacagccctagagcccatcgaaaagattgcggctaaggttggattgacagccgatcagattgaaccttatgggcacaccaaggcgaagattaatctgccattagctagtccgcgaccgcaaggcaaactggtactcgtgacctctatcaatccgaccccagctggtgaaggcaagtccactgttgtggtcggcttaggggatgcgctaaaccgggcaggtcatcaaacagtcttggcgttaagagaaccctctttaggcccggtaatgggacttaagggtggtgcgactggcggcgggtacgcccaagtggttcctatggaagacattaacctccattttactggagacatgcatgctttgacggaagcccacgatactttggcggcattaattgataatcacattcagcagggcaatgccttacgcctagatccacgccaaattgtttggaaacgggtcttagatatcaatgatcgggcgttacggcaaacggtgattggattgggtggtcggacatcgggggttccccggcaagatgggttcaacattacagttgccagtgaactaatggccgttttatgtttgagtgaggatttaagtgatttgaaacgccgcgttaatcgtatcttgattggttacaatatggataaggaacccgtcactgtcggggatttacaagttggcggtgctattaccctgttattaaaggatgccatcaaacccaacttggttcagacgttggaacataatccggcgatcattcacggtggcccctttgccaatatcgcgcacggatgtaactcagtgctcgccacgcaaacagcgctgcaactaggtgagtatacggtgacggaggccggatttggggccgatctgggcggtgaaaagtttatggacatcaagacaccagtcttagggaagacacctgacgccgtcgttattgtggcgacaattcgggcacttaagtataacggtggtgtcaaacgggccgatctagaaaccgagaatgtggcggctttacaacaaggcagtgccaacttaaagcggcacatccacagtatgcagcagtatggtgttcccgtagtggtggcgattaatcgtttcacgagtgatacggacgccgaagtggcagccttagaagctgaagtggcagccattgacgttcccgtagcgacaaccacggtatgggccgatgggggggccggggcgatggacctagctgataaggtggtcgcagcgacccaacaaccgagccattttacgcggttgtcaccagagcatgccgatctcatgacacagatgacggccatcacgcaaaaaatctatggtggtgcgcaggttgagctatcagctaaagccaaacgacaactcaagacgtttgcccaatacggttgggatcatttgcccgtctgcatggccaaaacccagtattctttgactgatgacgcgcatcagttgggggccccacaggacttcactatccacgtgcgtgaatttgcgccgcggctaggtgccgggtttgtggtcgccctgaccggaaatgttttgactatgcccgggcttcccaaacatccagcagctttggatatggatattgccccagatgggaccattagtggattgttttaaaacaattagttaaattaaaacagttgtcgtgtgtgacgaattcacagcgatgactgttttttggccttttctggaatttgtgggggcaggagtgcctaaatgccaacttttctggtatacttttcgataacgactaataggaaaggtgctccagactctatgctgattgtggatacaatcttaattattttattggtgggcgtggaccagttcattaaacacgctgtggtggccaatattgttttaggtggtgaacacccacttattccgggcgtactatcactgacgcatttgcgtaataacggtgctgcttggagtattttacaaggacaaatgtggttttttgcggttatcgccgtggtggctttgggcattatgggttacttcttttggcagtatcggcgagatcaaaaccaccgattagaagaactcggtttggctttgatgatggccggaactattggcaacttcattgaccgattgacgcagggatacgtcgttgatatgttccaactggactttatcaatttccctatctttaattttgccgacagttgtttaacggtcggggtcattttaattgcgattggcgtttatctagctgatcgacgggaggctaaatgatggaaacaacggaatttcaagtgacaacgactgaacgtttagataagttagtggcggatgcggtcgcaacggtatcgcggtcgcaggccaagcttgctattgaggccggtcagatcacggtcgatggtgcaacggtcaagccaaaggacaaacccaaggttggggcaacgattcgggtcagtctaccagatcctgaaccgttagacttaacaccagaagacatcccattagagattgtttatgaagacgctgatgtgttggtggttaataagccgcaggggatggtggtgcatcccgcgccgggtcatccgaaccatacgctggtgaatgccttgctgtatcacagtcctttatcacagattaatggtaccttgcggccggggattgtgcatcgcattgataaagatacttcgggactactgatggttgccaagaacgatcacgcgcatcagagcttgtctgcgcaactacaagctaaaacaaatctgcgtgagtatgtggccatcgtccacggtaacattaaggaagaagacggcgtaattcgggcaccacttgggcgctctcccaaggaccgtaaaaaacaagcaattgtggcggatggtcgaccggctgtgacccatttccgggttctagaacgatatggcacgtatacattaatcgcgtgtcggttggagaccggtcggactcatcagattcgggtgcatatggcgtatattaatcacccagttgctggggacccactttacggaccgaaaaaaaccctcaagggggcggggcaattcctacatgcccgtgaactaggattcaagcaaccaaccactggcgaagagttggttttcacggcaccagtacccgagaattttgcgaaagccgttcgtcacttacggcagcaagccggattaccggttgacaaagcaatctaggttttttatgctaaacatactaagatagatcaacgggtttgccgggtaatcaggcgggcgggtttcttcaccaatgttgccgaagaaacgcgcccgtttctgcacagatgctcacaccgtgaaagctcaaggaggaaataaaatggtaaaggtagttgttgacgccatggccatgcaacgggccctgacacggatcacgtacgaaattattgaacgcaataagggcgtcgatgatctggtaattttaggtattaagacccgaggcgtctacctagcgcggcgaattgctagccgcttgcaacaactggaaaatgttaccgttccggttggtgatttagacattacgccttatcgtgatgacattgatcatgatgcgcagacggaaccagaagtaacagccgccaatattgacttttcggttgaaggtaaaaaagtcattttagtagatgatgtcttatatacgggacgaacgatccgtgcggccatgagtgccattatggatctcggccggcctaagagtattaatctagcggtactggtcgatcgtggtcatcgtgagttgccaattcgggctgactttgttggcaaaaatattcccagttcccagcgcgaacgaattaaggtttcggtgagtgagatcgatgaccgcgatgctgtggaaattcaacaagcataagactggtaaaggggccgattttgcatggcaaaacgttatttaattttagaagacggctcggcctacgctggtgaaggttttggcgctggcgcgacaacgagtggagaagtcatctccaatttaaatctattaggctatcaagaaaccatcacggaccaaatctatcataatcagattattgtttttgcccagccagcgattggtaatgtgggaattaaccatgacagctatgaatcaattttaccgacggctaagggaatggtggttcgcgatgtgaccaatatttcgaccaatcggttatcacgtctatcgctcgatgagtttttacagcaacacaatattcctggcattagcggaattgatacgcgacatttaattcggaaattgcggcaattggatggaccaatgaagggcagtattgtggatgtcgccgatgcccacgcctttgaccaactcaatgcgactgtgctgactaaccggcaagtcgaccaagttgccacgccgaagccttatccgaacccggatactgggaaaaatgtcgtggtgattgattttggcctcaaacatggtattttacggcagttgtctgagcgccggtgtaatgtgacggttttaccgtggacagccagtgcccgagatgttttgaatttggacccggatggggtcttattatcgaccggaccgggttcaccactggatttaggcgatgcggtgctagagatgattcgaactgtccaagcagaaattccactgttcgctattggattaggccatgaattatttgcactagctaatggcgcagagttgaagatgttaccagttgagtatcacggcagtggtcatcccattcggcggattgtgacgaacgatattatttatgcgacgcaagggcaaggctacgcggtagtcgccaagtcaattgatcgtgaccgattaattaccacttatgtggatttgattaatggcaccgtgcagggattgcggcaccgggatttccccgctttttccgtgcaattctttgcggatggggcccccggcccgcatgaaagccgcgacttgtttgatgaatttatggaagccatgacggcacgggagggataagcttgccaagtttaaatgacatacaaaaagtgttgattattggcggcggaccaacagagatcggccatgaaacggaactagatagcgcgaccgtacaaatcatgacggaatttaaaaaacacggtgtacgtaccttaataatcgataataacccgttttctgtcgcgcttgaagagattcagccgaccaacatgtatgtccaggcggtgacgactgaaaatgttcggcacattattgaaaaggatcagccggacgccattttaccatctttaggtggtttattaggtatccagatcgcccaggaactcattgaagatggtgacattggtcgttttggggtaaccgtgttaggcatggcaccggcgaccttgcggcagattaacaatccggcggcgttgaacgcaacgcttaaggaaattcaggagcccattatcgaggcccaagtggtcagtacaactgatgaagctatggggatggttgaggccattggcttccccctaattgtgaaacccgtgtcgccgcgggtggatacgaaccgcaccatttgtgaaaatgtcgatgacatgctgacggcgttgaatcaaggattccagcaatcccggtttgatcaatgctcattggagcgaagtgtcgtgggctacaaggaagtcgaaatggttgcggtgcgggatgtagcggatacaaagattctgatttgtggtttggaaaatattgatcccattgggattcactccggggattcaattgtggtgactccgccgcagacgttaaacgatcgcgagtatcaggatctgcgggatgcgacatttcggattgccaccgagttggggattgttggggtgttacatcttcactttgccctaaatccggccaaccagcacttctatgtgacgaagattgccccttactttacacgcggggtggcactggcagcacgaacaacgggatatcccattgcattagttgtgggggcattgttgttgggccaacgcctagtagatgttaagctgcccggtggttatgttaaacagaccgcgatcatggaaccgatggtggaccatgttggggtacgaattccgttatggccgtttcaagaggtgcccgatgctgaccagcatttagacactgtgatgaaggcagtcgggtcgaccattggcttgggccgttcagtcgaagaagcgctattaaaatcagtgcggagttcccaattttctccccgtgacgttttacctagtgttagtaatctaacggatggtgagatgattcggcagctgattcatccattggctaaccggattttagttttgattgaagctctacgccgggggtattcacctgccgagctgagtgagttgaccaagattgataatttttactttgtaaagctccagcacctgttgttaattgaacaggcaatcaaggatcatccccttgatgttgatgtcttacagcgggcccggtacttcgggtttggtgatgggatgattgcgcgtatctggcaaacggataccgctaagattcggcaattgctggcggatgctcgcattgccccaacgtataagatgattgaaccgacagctggtgaatttccggaaaagactagtggtttttatagcacctttgagtatgaaaatgagagtcagtcactgggagagcggacggccttagtcttaggacggggcggtaatcaactaggccctaactcagcggcagagtattttacgactgaaatgttaaagcagttaaaacgggcgggttatcacacaattctgatgaatacgaatcccaatgcggtcgcaattgcgccagagttctcggacaagcagtatgtggaccctattcaattgggggatgtgcttaacgtgattcacgttgagcacccggatattgtgattgttcccggtaaccggcattatttaacccgtgagttgagtaagttagatatcaatctgcacgtgttacccccagatcaagaaacagaccaacctgcgccggagatggcaacgattggggtgagcctgtttgttcataatcagcataagttagcggttggggtgatggatatgattgctcccggaatgaataaggcgttatcccaggtgacggcatttcgaatgccggcggagttaccccgttcacgacgaacaaacttagttgaacaggccaaacaagcggttagtgaacgacaggtgaccgggatggttcaggttctctttgcccctaaaccggattcagatagccaccagctgaccgtggtgggtgtgcgaccaagccggctaactgaaatggcgtttcttagcaaagtaacgggtgtcaattgggtgcggatgttgacgcgacaacatattggaacgctagatgatgcggaattatcggcaatcaaagtggacattcacagtaatcgagttgcgttaatgaatgcggcctttccgttccgccagttacatgttttgaatcggcccggaaccacggatcaagaagtgggggcaaccatcgcttttggttcaagtgaggcgttaacgttgaccaaccttagtgatacggatgagttagaccgaattattaatcgaactatttagttgtagttagcaaaaagacgacctgtcagttatctgataggtcgtctttttgctagttaattttagttgttagttgcaattaatcggctagccgagcaactaaatcactttcaggtgtgacgtaaacggtcttctgaccggtgaaaatgacatatccgggcttagccccgttaggtttgtgaatccgtttaacgggtacgtagtcgacgggaacgttactggagtcacgacccttggagaagtaggccgctaattgagccgcttctaaaatggtcgcttcgctaggatctgcatcgtgaataatgacgtgcgagcccggcatatccttaacgtgtagccaaatatcggtgcgcttggcagaatgcaacgtcaattgatcattttgcaaattgtttttaccaatcgaaatcttggtaccatcactggccgtgtaacgatcgggcttgctaactttttgccgccgttgttttttgtttttcttctggtgatcgtggtcgcgtaggtagccgccttcttgtagttccagccgaatgtccacgagatccttgggtgcagccagttcaatttgggccataatgttactgaagtagtcaacgtcagcttgggtcttttcgagctgttcattaacgtagatcaccgcattcttggctttttgatagcgtttaaagtatttctgcgcattttggttaggtgataactggttagatagcgtaatttttaatggccgattgtcatcgtaaaagttgggtaacgtcacggcggtttctccgcgaacaacttgattcaggtaggtggtaaggatttcacccttgatccgataatcgtcggcgttctcagtttccgctaaagttcgttgaagctttttgagctttgtgcgattcttcttgagctcgttacgaaccacccgaattaggacgctaccttgctgttgaacacgatctcgctcagccttgtcttcgtagtagtgatcgagtagcacactgagggtcggatgtgattcggtagtcccagacgttgggtatgggaaggcagtaaagttggtcttattgttaacggtcacggtcagcgttggctgcggggcgttaaaccgttcaaagaaggcttggaaatgcttttgggcatcgccacttgcatgcagagcggttgccagtgctgcggccgtgtccttgcccagtccctggtattgatgttgtagtgtttgggccagaacttcctggttaggaaactcgcgaatagttgcggctaaatcagtgcgcggaccttggaacggatcatccaaatcttgcttaggtggcatgatatactgggccccgggtaacagtaggcgataacggttttgatcggagcctacgtgcttgatggcgtccagaattttcatcgaggcactgtctactaaaataacattactgtgtcgcgccataatttcaatgatcaataacagttcttgttggtcacctaactcgtttcgtgaagtaaagtgtaagtggaccacgcggtcattagccacttgggtaatttcttttaggatggccccttgaagatacttacgtaaaatcatggtgaagttcgtcggggtcggtgggttaatgtaaggaatttgggtactctgaatgcgggcatacgtcggattagctgataacaagatcgggtaattgtggccattcgcacgaacagttaggaccacttcgttagcatagggctgattgattttgctaacccgcccggtggcaatggtctgattgagttcgtggaccatcgcatgggtaaaagaaccatcaaaggacatacgtgaacaacacctttctaagcagaaatttatgtttaatcgattaaaaaaacaatacaaagtaaagtataccggcctagcaagcgaagtgcaaagaagaatacttattcggcaaaattaagccacgatagttagccagattggcccttgtggttagcaggcgaatcgttgtaaaatacaattaaaggagtgagggtctaatgaaatccagtcttgaagcgttaattgcgattaataaggtacaacaaaccttactccagcgaatgacgaaacgttatcagctgacagtatccgagtggcaactactcgaccacattgggggcggcgaaaatacacaggaaattctagcccaacaaacgcggcttgatacgtcaacgctgagtcgacaactgaaaggcttagtggctaaggagatggtcactaaggaagccattggtcgtgataaacggcaactgatttacaccattacagaacagggaactcagacagccgcggccattaatacggcattcgaggacttgtcagaccagatttttgagcactggtcaactgacgaacgtaacttattacagattcttttaaaccggttagataagagcttggaccggcgacgggggttgcagaattaacgaataggagtgacatattattcaacagcgattagtcattatttcattagacgcgctggggagtcgtgacttagacgaccatctagcagaattacctaatttacggcgattagtcgtcacgggcacacgggttaagcaggttcaaggaatttatcccacgttaacttacccatcgcacacgacgattatcaccgggcaatatcccaaggatcatgggatcgttaataataccaaacgccagccgcaacgccagtctccagattggtattggtatcaacgggatgttcaagtcccaaccctgtatgacttagtgcgacggcagcaccgaaaaacggcagcctttttatggccggtgacggcgggtagtaagattacgtataatctagcggaaattttccccaatcgaatttggacgaaccaagtcttggtttctttgaaggctagtagtcccgcttttttgttacgaatgaatcaaaaatatggtcacttacggcggggaattcaacaacccgagttagatgactttatcacggcttgtgcggtggatacgttaaagcataaaaagccctggttaacgttgattcacctggttgacatggatagtatgcgtcatcggtatggggtacgctctgatgaggcattagctgcattacaccgattggatcagcgcgtgggccgattaatcgatgcaacgattgaggcaggcacctttgcccaaaccaactttgctatcttgggggaccactatcaaatcaacgtggatcatatgattcacttgaatcaggcctttgccaaacggggatggttaaccccaactaccgccgggacagtgaaaaatgattggcacgtttgggctaagtcctgtgatgggagtacttatgtttacacccgcaattttgctgatctgaagacacttcggaccctgttggaacaaactcctggtgttgaacgggtgagtgaccagcagacggcccaagcgcgcggcgctgacccaacttgccgatttatggttgaggctcaggctgggtattacttcacggatgagactaatcgtgctgaggtggttgaagcagttgatcccgatagtctgggacaacccgatcggtatcatggtgttcatggttatgatcctttaaaacccgattattttacgacactagtcttaaatgggcctagtgttaaggaaaatcaaacgattgaacgagctgacttaattgatgaagcgccaacgtttgctgcgttgctgggcgttaagttccccaatgcattaccgggtcataccttactggatgcccttaagggggcgtcacatgaagctgactaaggaacagtggagctgggtcttttatgattgggccaactctggctacgggattatcgtgacgaccgcggtgttgcccatttactttaagggcattgcggcggctaacggggtcagtgcggcgaatgccactgcctactgggggtatgccaatagtctgggaacgttacttgtcgccttgctggcaccatttttaggggcgctcgccgactaccaaggttataagaagcggttgttaaccagtttttccatcttggggatggtgatgacgctggggctagctgtcttaccgacaacccaatggcagtggctactggtggtctatattatctctgtactgggttattctggcgggaatcttttttacgatagttttttgacggatgtcagtgataaccggtcaatggatcgaatttctagtatcggatatggttttggctatctagggggcgtgattgccttcatgttgttcatggttttacagttaactcatggattcggtcaattatctagtaccgccgttgcccgttggggatttgtcttagcggcgctgtggtgggtaattttcttcttaccactgccgttaaacgtccaccagcggcattcgctcagtgtgacgcaggcccccttgaaacaaagctggcatcgggtctggcaaactattcggcacttacggcagtatcaacatctggcatggtttctgattgcctatttctgctacattgatggggttgataccatctttacgatggcaacctcaatcgggctagacatcggcattgatagcacgacgttaattatggttttactggttgttcaactagtggcctttccttgttccatcttttacggctggttagctggcaaaactagcacccggaccggaattttaatggcaattatggtctatttgattatctgtgtggatgcgttacggttacaaaccacaactgacttttgggtgttagcgattctagttggtacgagtcagggcggcattcaggcattatcacggtcgtatttcggtcgaattgttcccaagaatcgggccagtgaattctttggtttttacaatattttagggaagttttcggcggtcttaggccccgtgttagtcggtgttgtcacccaattgaccggtcaatcacgaattggggcggcttcgctggcaattctgttcatcctgggattagtgatcttttggtcgattccccggcaagccatagacaatgcctagtggttcgacgcgttttatgttattctagataaacgaatgaaagacaaagtaggtgtaagaatgaagattgctgtggtcaccgatagtacttgctatttgtccgcagaagaggtcgaacggtatcacattcacgtggtacccatcccggtgatcattgatggtcgctcttacgatgaagatgttgatattacgaccagtgaattctacgatcgattacgaaattcaaaatcatttccaagtacgtcccaacccccgttgggtgaaatgattaatctctatgaccaattggctgatgagggctacgatgccgtgattagtattcacttagctagcacgatttctggctttgtgaaccaactcaagacgttagcccccacgattgataatattcgcgtgattccgtatgactctcaaattacggtgaagttaatggggtatttggcgattgaagccgctaagatggccgctgatggtgcggaacccgaagccattattgctcggatggatgatttacgttcaaccatcggagagtattttgtggtggatgatctgcaaaacttggtgcgtggcggccgattatccaatgcctcggcctttatcggtagtgttttacggattaagcccttattgacgtttgacgatgatacgcatgaaatcgttgcgtttgagaaggtgcggtcacggaagaaagcattagcccgggtggaagacctatttgttcaagcccaatcacaagttgactatccattgcgtgcgttggtgattaatgccaatgaccccgaggccggtcaaacgtgggctgacaagattgctacgcagtatcccgagattcccgtagaacagtcctattttggaccggtcattggggctcatttaggtgaaaaagcgttggctctggcgtggatgaaggactttgaacgggcataggttgtgcatgaagttgctcagtgtggtatgctattagctgtaattaaatttacggagtaggaaataaagcgtcaagtgccggtggaacgcaatgtgaacaccggacgaagggcaattggcccgcgattttatttccgcattggccgcaggaatgtggcaactcccttaggagatgtctaaattgaagacaatggcaaaaacccagctacccaagctggacacgttgagtatggtgacgatgggggtattgatggctttgcaactggtcatcagtcgcttctcagttggtaataatttcatcaaggttagttttacctttttgatcgttgctttgattgcgaaatggttcggtccctggtgggggatgctgactgctgcggtggtcgacgtgattggcacgttgatgaccgggggaccattctttatcgggttcacggtgtccgcagtgctcggatctctgatttacgccgtgttcttgtatcgacaaccagttagttggtggcgggtgattggggcgtctgtcttgattgccttgctggtgaatacattgttgaatacgctatgggtgaccatcatgtaccagaccccattttggagcttattgccagttcgagcattgaaggaactgatcgtcacaccggtacagattgtgctggtttatctgttgctaaagagtcaagtgatccagatgattcaagcccgtttgaataaataacttagtgacaccgttttggtttttaccggaacggtgtttttaaatgggtattgacagattgaggagattaaattaattactttaacttatacaaataaaataaccacctcgccacaacacaccaaaaactggcaactaagtcccacgtccagttaattagggaaggctcataacctttaactttttctatcaaacacgcagtgctgcttgcattgcctgcttaatttcgctataacgtaattataagtctagtttcagggaggataaacatgcaccagataagccaattatacgcaaaatacaaagatattttggcgtatcttatattcgggggtctgacaacggtagttaacctcgtggtcttctacgtcaccgtcacgctatgggggtggaattatcaaattgggaatgtatgggcgtggttcttatctgtgctctttgcgtatttaaccaatcgggtctgggtttttcattcccatttcaccaccattaagatgctggttaaggaagccgttgccttttttgcagcgcgcggcgttaccttaattatggatatgggtatcatgtggatcggggtctcactcttacaacaaaatgaaatgctaaccaagttggttgaccaaatcgtcgtggtattagctaactatttctttagcaagtggtttgtctttcacaaaagtaaggcagcctcgtcggttgacgactaaaagctggacaatatgtccagctctttttagttggtacgatatcaaagttcgttttcggattactcgtgcctttttagaagtagtctgatgaataccgataaggggagtttggaatccctgtaatttttatagacaccgccaagattttgggcccagccaccgtcaatgaagtaaattgccacaataaaaagcagtatcccgatagttacatatggccaattcattagccccatcttctttgtgtaaatttacagtgagtatagaccgagttggtctgactggcaaaataaaaagcgattgttccgctggtttgggaacaatcgcctgaggtcgatatgatttaagcgaccacccgagcgcgtgaacgccggctggtagataatcgataatagagggccacgatgagtccgccaatcatgattccggcggcattggcgagaacatcattgatgtcgctgctacggttaatcagccaatgttgtgataagacatattggaacgtttcaatgctactaccgactgggagacctaggccaccaaccgtcagcagtgataacttggaccagaaccattttaataggaggccaatcggcacagttagaataatattttctagaaaacctaagttaaaaacgtccagttgcgtcaggttaatgtgaccggtacctaggggcatcacgtatagggcggttccgtacacggagatcggcgtaaataagatagtggcaaggccggtgaagtagcccaagataacgagtgcaaaccagtggagcttcttacccgtcatgataatgagcaggccacttaagcaggccgttaaagcgattaatagtaaaggttcccagcgcatcgaatcacctccgaaaatgatgcaatcatatgggcgtcgtttgttaacatgtgaccatcgtaccgcggaaaggtggcgaacggggatttctcgcgatggttttaaggtttcttggttcctttagagaaaatgtaagactctggtcaaagaatcatcacatttttgggcggatttaacgtattgacgaaaaaaagaggcgcgcgctgtaagtgtctgcgtacgtctcgcttctaatttgtaaggggcttacggtggtgaagtgccgttaaacggtaatacagggccacgaccataccacccacgataacgcccagggtattggaaataacatcattaatgtcactactgcggttaatcagccaatgttgtgacaggatatactgcgttgtttcgaagaacgttcccgccagtccgccgagttcaagcaggcgccaaagtgacaatttaggccagatccatttcagcagaattcccaacggaattgtcattataatgttctcaaagaagccaagattaagcatgtccaaatgggtgagattaacttgaccagacccaggaccgataatgtaaacggctgtgcccgtaaaagcgagtggggtaaagagaatggcacccagactcgttaagtagccccaaactaaccatgtcagccagtgcttgcggtaatgagtcgctaggatgaataggccggttaacccagccaatagtaagataatgagtaaaggttcccaacgcatttcatcgcctccaactgaagtctattttagattagtcccatcctaacgcacatttggttttagtgggtgaatttgactcgtgttttagtctttctttgccactttagtcatttcgtaagtatctggtggggttaaatcagttggttttccgccaatttcgggtagaattgacttagagaaatcagtaggaaagaagcgaagccgtcaatgttaaaagatgatcaaattgtatgggcgattcaccagatggaagacgagattggaccagttggtccctcactggattcacggacaccctttcagtatctcatttcggtaattctcagcgcacaggccacagatgtttccgtcaacaaagtgacacccattttgtttgagaaatatccagacccccaagatttaatggtggcaaacgtcacggatgtggaagccattattaagagcgttggtctatttcataacaaggcccgtaatatcattaaaacggcgcggattgttcatgaagagttggccgatgttgtgcccactgatcgtaagggaattatggcgctaccgggtgccggccgaaaaacggccaatgtcgtgttgagtgatgtctttgaccgaccaacttttgcggtggatacacatgtctcggcgatttccaagcgtttacactttgtggcgcagaatgcttcaccactgcaggttgagcaaaaaattgtcggcgttttgccaccagaagagttgcatcaagcgcatcacaccatgattgaatatggccgcaagtattcgatgaagctcacaccagacaaggaagtctgccagttaattattgattgtgaccagttaaatgaggaaaacgaggcaacggtttaaagactaccagtagtaccgttaaagtaattggtattcaatcgagatatactgagagccggccttactcgttaactgttcattcagattcaattgccacatctgtgtagcgatagtcaactggtgctgattgacgtagtgctgaatgttatctaaggtatgtagaatgcttcccatatcgttcatggcagtagcaacaacgtactgcccagccggccgccgaacgataggaatagtggtgacgtcagctaagcttacggctttaataatttggaagctagctgtggggtaagcctgcgcatcactattggcgactgaggtgagaaagcctgattcatgcttatccaatagtttcagtggaccaataatttgatagaaggcttggtataatgcgctaatatcgctatccgtacagccggcagacttcggtgaacgccaaaaggccattgcgggacgttcaacaattgtgggtactagtaagtggttattttcgttgaacttgggttgttgaaatcgttctgccaaggtatcttttaacaacgttaggttatcaatttcagtttgaatgtgactgaggacagtccttaattgttcatttagttgggttgcatcgtttgtcgctaacagttctttaatcgttgcaagcggtaagtctaaatgccgtaattgtagaatgaattttagctgatacaattgatcataactgtaataccggtaaccattatcagcaatgtgagccggtttaaacacatcttcttgatcatagaagagtagcgtccggcgagttgtgcctgctaattcggcaaatttacgaatggttaacattttttcaaattcccccttgaggtgtcccttacgttacagtttatactttcttagtaatgaagtcagttattgataacgaggaggaacgatttatgaaagcagttgtgattgaccatcccggtaatacagatgtcttaaagctagttgagcgtccaattccccacgccgatgcaacccactcggtgatgaagattcatgcgtttggcgttcaccggtatgaagtcttgacacgcgaaggtgggtctccaaccgttaagttcccacgagtcatcggcgttgaggctgtcggtgagattcatgagacaacggctggctcggggttcaagcagggacaacgcgtgattacattaaatggcggatttggccgcgaatttgacggtagcgagcaggaatatgctctggttcccaacaagacgctatacacggttgattttgatggcgactgggtaacgctagcgcaatatccggaaaccttcgttaccgcctggggatcaattaaagcactccgactacagccggggcaaaccatgcttgttcgcggcgggacgagtgctgtcggcttggcgatgattaaactcgctaaggccagtggcttgaagattgtggccaccactcgcaaaccagaacgggcagacctattatctgcacagggagccgatgaggtggtccttgataaggacgggcaattgcaaacagatacgatgtatgatggcattgttgacttagtcggcacggccactgttcatgattcactcgcgcatatcaaggtcggcggcactgcttgtgtggttggtttacttgcgggggattgggtgatgaaggacttctcaccatttgaactacagaatcgctatattacggattatgattcaggctttgtcgatcagccaatgattgatgagttatttgatttaatcaagcacaatcacattgagattcccatctcaaaagtttttccactaacagaaattgccgccgctcacgattatgtgatggacaacccgcagatgggagaagttattgttactaatgactgatcaacaaaatgctcatagacaaaagtctatgggcattttgttgtcatattatgataatctggaataaaacaaagtgaacacgggtacggtatctttagcaattaatacgatgaaaggaaaatgtgcatgacgtatacatttattggtgatattcactccgccgccgacgatttagcggttcttttacaagcaccagcacttcaagatagtcgcttaatttttctgggagattatatcgatggcagcggatcacgatctggagccattgaaccggcaccgctcgatacactggctgtattggatatagttatagaccgcgttaagcagcatcaagatattgcgctgttgggaaatcatgatgacttttggcgacaaaccgctcgtggtgatgagctaagttttcagacttggcgcttaaatggcggcgccaagagttggcgtcgtttggggattcactccagtaattcacaagtcgtgaccgtggccttaaatcggtcaccactagtgaaatatacgagtttcttagcggaattaccgttgacgtggtccactgatcatctgctagcggttcacgcagggattgactgggattatccgttggatcgtcaggttcgcgatgatctgttgtggattcgagatccttattattttgacatggataagtcgtggcatcgtaattcgactggcaaagtgattgtgaccggtcatacgccagtacaagcgatgtctcacgatagctacggttgtattaagatgcaggccgacgcccaggacataccgcgttatctaattgacgcagggagtcggtcaggggccgccaatgggggaatatttgccttaaccctatcagctaccggcgcggttgtcgcgcagaactgggttattaatcagaaattatttgaaaattagtacgatttattatttctagtagtcagtagttgttattatttctagtagtcagtagttggctggtttgttatactggcaagagtgaaaagaaatcgggggagacgtatttgaagacagtacgagaaaatggaattgatggggttgggggcctcgtggcctttactagtttagccgtggtgtgttttattgtctggttagctacgggtctaacaaccagctggttaatcgccacgctattttacgtagccatggccagctgcttcttatacacgacactgattggcaaacaaaagatttgggaccaacagctgccacagctcaccttatccactgatactcgagcattggatatcgggtgtggccacggtatggtcctattcaaaattgcccaccggctacctgccggaggacatatcacgggtattgatatctggcgtcaacaagatcaaactaataactcactggctacggtgacgcagagaattcatgcagagggactggatcaggtcgccgccgttcagacggcagacatgcgcgagctaccttttgcagataaccaatttaatgcgattgtttctagtttggcgatccataacgtcaaacctaagaccggacggctgcagagcctgcgggaaatcgcgcgggtcttacaaccaggtggtcagttggtgattgcggacttgggtttctcctgtaacgcttaccgtcaggaattgacccgtctggggttccatgacattcaagttacgagtaccggcgttatcggctggtggggcggtccgtggatgccaacattggtgttacgagcgataagataatatttgagttttgattatgcctactttgtgcgataacataaaacagtttcaatttcggttaattaattcttaaccataactgaaattgaaactgtttttttgttacagaattaaattgatggcttacttggtctccagaacggtaaacatgcttcttattatattaatgggataataggtattcacaagtgaaatattaccagtttctaattgtgccaagctgtaattaacgagtacttaaatgttttcccaatatattccgagtttataattgatctatcaattccaatagtagcaaggagccaatctctgatcaaaactctcagcatatcatgacatactgatttgataaacggcgtaatatgtttatcagtattatgtgacagcgaatttcgaatattcttaatcacggatatccagccgtcaattttttttagattttcgtcatcccagtttgaggatgaaatgattttatttacaagtctttgctcaaatgagtgggtcataacgtatgtgactttttcccgataatatattttacgatttcgatgggaaccatacatttttcgatattctttttctccaatagagatatcaaagatgttttctagcacaacacattctgcttgaagacattggtctaaatcacccgattgtctaggagaaattgcattaaatatcggcattagactatcgtatctacatatccatgcgttaagtgattttatgatagttttcccccaattagtatcccgtctttgccaagtggatataaaagagtaacgatttattttaggcgagggaacatcaaaactaaataattgtacctcttgtaaaatgtcgcggtctttagtttgcccgataatacggtaattaaattcgtcattttttgataataggttaaaccaattactaacttgtgcattgcgtaatagtaggccttggacacttgcttttgcttcaaagaaatcaatcgaatttcttactaagatatcggatgttagatggtctacatgttcttgtgcattatgggtttctacatctctaactattttaaactttagatttttagaataaaacgccagttggttatcattatccttcaatgatgaaattttaatgtctatttgattggcaaacggatcgtctaagagatactttggactattgacattaccttgaagccaatttgaaaagttcgttggaaagaatctaagactatcgaaacttgttttgttggttacaaaaaagtccccaataaaggccgaaataaccgtatattttagataaaatattttttctttgtttgaataggtagtttgggattctatgactgctaatccacttaatgatactttaaccggggtcataaatttttcatcatttctggaggaactgttcaatataccggtgccaaatagtcttgttgatttgttcattgtattttctgaataggaatttgagacactcattgataaagataacccagttttatcatattcaagagtgccattctgagtcatggtagcttcgctgtctccccaaactgcagttatgacaaatgaggaaagttgggaaatttttgagttcatagtatatatctccggtattaaagtttttacatcttctccagcccatgtcgctgttcttcatcaatgatgtgcgtatacagcccggttgcactagtagaattttgtcccaactgggtggcaactaattgctcatttttggtcgctaaatagagcttagaggcaagtgtatgacggagcttatgcggcgtgattcgcaccttaaaggcgctggagtatttggctaccattttttccatggaattggcctgcatgcgcgatgcgtgcccacgatagctacttaaaaagagtgcgcggtcctgattcgttgcgtggtaggttgcctgccgctggtcaacgtaggcttgaatgtagggcagcgtccagggcgcaatagggaccgtatcccgttgaccgcccttacgaatgaccccaatggtccccgtcttaaggttcaaatggcgcaggtcagcattggcggcctctgatacccgtaaaccgctacctaataagagtgcattaatggcgaggtcacgctgcttatcgcggtgaaagtagcgcttctgggctggcgatagtttggtctcgtactgttgatcaataaaatccaaataatcatggtcagtgtggcccagcattagtttggtctttaaattagccgcgcgggttgcataggtctcgttagttcggactagggcaatcttatgcatcacgttacgattaaagtaagcctcaccgtgctcatcttccgtgtcttccgttaaatacttaaacaaggaggaaagggcatttaaagaacggttaatcgttgggtgtgttcgactaccacgggccccagttagtttggattggtttagcagggcggacttgtataattcaaccgtttctttttttattgtcgctaaaacctgaatatcaatttcgctggggtggggcgctgatgttagtccttcactgattaaccaattgaagaaccggcgaaactctgttaaatattgataaagcgtggctggggataatggaatagtggccttagcttggtaatattcttggacaaaccagggagcggtagccaattcctcatcaattaatttcaaataatgctgtttctccatagaagtggcctccaaacgtatgttctgtactcatattttactgacttactgacagttatgcaagtcccccagtcatttttaatcaagtactctctttaaaatatttgttttaatgaaagtagtattggctttattagccgatcacttttaggagattgaccatctctgttaataaataagtcccactaacagtaatgtcttagcaattttacgcttagcaacgccgatttcatagcggataatgtgccttaaaacggtcaaacttcatcaatattgacttaaaaatattgacttaaaaagttcttgtaaacgccgtcatatcaacatttagctgaatataaccggtacatctgaatttagcagtattggccaatagctattgacgttgattctaagcacacgttcagcattcaaatggactggtcatcacaacgcgtccgcacaacacgcaagcctgatggctgatttatcatgaagcaacagcgtgcaatgatttaggagatagctgagtgtggttgcgtccaggcaaccactcaggaaaagctataagcacgccaagcgatttttgctggacactgtagctgattagaagttatcagcgtctggttgttagtgcccaaaatgctggtaaatgagctaatgtcgtttaaatagaattaaaccgtctaatcaaaacgagggtagcttatatgacctagctaaataaggattattttctctactttacataatatatattatcgaaagtagagtgttaatgactttttgccggttagccgcccgataactccttaaaaaaccgccatatgactttacacaattactgtaaatcatatggcggtttcatttatttagtttagctttaatcgtgttaaaatctcacgcgttaacggcgttagttttgttggcaagtcatcaagtccaaaccagtcggttgcgctagtttcgtcatgatctggcaacgcttgtcccgttacttgcaaggcataaactgctgtgacggaatcaatttgatcaccattgggatacgtatactgcatattggcaccacttacgaccgttagtaattgtggctgaacaccatctaagccagtttcttcgcgaagctcacgtcgagccgtggttgctagatcttcatttaattctttggatccagccggtaacccccataagtgattatccgttcgttcgaccagcagcaatcgctgatcttgctggacaatggcggcagcaccggcaacgatgagtggctgctggcctaatttctggcgtaaatctaagacatatcccatcagcgtcacatcctttttagtctattttatcacgccagtgttgattgataaaatcttgacggccacccatttcctcaatctgataacggaagggattcttacgataaaaatcttgatgttcttcttccgctggatagaaaggttgggcctcttcaatggttgtgacaattggggcatcaaactggccgttagcagctaaggcggctttagaggcttcggccacccgacgttgttcaggattattaacaaagattactggacggtagctatcaccgcgatcttggaattgaccactagcatccgtgggatcggtttggtgccaataaatctccactagttgggcgtaactaatcacttttggatcaaaggtaatcttaacggcttctgtatggccggtcgtatgactagcaacttcggcataggtgggattaaccgtatgtcccccggtatacccagacacgacggattgaatccctggttgtgtatcaaacggttgcaccatacaccagaagcagccgccggcaaaaatagccgtttcaaattcactcatttaaattccccctcagccaattatctattagtccttaaacaaagcgtcaaaaccatggtaaccctgtgtttccagctctgatgctggaataaactttagtgcagcagagttaatacagtaacgtaacccgccagcttctgttggaccatcgttgaaaacatgacctaagtgtgagtgcgcatccgtactcaacacctcttggcgaatcatgccaaatgaatgatcggtattctcctgcacgttttcagcatcgattggtttggtgaaagatggccagccacacccggcgtcatatttatcagtcgagctaaatagcggctgtccgctgacaacatcgacatagatccctggctgatcaaattgatcgtacttcccagtaaaggctggctccgtcgctgccttttgggtgaccgcatattcctcagcagttaagcgttgcttcagatcttcttgactctcatgcttgttcattcaagttcctccaatcaattgtgcacaatttaaggtacttctttaagtctaaataaattcagcagaaacacaactattttgccttatcatttataaattaaattatacaatctaaaaagtcgagatttttaatcccgactaatgaatctaattttaattagatgcttgacctgcaggggtttgatagcatagcttgacaccctgaatatcaaccggttgaatgccctcactacggtttcgatagtacataacgctgtgcttatcgggattatgtgctaatcccataacgtgtcccagttcatgctccgccacggccagctgattggctcgagaatagttatattcgcgtagcagtgcagcattaagcgtggctgtagcccgttgcaaataactttgtttggctgtgtattcggtcaaaccgacatcttctcctagcgcggccgcttcatgtttagaagcgaccttcaacgttacttgtgccgcacttgccgagtctgctttttgaaaatgaaaagcccctgtctcgttccaggctttaatagcttcttgccaaattctccggtaatacggtgactgagcactgatcgtgtaagtggcatgatcggtgctaaatcgttctggaccaaaaggtgtgctgctagcggatgccgagctcccaccaagctgtgtgaccatcaacaggattgtaacgacagcgattagactaccacgataccagtttttgatcatatgaccattccctctctcgaaggaaactgacaacatctaccatcaatccgtattataaagaaagcaccaattaaagcgaacaaaagcgctccaaaccaatcaaaaattggtttggagcgcttataagaattgttattgacttttcaattaagcattgaaagcagctgtcagtggtggcaccacttgcttctttcgggaaacgacgccaggaagactagcccggttatccgtcaaagtcgtattaaaggccttttcaatcactgacttaggttcaccggcaacgatcatttctgagtcactgttgagcacgttggtggctaacgtgatgaacaaatcataaccatcagccgccatttcggcttgcatttctttttctaagccagcctgccgatccaaaacgtcagctaaatcaaccgtattgatttgaccaatccgtactgaacgaccagccatatcaaaggacttagcatcaccatcaatgagttccttgtcgctcttggcagccaggttagtaccagcttttagcatggcaatcccataactttgaacgtcttcacctgaaatttcagctaaagcccggacagcttcacggtcagcatcagtggtagttggtgattgcagcaataacgtatccgaaataatcgctgataacatcaacccagctagcttagcaggaatttcaattttagattcgtcaaacatttccgttaagattgtgctcgtgcaaccaacgggttctgcccggtagtatagaggttgatccgtctggaagtttgcgatccggtggtggtcgacaacgtggctaaccattaccttatccaaatcactaacactttgttgtgcttcgttgtgatcaactaacataaccgtatcaacttcgttagctactgtcttgataactcgaggagctggttcgtcgaagtggttcaaaacaaagttcgtttccatgttaggattgcctaaagcgactgcttcaacatcaaagcccatttgggtttggtagtaggcaaacgccttagcagcaacgatagcgtccgtatcaggattttggtgaccaaagattaatgctttactcatgtgatagaaactcctttatcaaatagttttaatttaattggttccgaagttgtttgagccgcgaaatatagtcatcggtatgcaagtaccggtcaaactgtgctaagaaaaggctaattcgcggaatttctgccttgcccttacgaaagacgaaggctaaatcaaaccgaatattaggttcaaaatgtgccgtccaggtgttcggcaagttatcttgtccaatcataaatgagttgggcagagccgttgacacctgcgtttccattgaaaaatgaagcaactgattaggcgtggtaaagttagcaaccccttgtggaaagtcagccaattggttcttgtaagcttcgtgaagcgtctgatccaggtaatagccctctggatacatcgcccatggctgctctgtggtgtccttaaacttaattcgccgtttcttagacaattgctcatcatggtgaatgaacaataaatcatcggaaatgatctttttggattcgtagggtttccaattcttgatagagtcatctggcaaatacatgatggccaaatcaattttgttattctccaaccgttcccaaatctccttacgcgtcaacatatgaaaggaaatcttcaggtcaggattgctttgatacaaaccaatggcgaagtcttcaaacaccgcgtcttcaactgaagctaatagtccaatgttgatctcaccttgggttgcacttgtcgattgctgaatctcatcagtcgcctgattgagaataccataaatttggtgcgttgcttctaacatggtataaccagcgtccgacaaccgaagcttcttgcctaccgaatagaataacggcgcaccaacggtccgctccagtttttttatttgttgcgttaatgcgggctgcgtaattcctagaatctgagcagcctgcgtatagttcatcgtttctgctaattgtaaaaagtacgttagagttttagaagaaaagatactttcttgtttcgttttcatccgcttcgttctccttatgactagtcagacatggggttaatgaggccggtctaatggttattattactctataataggctgtttacagtaaaagcgcaacgatttatcctcacaaattggtgatcggttaacccctaatctagaactaattcggctggcttaacgcgtagctgtagcggctgtccttcaacatccgtatcaataacaaatgagccattggaataccgcccgcttaagggatgatccgttggcataacatcatgtgtccgttcacggctggtcataatttccaatggcggattgccagctggaattgttatgaagtcaacaatccgatgcggatctcgtttcagttcgcgcagcacaatgaccccacgtcgcgcacgactggtgacagaaagttccttcattgctaagcgtttgaaggccccacgttgcgtaatcaacgcgatggtatcgttgtcagtaacgagggccaaattaatgacctcatcatcgtcacgcaggtccattgagcgaacccctgtggtgcgggcaccattgactgatacttcatcgactgggtagcgtagcgcgtaaccgttcttagaaacaagcaagatcccctgttccacaggttcggtcagatacttcaccgcaacgacccgggcttccgctgttttaagcttttcataaacggcggcgcgactcttataagtacgaccaggtgttaaatcagcaaaggccgtttgcttaatgtacccatcactggttgcgatcaggaaacgcccgggttctttgagcgtcttaaaggcaaaggtggcaacaatttcttcatccgcagctaaaccaatcgtctgagaaatatgttcccccgtctctttccacttcacatcactaatctcatgaactggccggtagatcaaattccccttgctggtaaacatcatcaagtgattcaaagtactaagcttttgcataaagatgggataatcgccatctttcaagccattatcagttgggtccgaagcagtatatgaccgcacaccagaccgtttgagatagccgtcgtgactgaccaagaccacgacatcttcgtcagcaaccgtcaccgtggtcttaatcttcaagtcttcaatctcattttgaatttctgtccggcgaggattgcgataatctttggctactgccttaagttcctggcgcaagacgctgtttaaggttttgggttcagccaaaatcttatgatcctgctcaatttctgcggaaagtttggcggattctgcctctaactgcgtaacatcggtgttagtcaaccgatacagttgtaaggcgacaatggcatcagcctgtttctcggaaaagtcataggcctcaaccaagttatcacgcgcatcccgccggtccttgctagcccggatggttttaataacttgatccaaaattgacaaggctttaatcaaaccaacaacaatgtgctgccgatccaaggctttttgtaagttatattcggtccgcttggtaatcacgttacgttgatgttccaagtaggcacttagaatggtctttaagcctacgtgttcaggtcgttgatgattaatcgccaccatattaaagttataggtgatctgtagctcggtatttttgaataggtagtttaagaccccttgcgcatcagcatcccgctttaactcaatcgcaatccgtagaccatcccgatcggtttcatctcgaacttcagctaacccttcaacttttttattcaagcgaatttcatcaatctttttgaccagttgcgccttgttaacttcataaggaatttcggttacggtaatttgactcttatttccccgtaacggttcgatggccgttttcgagcgaacaacaatccgcccccggccagtctcataggccttaacaatgccatctttcccttgaatgatcccgccggttggaaaatcgggtccttgaacaaaggacatcaattcttctagcgttgccttagggtgactcagcaagtagattaaggcatccacgacttcacctaaattatgcggcggaatttccgtggcatatccggcggagattcccgtggcaccgttgactaataagttaggaaaacgcgctggtaagacagttggctcgtactccgtatcatcgaagtttaagaccatctcgacagtatctttgtcgatgtctcgtagcatttccccagctagcttactcagccgagcttctgtataccgcatagctgctgcggggtcaccatccattgacccattattgccatgcatttcaacgagtggttcgcggaccttccagtcctgactcatccgggttagcgcttcataaatggaactgtcaccatgggggtgaaaattacccatgacatttccgaccgacttagctgatttacggaagcccttatcgtaggtattaccgtccttgttcatggcaaacaagattcgccgttgaacgggtttcaatccatcccgaatatccggtaacgcccgctcttgaatgattgatttggaataacgaccgaagcgatcgcccatgacttcttccaaagtaagttcttgaatcttttgtccttcactcacgagatttaactcctttcaccggttattggtctgacgtcttatcgttttctagcaaactggtatcgtcatcttccagggtaaattgtacattactttcaatccacttacggcgcggttcaaccttatcgcccatcagagttgtcactcggcgttcagctagcgctgcatcgtcaatttggacccggataagtgtgcggttgtctggatccatggtcgtttcccagagttgttcagcgtccatttcacccagacccttgaatcgctgtaagtgatacccgtgattcgcaatcttcttggtcttttcgtttagttcatcattcgtccaagcatattcaatcgtcggtttcttcccggtcttttgaatccgatacagtggcggtagcgcaatgtagattcgcccagcatcgatcatgggtcgcatgtacttgtagaagaacgtcaacaaaagaatttggatatgggcaccatcatcatccgcatcggtcatgatgataatcttatcgtaattggcgtcttcgatattaaactcagttcccacaccggcaccgatggtataaatcatggtactaatttcttcatttttcatgatgtcgggcaacttggccttttcggtgtttaggactttcccccgtaatggcaggatagcttggaactttcggttacgcccctgcttggctgaaccaccggcggaatccccctcgactaaaaagagttcattcttagcagcgttctttgattgggcaggggttagttttcccgataacaaccgttcatgtttcttatgccgtttgccattacgactttcatcacgggccttacgagccgcctcacgtgcttggcgagcctgggtcgattttttgattaacatcttgccaaagtcgccattttccatcaaatagtagcctaattgctcactaatgatgctatcaacaatcgttcgtgcttcaggcgtgcccagcttttctttggtttgcccttcaaactgtaataggtcttcgggtacccgcaacgaaatgacggcagataacccttcacggacatcggtcccttcgaggttcttgtcgcgttctttgagcaggccaactttacgggcatattcattaaaggctttggtccagccgctacgcatgccggcctcatgtgacccgccatccttggtccgcacgttgttcacgaatgataataagttttcagtgtagccatcgttgtattgcgcggccacttctacttcaatgccatctttactgccatcaaagtacatgatgtcacctaacgtgtctttatcttcgttcaggtaactaacgaattctttgattccggattcgaaatggtattcttcggttcgttcttgcccctcgcgttcatccgttagggtaatcttgacgcctttcaataagaaggcagattcacgtaaccgttccgctagggtgccgaagttataaacagttgtagtgaagatttggctatcgggtttaaagtcaatggtcgttccgttgtgagcacgcgtattacccaacttctttaaggtaccttgtggatgaccgcccttagcaaacttttcctgataacgaacgccgtcacggacaatggtcaccgttaatgaactagacaaggcgttcacgacagaagcccccaccccgtgcagcccaccggatgttttgtagccaccttggccgaactttcctccggcgtgtagcaccgttaaaataacttcgggtgttggaatccctgaggcatgcatccccactggcatcccccgaccgtgatcaacaaccgtgatgctattgtcctgatggatcgtgacattaatttccttgccataacccgccaatgcttcatcaacggcgttatcaacaatttcatagaccaagtggtgcaggccccggccgtcagttgagccgatgtacatacctggacgtttacggacagcttccaatccctccaaaacctgaatggaggaatcgtcatattttggttttgctttcgccatgcgtaaatcccctttactttacttttttagatgatactggtagtttacccctaaccgaacgtatgttcaaataaacggactaaatggctaggcagaggtattcaataacttcataatcataccacaggaaactaaaaactggctagagattccatagaatattggcgttctcgtgaaaacatgctagaatataaatcagcttagcggtaacgattacctgattggcggtcgtcatcgcagttcagagcggaggaaaacttgtgaaattgattggtttactcatcgtggcctaccttctcggagcgattcctaatggcgtctgggttggtaaagccttttttcaaacggatatccgtcaggcggggtctggaaatattggcacaacgaatacttatcgggtcttaggcccctatgcgggaaccattgtgatggtgctggacatcgctaaaggatcagtggcgacgttattgccaatagtgtttcacgttcagacggtcttgggaacggcgacacccctgttatttggactatttgcggtcttagggcacactgtttccatcttcgatcacttcaaggggggcaaagccgtcgcgacctcagcggggatgctcttggcctataaccccattatgtttgtgattgccgctggtttgtgggtcagcttaatctactggactagcatagtcagccttgctagcatgattgcctttaccttgattaccctgatctcgttagtgtttcaggattggtacttaaccggcattgcgctggtcttgactgtttttgtcttctatcgtcatcgcagtaacattcaacggattcgtcaaggaactgaatcaatggttcctttcggccggggttatcatcgccggcaagctaaataacctgaaaaaggacccattcgactggtttactgagtcggatgggtcctttttgtttaaaaataagtcacttgataggcagcttggaaatgttgttgcgctgccagatgatgaatggcgaccttggtcgtcaactcaccggtggcctggacatcatcagctaatccccaccatggttctaaacaaacaaagggagcctgtttgggataaggtgaccaaattcccaagtaaggcgccgtggttgttagtgctaccccgtggtcattagttggcgtgcttaacatgacggtcgtctcgctatcaagggtcaggacttgcgcgtcatgggcaaataacccgtgatctagtcctaatggttgggtcaggtcgagtggctcagtatgctggctgtcactataaggaccaaccagtggcacgcgctgatacgtctttttcggtgaaacggtcacttgataatccgtgaagtccgctaaggcatcccctaacggcacattgaatcccggatgtgcgccgatagaaaatggcagcgtggtggttgctggattaaagacatctgctgagaagcgtaattgatggtcaatgagttcaaatgtcaccgttaacgtgaagtctgctggaaacaaggcccgactttggtcatcagccgttaattccagtgtcacttgcgttggggtctgatcgatgaccgtaaattcacggtcacgagcgaacccgtgttgggtcatgtgataggtcctttcgcctaatcggtattgattgtcttgtagacggcccacaattggaaacaggatcggcgcatgccgtccccagtaggctttgtcagcttgccacatatattcgagttgtgtttcattatcgaccacactggttaactcggcgcccagtggattgattttaacggtcagatagtcattcttaagggtgagcatctaattcctcctgcacaattggtatagagcattcatctactatcatacgccatctacacaaaaggaccaagacaaacgtgtcttggtccttaaaaaattacagaatataccgtgataggtccttgttttggacgatatcaccgattttatcattaacatagctttcggtgatcgtgacatctccggtccccatgtctggtccctcgtataagaggtcttccaacagtttttctaagaccgtttgtaatcgacgagcaccaatgttttggttttcatggtttagctcaaaggctaattccgcaattcgttcgatggcttccatggtaaaggttaccttcacattatcggtcccaatcagcgcaatgtattgcttgatcaaagcgttgtttggttccgttaagatgcgaacaaagtcggccttgctaagatcgttgagttctacacgaattgggaagcgaccttgcaattctgcaatcagatcacttggcttagactcggcaaaagcgccagctgcgatgaagagaatgtgatccgtatcgatggtcccatacttggtcttaacctgggtaccttctacgattggtaaaatatcgcgttggaccccttcacgggagacgtcaccactattttggctactgcccttggcaatcttatcaatttcatccaggaagataatccccgtattctcggcccgcttaatcgcatcatgattgatatcagcgttgttgaccaacttttcggattcctcagccaccagaatctcacgagcttcggcaaccgttaccgttcgtttgatccgcttcttcggcatgatggaccctaacgtgtcatttaggtcgatgcccatttggcccagcatgttgttatctgtcgcattggcttgttggggatcatccatctcgatttccaccatgtggttttcgagtagtccttgattcagttgttccgtcagcgataagcgttcattacgaatctcatcggtgacttcctcttgatcatttggcgccgttggtgtttgcccgttttgcatctgggtaaacatattcatcatattggcaaaatcattgttgttcttattttcttttttcttggctggtgcgagtagcttgaccaaacgcttattggccgcttgggtcgcatcagcccgaacatttttaaattgatcttgcttttgcatgctaacggagacttcgactaggtcacggaccattgattcgacgtcacgaccgacatagccgacctccgtgaacttactagcttcaaccttcgtgaaaggtgcgtggacgatcttggccaatcgccgagcaatttcagttttcccgaccccggtcggtccaatcattaacatgttcttaggtgaaatctcttcttgcatggcgggatcaagttgcatccgccggtaacggttacgtaaggcaatggcaatcgcctttttggcttcatcttggccaatcacatattggtctaataagccgacaatttcttttggtgttttatcaattgcgtccacggtaaatcccccgttcattaaagttcttctgaaataacattttcgttggtaaagatatcaatgccaccggcaatatggatggcactttcggcaatttccttagcgctcatatccgtggcgtggtgatgaagtgccgttgctgcagctaaggcaaagttaccaccagatccaatggctaagatgtcgtcgtctggtgcaatgacttcacctgaaccggaaaccaatagcatttcatccttatccatcacaatgagtaaggcttccagcttttgcaaagcctggtcggaacgccattgcttagcgagttcaaccgctgctcgttgtaaattaccgctgtattcattgagttgggcttcaaacttttcttccaagttaaaggcatcggccacgctgccggcaaagccaacgacaacttgattgttgtagatccggcgaatcttgtgagccgtccccttcataataactttttcacccatggttacttgaccgtcgccggccatagcattgtgaccgttgtgccggacagcacagatggtcgttgcttcaaattttactggcatgatttaatccgtctcctttgatgatgtgtgttctgacgttgctcgcggaaagaattgacgataatctcgttgtaagtgttcgcgcgtcacgtgggtataaatctgggtggttgataggctactgtggcccaatagttcctgcaccgagcgtaaatcagccccgcgatttagtaaatgagtcgcaaacgtatgccgcaacatatggggatgaatatccgtcgttagcgtgctacgcttgattatttgatttaacaggtacgtcacaccggcggacgtgagttgttgtcctcggtgattgatgaacacgtaggggtgatcttgctggtactgcgccatcaatggggttcgtgcagtgtcaaaataagtttgcaacgcatcgctggcgtagtgaccaaacgggacgtaacgttccttattgcccttcccatgaatcaacatgatccggccgtcaaagtcaatctccgacagggccaagttaacgcactcactcacccggataccggtgccataaagaacttctagcaacgcggtatctcgcgtagcaagctgctcatttggattagccgcggctgcggtaaacagggccgtcatttcccgttcgtagaagaaacggggtaaatggttctgatgccgtttgagctgtacgtaggcaaagggatcatcttgtgcctgcccattactcatgagaaaactatacagtgaccgtaatgtcgatagcttacgcgcaatcgtggtgcgcgcatagtgccgatcatacaggtcgctcagataaacctcaacatccaattgatcgatggctgtccagggtttctcgccaccattatcggctaagaactggacaaactcacttaaatcttcatggtaagctttaaccgtttccgcagagtactggcgttcaccactgagatacgtcataaaagctgtaatcgcccgatccaagctaccccctcctgtctgtgttaatgctagcaaacggacttaaaaaactcaactaactcatcaaaaaccccgtacactttaataaattagagcaatcaacaacgtaaaaacacgacgaccttgaccagatatagtctggtaggttgccgtgttttgtttaatctttacttttggggtgcttcttcgtagtcgccatttggacagacaatctgactaccgccccgaatcttcttggcaacgaggtaatgaccatctttaggacagtcacgaccgactggcttgtcccaagagacaaagtcacagtccggataacgggaacagccatagaaaattcggttcttctttgactttcgttcgatcacttcacccttgtggcaaacgggacaggtaaccccgatttccttaacgattggcttcgtgttacgacaatccgggaaccgtgagcaagcgtagaatttaccatagcgacccatcttgatgaccattggtgcaccacaaatgtcacaatcaaacccggccggttcatcccgaatttggatcttttcaatcgcatcttcggcatgggccacttcagttgagaatggcttgtagaaactatcaatgactttcacccaatcttgtttgccgtcttcaatcccatctaattcgtgttccaaatcagcggtaaagtcaacgttaaccacatcagggaagtaatcgttgataatgccatcgacgatctctcctagttcggttggttcgaaccgccgaccgacaagtttgacgtagtaacgacgttggatggtatccaatgtcggggcataggtcgatggccgaccgacaccattttcttccaaggccttgattaagttggcttcggaataccgtgcaggcggctgcgtaaagtgttgggccggatcggttttcgctaatttcacctgatcgccgatttctaggtcgggcaacaggttatccttttctttgccgtccttatagatttttaagaacccttcgaacttcattttagacccgttagcccggaaagtgacgccgttttgttccaacgttacagccatggtatccataatggcattcgtcatttgactggccacaaatcgattccagatgagttgataaagccggaattggtccttggtcaaccgttcctttaggctagctggtgtccggaaaacagatgttggacgaatcgcttcatgggcatcttgcgccccttctggcaattttcctttgattggcttagtagccgcgtattcagcaccgtacttttcatgaatgaacgtggatgcctcatgcttggcgatattagagatccgtgtggagtcagtccgcatataggtaataagcccttgcgtgccttccttaccgaggttaatcccttcgtaaagctgttgagcggccatcatggtctttcgcgtccggaagtttagcttccggttagcgtcttgttgcatagaactggtggtgaatggtggttgaggggtccgtttgcgttccttacggacaacattggtaatgtcgaagttcccctttttgtcgagcttgctcaatacggcttgtaccgcatcattatccttcaagcccgtctttttaccgtttaagccgtaaaagctggcagcaaatgtgtgccgtgctttcttgaattcaccgtcaatcgtccaatattcttcggggatgaaggctttaatttctttttcccgttgaataattaaagataaggcaattgactgtacccgaccagcacttaacccctttttaacctttttccatagtaggggtgaaatggaatatcccactaggcggtccaaaattcggcgggcctgttgggcattaaccaaattcatgtcgatagagcgtggtgttttaaaggcttctttgacagcatccttggtaatttcattaaatgtcacccggtttttatccgtcacgtccaaatttaacacgtgggctaaatgccaagcaatcgattccccttcacggtccgggtcagatgcgagataaacggctttggcctttttggcttctgagcgtaggcccttgatcacatcgcccttaccccgaatggaaatgtaatggggatcgtagtcattttccgtgtcaacccccatcgaactttttggaagatcccggacgtgtcccagactcggaaccaccttataagttcggcctaaatatttttcaattgtttttgctttggccggtgactcaacaatcactaactttttttgcggtttgcgccgcgttttggttttagcttttggctttgcttttgtcggcaactcacattactccctcgtatgatagacagcggatcccattatgacgcggatcgtggtccctatcgcattatttttcctggcgaacttctcgctcgctaaatctttcactataatctcacacataatatttcaagtcatagtcgcttgtcaactaaaacttcttctattatatgttcagaattcaggattggtttcgccccggccaagattaattcattggttccgaccgaattggggttgtccaaactccccggaacggccaaaacatttcggttctcctgtaaggcaatattagccgtaattagactgcccgagtggcgagcggcttcgaccaccaaggtgctttgtgagagcccggcgataattcgattacgttctggaaagtgatggcgggcgccagccgtcccccagggatattcagatatgactaaatgatggtgggccaattccgtcatgagatcgcgattaccggccggataacaatgatcaagcccagttccaatcacggcgattgttttaccacgatgggctaatgccgcttgatgtgccagtgtatccacgccttgagctaaaccggatactagacagacctgttgtcggacgacttgcggtaataaccggcgcatggcacgtaaggcataaggactgggttgccgtgagcccacaacagccagttgcggtcccgttagccaccgaagatcacccaaatagtagaggacgacgggtggtgcgtacgtttcgcgcaattgttctggataagcagcatcgacaatggtcaaacagcccgtgtgccgctgattttcagttacgcgtttggctaattgggacgtgaagacctgttgcagtaattgggtgcgatcagcggaaatagccgcctcttgacagagacgattcagatcggccggtgttagtgccgtaattgttgggtgttccgttagccagtgccagcaagcacgccgggtctgttgaccaaccccagttagtaatggtaagcgcagaaaaaaatcacgaagtggcagttgcatatcgcaacctccttatcccttttcgggttaactccgtgattaagcctgtaaaattttttgaacgggtgaaaaggttcgacgatggatcggggtaacgccgcgatcggctaagccttgtaaatgctcagccgtgccataccccgcattttgggcaaagccatagcccggataaagttcgtcataagtggccattaaatggtctcgataaaccttcgcgacgatgctagcggctgctacactggcgctcttagcgtcccccttaatcaaccgaatttgagggacgtcaacgggaatctgcatcgcatccacaatgagctgctgaggcgcgaggcctaatcccaagacggcgcgttgcatagcgacccgagtggcttggtaaatattgatttggtcaatgagtgccggactaccgataccaatgctaaccgactgggcttgagctaaaattaagggatacaagcgttcccgttctttggcagttagctgcttggagtcattaacgagcggaatatcaaaatccggcggtaaaataaccgcactcgtcacgactggtccagctaatgggccacggccgacttcatcaataccagcaacccgttcaccacgggcccaaaacggtcgttcgtaatgcaagcgtgcctgaaaggcctgttcagcggcctcagctttcgccagtcggtgttgaatctgttttaggagtagttgggcccctttacgtgaatcggccgctaacgacgcgagacggctatcattgaggtcagcaatatcggctaagtcttgcttaagttgggccaggctgggttgtttactcatgatcatcagttgctcgtggagcacggtcaagggtaaaaccacccagttttttacgccgggcgtctaaaattagtcgttcactagcccgttcatagtcatcgcgcatcccaactttttcggtaattttcagtaacaggtcaacatcactaagttctaggtcactcgttaccaaatggtagcggtcaatcaatgcatcggcgtgatattggcgaaagaaattcaaggcaaataacgctacatcatctttggcatatagcttttccttgatggccccagtcaatgctagtttttgcgccgtttcttggtccttgaacttgggccataggatgccgggggtgtccaaaagctctaggtgcttgctggaacgtagccactgttggcccttagtcactcctggtgtgtcgcccacctgagcggccttacgctgaactaaatggttcagcagtgtggactttcccacgttgggaaccccaacggtcatggcccgcattggtcgttctttcagccctttagccttttcggctgcgagcttgtcggcgagaatactggccgcaattttggtaatttgcttgggcgtcacgttggcccgcgaatcgatcgcaatagcgggctggtgctgctcacggtaatacgccaaccaagccgcggtctgttgcggatcggccaaatctttcttggttaagataatgagatgtggcttgtttttggcaattcgcgtcacttccggattacgggaagcagcgggaatccgtgcgtcgactagttcaaacacgatgtcgacaaggtgaatattttcctccatttggcggatggccttggccatatgcccggggaaccattgaatggtactcataatttgtactcctttgttatatcaaggtattaggcctttttcttatttatgaatatttgttcgcaacgcggtagcctgtttagcgtggttatcgcttgaatacttttgaagtggtaatgtactgacgttagaaagacgttgagccaatcaggtaatcgctgaaaaagattgggtgtgggtcatcgcatttcattttaccattttcttggctactttagatatacctgttgttccctaagctcaaattgattacttagcaggcaactctataccagctaatgacttagcacctccgttatcttttgcaaatctgagcgaccgggaaactcgttgatataccggctcaactttaacggatcacagagttcactttggaagtaattccgcacaacttgattacgatcatatttagcaatcgttttgaagcgaaaagcgtctatcaatgaccgctctgggtcataaatgttcaatgaaccactatcctcctctgtccggttagaccgattgggtaatagcgttcgtcaacgtggtgaattgaaacgatatgtcgttcaaattcggttgggattcggtagcctcggggcactgttaagtctaaataggtgaactggcggtcgataaggtgccaccagcttaaagccgtttgcccagaaattactgctttggggtaacgtaattggattgctaaaaaatcatcatctgagtagatctcattactccacaactggacaccagcgcgcccggtaccgaagcgcgcaacctcacccgccgcaactaacttgttcaagtagtattttgacagaccgaccgtttttgcctcactagtcgtaaagatagcatttaattgaaagagctttggcgtcaatgaatctacatccacttttatcacctcgtactatattgttttaagattatagcactaatcatcaaaaaatatttgccattgcgcagtgagagggtgctactctaacggccgattaatttcaattatggaaaccacttgttgacgatcataaatagattaacgtctgttttggttatcacgtaacgaacccacgcctttcaccaattaaaaattgcccctgttgccaataaacttataataaccgtaatttagtaatctctaagaaggtgacaagtgatgaaacgattgggtcaaatactaagtgcatcgtcattccacgatacttttgtcattccaattgccagatatacttcagtttatgtgaaatcgttaccactttttatcgtacttacgctattaactggccggtacgccaatggttcctatatctttagttggaccctagcctcagggtatctcattatctgctctttgcccctgaacagataataacggcgaaattaaaaacgcgcggactgactaggcagtcaaccacttttaccatgccaacttcagcatccccacgagctaaagtttatgctgccggattacccctgatgccgctcaaagattacacccagaatcagacccgactgcttcccggactctttatttttgtggtggcgtttatctttgggccagagattttattagtattattactgctaagctattatttgaggagaggtatccaatgaaaaagttactaatcgctttatcaactgggttattcgttattcttctaactcctaatatgctggtatctgccgatatgattcaatctaattaatcaacctactaattctgtcattgtacaccactacagtagaaactttcagccacaattatcccattacctccttgaatcatccggacccgagaacctattttattatggtgagaactgggatgttccttggaattgaatgaaaattagatactagtactagataagccaaaaaacgattaccatgatgtggtaatcgttttttcgtgacattattaatttgggcttcttcaagcgcgatgcgaatagaaattcaaaatagggacattcttacgaattaaatagtcacccaacttggtctccaaaagagaaattttttgacggtctgtcgcaccgtcagttgccttatcaaggttaacgggaataatccatgcccactttaaataagttcgtagatactcgttgatttcagcgtctgtctgatcgctgggataatgccatacaaccatagatgccgccccacttggccgttttagttgcttgaataagtcatcactgttagacgtggattctttccccttatgtaacacctttttaaaagaagtctgacccaccgtaacgaccataccatcttgacgctgggtaacccataaatatttgtacgtgtctcggtcgccaacggcttggataatttgttggtgaacaccgtcgatgaacctattcgttgaattttctccgtagccactttgatccagtcccgagtatttatgcaggtccactggaatgggttctcccactaaatgctgatcggcggcttccgaccattgactaagaagacattgcacctgctctttagacgtcgccagagatttttggctttctcggtattttttatcttgaagtcccgccatttcctcacgaatttccaaagcgggtcgtcttcgatcagccagctctttgagtcgttgctgctcacgctcatccatcttgattacctccagcgattattaatatacttatttaagtataaggcttaccaactctcacacaaaataaaaagccctcaaccgaggactttcacactaagccaacgctgccaaatacaattgccaagcatcatcgaagatagtcattgatggcaaataaggcgcgttttcttctaaatatttggagagtggttcgaactgtgtttcttgtttaggaaatgcgctgtccagaaaggcgttgttggcaaaactggccacaggttcatagctctctgggttacgttgcgtcattaaaaattcataaaatgttttgggcatatgtccctccttaattcttaggaatccgtgcttggaagacgaagttcccgtcccctgacaagtcaatctttttagcagcaaaggataactttttaccattaccaatcgccgttagatgtaaggtcatggttttatctgccgtgttcatggctacccagttgggcaatggataattcttagcaatataattcattacaaaactaattggcacgggaagtgaaccaatcgataacttctgcgcttttaattgcacatcgccagacggtaggaccgtgggcttaaagagcaagacgaagttcacacttgcacctagaacttgagtggaccccgtcaacattgcttgatctgagacctggaagcgatatttcatggtcgaatttttaagcgacttatttacatagtagtcggccaaagcgttgacctgtttcttattaagtgctacgtcaatattcgtggttcctgtggcgacctttgccgttgaggtcaccttagtgggtgtaaatgctttaacactcaccgtgaccgtggtgaccaataacacagctactagcgcaatgaacccccatttccaccaattagtctgcttaacgggcgtggtttgtcgttccatataactgcctccttatttcattagccattgttgatgagcctgcatttgcttaaagacataacgcgtcatgagtcgatagcctttggcattcggatggaaatggtcagccgatgaaaggtaatcgtttagctcatccgtactactgctagctaaaatcatggtttggaaattctgtgtggatagctttccatcgttattctttttagccgtttgtttcaatttagtttgttgggccgccgttttaaattggccgactgacaacgcccggttaatatcgaccatgtacaactggctgaattgcccagcagtttgcttggtggccacattccaatggttaacggcgttggtaatctgtgccagattggcaaagtacacgtagattggattataaatggtgtacaagtatatcggcgcacttggattatagtggcgaacggtggttaacaaacgtttcaatttcttttgataaaccgtttgggcggatcccagctgatgggttaactttgcctgctgattaatcgtgacatttttagtcaaagtttgtagcagatcattaccgccgaccgtcatcacaattgcctgggccttttttacttgacgctgttgggttcgactattgaccaaccgggtttcaatctggtcactacggtcacccgccttgccaaagttatgcatcaccactttaacatgatcttgttgatgaatcatcgtttttaatcgaccagtatagccgccttgcttttgcgtatcaccaatcccctcagtcaaggaatcacctagggcaactacgcgaacaattgagcgccgattctggatttggcttggcgactgggtagttcgggctccaggatgccaataagtcaatgcagcgagcaccactaacgccaagagtaaggtgacacccaccaccttactcaagtttttaaatttcatttaaaatccccctcaggataaagaaaaagcggtggaccagccaccccttttcggtcaatgcgttcctattttgtcggatcggtgtagtacattaacgcaaaggcacctgggccaccatgcgtggcaataattggcaccgtttctctgactaagacatccttacccggaacaacctcacttaagtgttgtttgatcttatccacggactcaaaggcctcaacgtgagagattccaatcgccatgatgtctggcgtctgctttaactgctcgtagaccttgtcaaagtaccggtcaatggtcttcattccccggcccttagcgcgaatcttcagttcgccaccagtgacttccaaaacaatcttgatattcaacagtgaggtaagcatcccagcagcccggcttaaacgcccgcccttcaggatgttctctaacgttaccacacccatgaagagtttggtatggtcccgtacggctgccgctcgagccaagatcgccgccttgtcagcaccttcggctgccaatttagctgcttccacgacttggaaagccaacgcctgatcggtcgtttgactatcgaccacggtaacatcggtcttagataattgcgcggcctgctctgccgtatgaaccgtaccactaatggctgccagcatattaaagcaaatcacactactgccatctgcgcccaacttgtcgaaggtttcgacaaacgatcctaatggtggctgactcgtcttcggtaacgttttcgccgttttcattttttcaataaattctttattcgtaattgattctcgttcaacgtaaattgtgtcatcaatcattaccgttaacgggataattgtgatgtcatagtctgcaatctgttgatcggttaagccagcagaagagtctgtaacgattttgattttagccatggggatcccacactttctgaccagaaattttggtttatgctacaatatgcgtaatggaacatacggtaatagtatagcagagttatggataattttcagtagttgttactaactcaccggtaacggttagtcaaagactattaccgacaacttaagggagggtttcatttgacaaacggacacagccgcgcatatcaaatcattaacgaggtgcttaacgccgcgacccatggaatcggtgcgggattaagtatcgcaggcctcgtcattctactacttcaagctcacgccaagggtggcacattacgaatgaccacctttgccatctatggtgctatcttagtccttttttacctcgcctcaacactattccatagtttgtactttacccgggcgagccacgtctttcaaatatttgatcattgtgccatttatttattgattgctgggacttatacgccctacagtttactagtcgttggtggcgcactgggttggaccatgtttggcattatctgggggatggctatttgtggcattatttataaggccatctggctaggtaaataccaaacgctatcgactgtcatttacgttgtcatgggctggatgtgtttattgggaattaagcccctctaccatggactaggcccgatcgggtttaccttactattcttcggtggcgtgtctttcaccgtgggtgcggtactatatagctttaagggaatcccattcggccacgttatctggcacctgtttgtcatgttagggaccggattgatgtacttctcaatcctgttatacgcttaatcttagggtcaaatggtccacctcagtcgcaatcgtaactgaggtggaccattttttcgcctgtcaaggccccgccagagacacgctttcagtggaccaataagttataaaaaaacgcgatcggcgtcgtcaaagctcaccaatcacgttcgtttttactacctggttaaatataattctgttttaaaagcccaaattataaatgaacatctcaacgacggtacttccggagcggaactagcaagaaaccatcaattacccaagcgataagttaatcggtggcttcaacagtatcgtttgaacggcattgaaacacttaagcggcacaaaactaagcgtaagttctcggcagaattcaaatggaatgtgataaactactaccaaactcatgatgagtctttagccgaagttgccggaaaatacaatgttttagcctgtcaaatctgtacttggcgaaaaacgtttattcgagacggctactctggtttaggaccccatcccaaaggtaggccaactaaaatgaaacgttctaaaaaacagattcgtcaattagaaaaacaaagtgaacttgagcgtttacgaaacgaactcgccaaaaagaatcaagaactctatgccacaaaattggagaatgatatcttaaaaaaatcaatgaccctgttcggaccttcaaaggacgtcaaaaaaccgaaatagtggatcagatcagggcggatcaagtcaagctacctaagaaccaacgttataaaattggcgacatacttagtgccattggtcttaagaaagccacgtatcatgatgaacgtaaacgaatcaaaaatcatactgataaatatgccgacatcaaaataaaagtcaaaaagatcactgaagatggtaagtgccgcggtcggttaacctacggttaccggcgggttcaagatgaactaattaagcttgatgtccatatcgcagatgcggttgtccgccgactaatggctgaattgggcgtacaagtgagtctttataatcggcacaagaacggtaagtattcctcctataagggtaccattggtaaagtcgctgaaaacctcttggaacaaaactttaaccaagccaagccttatacggtactccatacagatgttacgcaaattcgcttagggaaccacaaatgggcttatatctcagcgatcaccgacgaggccagtaaggaaatcctagcgtttcaaattagcaacagtcccaatcgtattctaataactaagaccgttgatgagctgatcagtaagttaccaagtaatgtccaacccatcattcattccgatcaaggatggcattaccaattagattactacatgaaaaaattatccgaacatgaattcattcaaagtatgtcccgtaagggaaactgtcatgataatgctccaattgaaagcttttttcacctttataagaccgaatgcctgactggattcccaccctgtaaagatttagccgaactaaaagcagtttccttagaatatgttaattggttcaattaccaacgaatctcatcaaaaacaaaaggtatgtccccgtgtgaatatcgagaacataccttagcagcgtaataaatatttacttttgtctaacttttatgttgcacttcacatttgccttttagtacgggactttccgttagcttaataaagctattacggatacttttaaatctgctttcggtcagcaagttaagcagagaactgcgggactccctctttttgattcgtggtatagtgaagggtatcagtgtagttaagaaaggggttatgagtagtggcaactcagttaccagcagaaattaaagtgcgtggcgcacgggtgaataatttaaaaaatatggacgtcgacgtcccactcaatgagttcgtggcgattaccggacgcagcggctctggaaaatcatcattggcgatgggcgtcttatatgcggaaggagcgcgccgctaccttaacgcattatcaaccttcacccggcggcggatcaatcaaatggggaaggcagctgtggattcagtcgaatatttaccatcagccttagcgttacggcaacgcccacaagttccaggagtccggtccacagtcggcacgatgtccgaaagtttaaatattctgcgactcgttttttctcggttgggatcgccagtttgtcctaacgggcatcaagtgccaccaaccctagatgccgctgagaatgatggctacgtagtctgtccaacttgtggcgttcgtttccgtgcaccaggagcagaggattttgcttttaattcagatggggcttgtccaacctgtggtggtttgggagaagttcgccagttagatgccagtttgttaatcgctgatgacacgctaaccttacggcagggggctgtggcatcttggcatttacctggccgaaatttcatgccaacggtggcggatgcgattggaattccaatcgatgtgccgtatcgggaattgagtgcggcggacaaacagcgcgttttacatggtgccaagcaaaccgttgccgtgaatattcccagtagcaaaggcaaaatttttcacatggataatgctgtttatgaaaatgcctttgcagcggttgaagatagtctagcgacaactaaaaatgaacgaacaatagcgaagcttaacaaattttatacgtttgacacttgtccgacctgtcaaggcacacgtctcaatccggaacgattaaaacagcagctcaatgggcgtaatctggcagaagtgtgtgacttgccaattaaccagttacgtacttttgccaacacggtggtggcgtggttacctcctaccatgcaatcgatggggacggagttgattgacgagttgctagctagtctacagcccctcgttgatttggggttagattacttgacgttaagtcgaccaggagccacgttgtcaacgggtgaacttcagcgtattcaactgggcagaacgttgcgaagcgcaacgacgggagttctgtacgtcctggatgaaccgtctgttggactacatccggctaacgtgacggggcttattaaggccttccatgagttggttgctcagggaaattcagtggtggtcgtggatcatgacacccggatcattagtgcggcagatcatgtcattgaaattggtccccaagcaggtaagttgggcggtacagttgtggatcaaggaacggttgctgagatcaaaagcagtgcgcaatcgttaattgcaccatttttaacgggacgagcacagttacgggaacgccctacgctgagttcaactgacttatgggccaaggggcggctggctattgaggtagcggaccgatttaatatcaacgatgtgtcagtggcctttcctaagaaccggttgaccacggtgacggggatgagtggtgctggaaaaacaacgttagtcctagacagtttgattccagcaattgaggctgaggttgcgcatcacccgttgccaacccatgttcgccagcttgaacgggggaagattcgccatatcgtgacggttgactcagttcccgtgggtaagaatgtgcgctcaacggtggcaacctatacagatatgctagatcatttacgcaaattatttgcggcaacgccggcggcccaagcacatggatatacgaatagccggttttcatacaatgttaaagcaggggcctgtccactgtgtaatggaaccggtcaaatctcattagatgtgcagtacttaccggatattaccgaagtttgtccgcaatgccaagggcagcggtacaatcgtgagaccctagcggtgaagtggcaaggatatagtattgccgatattttagccttgtccgtggatgaagccttgccaatttttgcgacagaaaaggcgatcagccagaccttgcaggcgctccacgatatggggctgggctatctattattaggagaaagcacccccgctttatcgggaggcgaagctcagcgattaaaattggtatcacgaattggtaaacgacaaaacggcactttgtttatttttgatgagccgacggtgggtctacatcccttagatatccaacaactggtaaaggtcttcgatcaactcatttcacagggagccaccgtgattgccattgaacacgatcttgacttgattgccaatgctgattatgtgattgatatggggcccggcggcggaattaatggcggccaggtagtggctgtgggaacgcctagccaaattagtgcgaatccagctagtgttacgggacgctatttaaaagaagaattacatctgtttgcgcagcaggtataggagatttaggtaactaatagtataaatgagagggagtgcttggtgtaagccattgagagcattccctttttgaattcaggtaagggtaatgctgataaaccggagattattgaggaaaatattctcagacttgaagttcgctgcaaatgagatagtatataatgcaagtggggggatgcgtgtgagttatagtagaccattctatcgtgtggtcgcatttgttcttggtctgatgttgttagtgatccctttgacagcacaatattctaatttcgcgatccccgctattatcttggggctagtatatgtatattatatgtgggtggtttcgttgttgcataagcgagccagggtatttattagactctttatccatttgatctataccacaattgcggttagaacgatgtacgttgcttgtgatcatatttttatgatgcataatctcattagctggattgacatgctatttgcattggttgcttttggtatttttgggattaagacgattataatttttgtcaataattatgatgatattattagtctgctgcattagactagctgttaaaaatgaattacttcttaaggatgaacgaaattgattggagtcagtttcgctcattttttacataaaaatttgcttgagcccgcttaattgtcaaaacaccgaaaatgttcgttatttcaacgatttttagttgtataatggtgttaattatagggggtgctgatatgggtaaagaagcaaatgaactagccaaatcggttgtaagtgcggtcttgagtgagctacgtcggtacaaaaagaaagatcccaataaggcatttatgttattagacttagcgggaaacatggttacagagattagaagttgtgggccgttaattgcgtgtgagttgttaaaaaacgatggagtagagtatatgaaattatatagtcctagtaccgttaattttgagattcgagaagtaaagaacaattagtctgacttatatcgagatgtaataccaatacgatctaccagactaatgctaattttagatggttgttatattagctctgcttactttaagcggggctttttgacgtctttctcacatctaaataagttagtggagattcatggctagatgttgattttaaaataaaaaagttctagtgactatagatagcatctggttaaaatttatcgagaaatgcgtttaacaatgaaataattcgtttatgaaatatattaaggcaacagattatgtgaaatgtgtaactctcagtaactatattagtcaatcccaaatagcctttgggaacccaatgaaagttaaaataccgtccaatatcatttaaactgctacagtattgtgttaaaatgtttttatagtattaagtattgtaagtgctaatgtaagcggcatatatatatcaatgctattataaaacggactaactggtagactattaaagccattaataaatgattggaattgggttcaatcatttctaataagacacaataatttttagggaggagaccaatttgaagctatcgacatcgcgattggtaattttactactaagttgtctgattttcggctttggcattatgaaggggcagacggcagaagctagtattacgacatctggtagtacgtatacggtaacctcgggagatgacttgtttaacttgttgacgaataacaagaattactggtcatcccaaaatgttccgccgacggatctgacaatcaaggtggctaataccattacgttaccggggtatgacgcgagtttatatagtgggctgaccaatgttaaggttgattttcaacaacaccagttctatgcaggaaattacgtggcgtcgcgagttctaattccaagaacgagttcggctcaattaaccgtggccaacgtcaacaacacgagtaatgccactactaaccaggttactggagtgccaaactcagctggaacggggacagcgacagcttatctcagtacctactacggtatgttgttttcatcagattttgggctgtcgggtggcacgacctcctgcgcggcacaagtcacgtacgataatgttgtatataatatgcccaataatttgacctacaatcaaccattgtgcacctactttgtaccaatcaatttcactggaaaaaataaaattatcactgccgtctcgggacaacaagttggtgaaatcgcaaatttaaaggtcagttcgggaaccactgaaattattggtggcgatggaagcagtggcttagctggtgggatgttttatccctactacaataacttgaatcaggctgactttccgattgatgtggcaaagggagcaaccttgacgttaaccaataaagatgccagggcccccatgtttgcatttattggtatagccaattcagtaacaattaataatcaaggaaccttgaatttaaacgcgacgagtgcacagacaacgttatttggttcgggaacgaaaggggtaaccttaaatgcttccgcacaggccaataccaatattaatacagccggcgcagcatttagtaatgacatggggacaacgaagttcattggtaattttgccgaccaatcgcgtacagtgctttcgtccgcgacctctgtttttaaaaattcaagtgcttggaaaaacaatagttccttgaatgttacgactggtgctaagatcgcggcttatagtggtggtacccaaacaggtgggttaaccgactccagcagccactatattccggtgacgtttaatggggggagcatggctcaaggctttttaaagccaagtgctcccagtacgacggacgattataccggactagaaccggccgactcgaagtttaatgcggctggtagtaccgtaaactctaatgacttaaccaatgccaataataaggggttgcttatttcagcggaactattggggactgaccttggtgcagtcgatcagtacaagtgggattacaatattgcggacctaagtgagcagcctacgttactaccgcgaacgaccggaaacgatctttattttagagtgattgatacacggtccgcgacgccgtctttttcggtgatggcaagttatacgccagccgaaacacagccgtttaccatgtggtttaaaaatgatcagtcggcggttcagctatcgccaaccgatcaaactgtgcttagtgctgaccagatgacggcagataacggggtttatacaaaaacttttgatgagaacaccggtttgctgcttaaggctagcatcgctgcgcgggccggatcgtatacggggaaagtagtttggaccctggtagatggtgttcactagggaatgtgttgagtaggcgttggtgataattgatcaacgccttttttgcgggtttaaaatttaattcatgagggcaacgacaaaaaagacccgcgatctgtttaccaatcgcgggtctttaaaggagctaagattcaaatgtgacaattacagttttttagaaacggtataccgtttcgtcgttgacggctcagtagaatttgtgagctgttgctccgctaaaaagatatcaaaggacggttcaccatgctcgtttttaacaactaaaacatggccggaattatcgtgccgttcttgatagatttgcgccgtttgcacggcttcgtgataatcatggaaattaccaattgagtcaccaggattgaaaagtactacttcatccattgtcatcattcctttcagggctagctgctgatttcattatagcgcattcacttgaaaaacaacaccaatttacaaatcagcatccatggtaaaagataatttagagaggtcaccgttggcctgaatcagcttaccaatttgaacttgaatctgggcaaatgcagctgtggcagtttcttgattgaaatgacctagctcagcggcggtgggggtagtttgcgtgtcacctgtgcttaaccgttgaaaaccggcaatttgggtttcctttagaaaattgtctagtagcttacggttttgatgatagtgtgcttcgcttaaaacatcgagtaatttacctgcccaataaggattttgattgtcataggcagcgttgtttgcggcatagctaggggctaactgatcaccagcggcatagaatgggacatacggactgaatgccggattgcccaagcattgccaaatcacaccagctaaggttggtgcgacgttacgtcgcagttgcagaatgtgtgagttctgggttcgtgatagaccaattgcccgaaattggtgacgttcagtttcactaccagttcccagtggatcataaggggtttcttgatagtgtgatccaaggaaggcttcaacttcggggatgctaattttttgttccgcctgccgaataaaggggagttccatactggttggctcttcaaaggcactgggagtgaagcaacgatgaccgtaccacacccggggcgtattatagtgtgcatcatcggccgttttggttccgaaaatatgccgggagttaaagcgaccgccaccgggatttagccggtgatgttgaacaaattggcgaataccagcggaagttaggaaatcttgtgggcgatcaaagtcaatatcctcaattgctaattgattggcgacaacagcgtatgcatcgtctggaattcgctgggccacccagtgatgaccgctaacgatttccatgtaccagacttcttcggtgtcactgaagagcacaccgtttgtttccgcagctccctgctcactaactagctgacctagtcgcttaacgccagcttgagcggagtcaatgtaaggcagcacaacagttagcatggcatcttcagcaataccattgctgactaaggggtctacgccaagaacacgactgttcgtgtaggcgctttcggtggcactcatagcaacatttttttcgttaatgccgctttcttcatagtaaccttcactgggatcggtgtcgggaacagcggtgtactgataagtggtttgaggaagccgagtggtgaactgatttcctcgtgatacaaaaggttgttcaggagactcaccagcggggtggacaattgcacgtttaggccagatagcaacgaagttatcttcattacgggcaatgatggtgctgccatctaaggttgccattttccctgccaaaaacgaggtacaagcttggtgtgtatgtcgagacattcaaggttcctccctttcagaaatgagactgtgatttattacgaatactatagcacatttcgctagtttaagacgtctctcaccgcttcttcatcagaatttgctaagatggatgtatcagaaaaaggagatgtcgttatggcacacacccaacatcagcattcattgacgcgagaactggcgtgcattaatcaagtaccgatttttcagcacttatcagatgagcagaaggtgtcggttgctcaggtgactcgccccgttcatgcggccaagggtgagacagtgtttgcgatgggggaggtttcccagacgctgtacattgttaacacgggccaggtacggttatatcatttagctgccgatgggcatgaacaggttctgcgagtgttgaatccaggggactttgtgggcgaaacggcgttgttcacagatgaaattcacgcaagctttgctgcggcaacgcagacgggtgaactatgtacgatctcacgggcggcactgactgcactcgtgaagacgttgccccccgtggcattagcgttgttgcaggcgttggctgaccggttaaaaacagcggaacgtcaagcaaccctgttagccatcccagatgcgttaccccggttagctggctacttacaagccatcagtgggcgacaagcaatcacgctaacgttaccgatgagtaaacaagatttggctgcttatttgggaatgacaccggagtcgttaagtcggaaattacggcaattggctaaggctggtattatcgaaaccgtcggccgacgtcagattgggattattgcgcctgaaaagttggcggaattggcgccagaatagcgttgagcttgtggttcttttaagaatccttaataatatggtattcccgaaataaatttgctaaaatgatgggtgttgtgtttcattgaaataaatgaacgactaattaggcttaagactaaaatgaaaaaggggatacgcacatgtgtggattcgttggctatgtgaatcaaaaggatgttccgtctaccacgattaatgcgatggcagatcggatcaagcatcgggggcccgatgatgaagctttctttgaagatgatcaggcggttatggggttccgacgcttatcaatcattgatttagctcatggtaagcaacccatgtacaaccgagatcagacgaaagttttgacctttaatggcgaaatttataactatcaagaaattcgagaagaattaaaacaactcggttacgaattccaaacggacgtggactcagaagtcttgattcacggttacgatgcttggggtcctaagctgttggatcgcttacgtgggatgtatgcctttgtgatttacgataagacgaccaatgaagtatttggcgcacgtgatcattttggaatcaaacctctatactattatgatgatggggacactttcctgtgggcctctgaaatcaaagctttcttggaacatccaaatttcaagaaggaatttaatgaagccttactcccaattcatctgagttttgaattcattccttctcgggatacgatgtttaaaaatgtttataaagtgctaccgggccaatactttattcaccatgcaaatggcgaaaccgagacgcaccggtattacaaattcaattacgatcacattgacaacacccaaacggttgaagaagatgccaagaagattcggggtatcgttgatgaatccgttaaagcccatatgattgcggacgtggaagtcggtagttttttatccagtgggattgattcttcatacgtgttgaacgaggcatctaagttaaagccaatccagtcattctctttaggatttaaggattctaagtacagtgaattgagctggtcaacagaatttgccaaggaaatcaaacaaaagaatacgccgctctacatgacgggtgatgattacttcgatatcttaccaacgatcatgtattacatggatgaacccttatctaatccatcggcaatgcagctgtattacttgtctaagggaacacgtgaatccgtgaaggtagccttatctggtgaaggagccgatgaattcttcggtggttataacacctatctggaagctattccatttgaacgctatcaaaaatgggttccaggtggcattcgcaagatgctagggagtattgctgagaagttccctcgtttccacggtcggcgtttcttggttcgtggggcgcagccattgagtgagcggtactaccgggttaactatgtcttcgacttccatgatcgtaataagatcttgaagaacccgagcttgaatcaggacgctggtgcttataccaagcatttgtttgatgatgtgaaggggttagacgaaatgacccaaatgcaatacttcgacatcaacacgtggttaccttacgacattttgcataaggctgatcgcatgagtatggcgaactctctagaagttcggacgccattagttgataaagaggtggcgaagtttgcggcaaccatgccggttaagacgcgaattcacacggacgaaaccaaggtctctttgcggacggcggccgaagcagaactgccagaacgggtagctaagaaggaaaagatgggattcccatctccgattgcgacttggatcaagacagaaccttataagtcacggatcattgaggccttcaactctgacgtggctaacaagttcttcaatacggatgccttaatggatatcttgcatgagcacatcaatgggaagtccagtatgcaaaagatctttaccatttatacgtttatcttgtggtaccaagtttacttcccagaagagacgacggctaaaacggtggatctagtgcaccggacgcaagtttaataatttaacggcgcgccaatgaatttggtcggccgataacgatcaaggttgctattggactcgtccgctaacaaccttgattgtgtttacttagcttttaatcaaaatttagtgtgaagggacgtttatgtgtgatggaaaccaatggcgtcaagtttacgcccgtattactcgggagtgattttaacgtttacgggatggctcgctccttttatgagctataccatgaacccgttcaagcttttgccagtgtgcaattagcaccaacgcgctatacaaaagttgttaatttagagttgattcctggatttgatgaagatccagtttggattcaaacaatgcgtaaacttaaggagcggtacgctgatcatcccgaacctgtgattttaattgggtgtggggatggttatgccgaattgattagtaagcataaagccgaactcgctgatgtgtttatttgcccctatatcgactacgataaattacggcatttgaacaataaagagaatttctacaaagtctgtgaccagtacggattaccctatccggctacccgtattatcaccaaggacatggcgacagccgctgaaccggtggaacaaccctttgattatccggtagccctgaaaccagctaacagtgtggaatggttggatgtccacttcgaggggcgtaagaaggcctttcggattcagtctgaagcagagttccgcgatattgtgcagaagatttatgccaacggctaccagtccgatctgatcttacaagattttgttcctggtgatgatagtaacatgcgggtactaaatgcttacgtcgatcaatatcaccatgtgaagatgatgtgcctcggccatcctttgttggaagacccagcaccatctgcgattggtaactatgttgcgatcattcctgaatataacgagacaatttatcagaacattcagaaattcttggaagccattgaatttactgggtacgcgaactttgatatgaagtacgatgtgcgtgaccaaacgtttaagttatttgaaattaacttacgtcagggacggagtagtttctttgtgaccttaaatggctataatctggctgattgggttgttaaggactacgttaaacaggaattggttgatgctcccaccgtttacggtaatcaagatgagtcacaacatgcgctatggttaggtgtgccggtgaaagtctttaagcaatatacgcgtgagaatgtggacaagcaacgggcgttgaagttgattgccgctggcaagtatggaacaacgtatcactacgatcaggatatgaacttaaaacggtgggcattgctaacctggatgcaacacaactatacggtgaactttaagaagtatttcgctgaaaataaggggtaagccattatggaaaaattctttacgattattggcggcatgggaaccatggccaccgaaagttacttacatcaattgaacttacggacgccggcgcacgccgatcaagagtatttgaattacattttggtcaatcacgcaacggtgccggatcggacagcttatattttggatcacagccagcccagtccgttacccacattactggatgacatccggcaacaaagccagttaaacccagcgttctttacgctaccttgtaatacggctcattatttttatgatgacttgcaggccgctacgactatcccgttgttgcatatgccacgcgaaacggtcaaggaaatccaacgccattttccggaagctaagcgcattgggattactggtacgcagggaaccattacggataaggtctacgaagatgaggtgttggcggccgggttgacaccagtgttgccaaccgcagagattgaagcggaaacgatggagttgatttacgacaatatcaaggagcaagaccgtgtagatgcaccgttgtatcaccggattttacgccaaatgcatgatgagcaaggggccgacttggtcattttggggtgtaccgagttatctctagcccaggaacgcgaaccggaaactcagattcctttggttgatagtcaatcagtattggttgatcgaacactggaaatggctttagccttacgtgataaaaaataagtaatagataaatgatggtcttgagtggcttctctttttataggagtcactttttttattataatcaattggttaggaaattaatcgtagtgaaagtttctatccagcagtggcgaaagtcgaactaccctaatccagatcaccactttcacttttatataaaaatatcccttctcaacattaatgatggctgttgagaagggatattaataattatttaaaagctaacgttagtcccaatccaatcgtcagtaaagcgacgatacctagtagccagtaaatgagatgatgcgttgttcgctccatctttcgaccaaagctaatctcaattagtgcaatggtcccaattcccaaaagaaacttgagactgatgaggaggggagcgtggttaaacgttcggatacttaacacaaccccactgataatcatgatgatataagcaattcgcgccagaataaggcattgggtggctcgtttttcagaatgtcgagtcagcccaacgacgactaaaattgctaaaataatccaagtccaaaagtgaagccctaaccacatagcaaccgctcctttgatatgacgcctagtaaccttagcctaccataatctaccggataccgggtactaattttcctccttttcatagaccaattctgccagtggtccaagggggtggacggactgaaggtggaaatggtggcgacgatttaggtcaccaaagagacgtttaccttgccccaaggtaacgggggcgatttgtaagtagagttcgtcaatgaggtcgtcggcgattaagggggttagaatggcttgtccaccaataatccagacattgccagattgctgcttcaaacggcgtgcaaggccaagcaggtcttcactggtgaaagtgatagttgctgtatcttgatagggacactgggttaagacatagctgtgcatggtaggattatagggattgagagttaatgttgaggccgattcagcaatcgtatcataagtgacccggcccataatggcagtcgtcatcttacctaatacatcatggccggcgtccaccgggattcccgctaagccggttaaccaatcgagacgatcatcagttgttgctaagtagccatctaaggagatagcaccgtaaaattgaatttttcccattattgtaatgatcctttcaaaaaaacgctgctccaattcggagcagcgttaaagtgggcattaggcattggtatttaaaccagctgctttaatccagtaagctttattatttaagacaatgcgataccaagttgagccatcgctggctttgttaccttgtttgttgaccgttaccttggttccggtactaaagtcttgcgtatgtgccgttgtcttggatagataagttgaattgagtacgtggttgtacatcgcgtaattttgagaattgttaagtgtcatggttccactggcgtcactgtaagtgaccttgggaaagttcaaaaccttgctatatacccagtacttcgtagtggcattcttactgaagcggatgcgataccaagtgccgctccaaccaccttttttgacaccacgactatcgacatagaccttggcacctttgtgatcagcactcaagcgaccccagccgattttgtaagcaccactggttcccttaacatgattgtagacggtccaattggtgtaattattggctaaagttgcggtttcgttattactcccgtgattgtaagtgaccgtctttttagtagtcggcgtcgtgtgatccgttgacgtatctgtattgttatccgccggatcatctgttgatgtggatgaccctgataacttggcgtactgcgtatttacgagactaacaaagtctgtcatagtgtaagtcgtcccaaagtaggtactggcgttactcttccaataaccatccggatcggtatgattggttccgccaaggcgattggagacatcatgatgggaaagaaccgtggtgtaacgcttaggcgtgagcccattttgctttaaaatataggccgtgtagtaggcggcgttgttcaattcagaggcgaaggccgctttagaatgaacctcaacttgttcaaactgcacataccgtgcattggctacgggaccagcaccccaagataagtatttggtgttggcaatattaataatgtgactggcgtcgacaaacgtgtgtacgaaagctgccgaataattatttttcatataggcaatttcattatagattgtggaattggggttggctgtttcatggaccacaaccccttccggtttattatagcgataactgttcttaggaaaggttgaccaaattgagctagtaattttaggtgtcgcataattttgattagcgatgtacgtattaattgaattggcgctagccgaagtgttggaccaaaagagcccaaaacaaccggcggtaatggcgattccccgaaccgcccaacgttgccattttttcatatttatttgttcctcctgttgataactatttttaaaatagacttaacgcaacgcctaaagtataacttatttaaggaactttgaatattcaaagaatttttgaagaaaaaacataattgttcgttaattacgctgtattttttgaaatacccttgaaaacaagcattaaatttagtttttaaccgaaaaataaaaataatgggcattaaagttcgcgtttactcgtttgtttcaaactttttacatttgtgttgcgaggaaaggagactttacttgcttcatctaagtgatttggctataattaaattttgcaaatgaaaggagcgacgaacaatggctgaaattaaaattggcgattacgttgcggcagaaaagtttggtcctctcgaacatgattttacgggagaagttaccaaagtgtatgataattcagttttagttgaaatccgtgagtatgatcctgcagataaaacggcggtcggcgatatgaataaccgggcggttgtgcgaaagaccgctgcaaaagtgaccggtcacgtcgcagacgaaaactagttttttaaaaactttttgaatttattttcaaaaaatgatgacaacccacagatggtatgctatacttttctgtgttgtgcgggtgtagtttagtggtaaaattcaagcttcccaagcttgcgtcgcgggtccgattcccgtcacccgctttcgaatgtaggcggccaacatggtcgtctttcttattattcgaaagctttcaccatcactggaatagtaatttaagtggtttctcctcagcaagtccgggtagctgtaagccggaagggaatctttaaatgaacgggtcagtggcgactaatttaattcaatcatttaagtggactttaaagtcaattagagtggtaccgcgggtaatctcgtctcttacaagtatttttgtaaggggcgtttttttgttcccggagtcgtttggtgtaaactaaaattgatttactaactaattaacaacctttcaaaggaggagtatctatggactacaaacaaatcgtaacggcagccttgagtgacgctttagcgggtcaattaacgcgtgacgaaattgctagcaaattggaacggccaaagacatctgataaaggggacatggcgttcccgacatttacattagctaagctcttgcaccaagctccccaacaaattgcacaagacttagcggaaaagctagataaaactagttttgaaaaggtggaagttgtggggccttacttgaacttcttctttgataaaggggcgtacagtgccgaaactttgcagaccgtgttaactgctggtgctgactatggtcaaaacgacgatggtcaaggcggtaatgtgccgattgatatgtcgtcacccaacatcgcgaagccaatgtcgatgggtcacttacggtcaacggtaattggaaattcaattgctgaaatcttaactaagaatgggtaccatcccatcaaggataatcatttaggtgactggggaacccaatttgggaagctcatcacggcctacaagttgtgggggaacgaagccgatgttaaggcagatcccatcaataagttggtggaatattacgttcggttccataaagaagatgttgataaaccggaacttgatgatacggcacgggaatggttccggaagcttgaaaatggggacgaagaagcccatgaactgtggcaatggttccgggatgcttctttacaggaatttaacgatgtttacgaaaaattaggcgtgacgtttgatacctttaatggtgaagccttctacaatgataagttggaggaagttgtccagattcttaaggacaaaaacttattggttgaatctcaaggagcacaagtggttgatttgagtaaatacaacttgaatcctgctttgatcttgaagagcgacggtgcttcactctatatcacccgggatattgcaacggccctttatcgggaccggacgtatcatccagctaagaatttatacgtcgtgggctcagaacagacgtactactttaagcaattaaaagcagtgttgcaagaaatgggcgtgccatcagctgatgacctggagcacattccattcggcttaatcacggttgatggtaagaaactgtcaacgcgttctggccgtatcattttgttggctaaggttttggatgactccgttaaattggcggctgaagaaatcaatgaaaagaacccagatttggcgaataaggatgaagttgcccaacaagttggggttggtgccattgtctttggcgatttgaagaatgaacggaccaataacattgacttcgtattggccgatcaattgaaattcgaaggcgaaacgggaccttacgtccaatactcacatgcccgagctgaaagtattttacgtaaggctggtaaggtgacgattacgactgatggcaaccaaatatcggatccagaagcctgggacaccattaagacgctagctgattttccagccatggttaagatggcctgcgatgagtttgaaccatctgtgattgcgaagtatgcgattcggttggcgaagacctttaacaaatactatgcacactcaaagattctgacggaagacgccgagttgcctgcacggttggctctagttaaggcagtttccactgtgctaaaagaatctctacggctattaggtgttcaagcacctgacgaaatgtaggaagaaacacgcaactagctgtcgttaggcaatgaatgactcaagacaaacgtcttgggtcttttttggtgggcacacgtcaagatggcggttattaaatgtgcatgtaaatttaggaaaatgttaatttatgcggaaaatagcgaatgtaaggggcctcttttgcgtttataatgaatatttgttaaaataatggtcgtagttatgcaagaatatacgaggagggttgttttagtgaaaaagagtattcggcaagaacgtatcgaacgtctgattaaccaatatccaatcggaacccaggaggaattaatggagcaccttgaggatgtgggtattcaggccactcaggcaaccatctctcgagatattcgcgaaatgcagattgtaaaagcgcaagatggacatgggcatttgcgctacacgatttttaaagtggacaaccgcagtgaagaagagcatctgcgtgaaaccattaatgaagtagtcattggcttaactcaagtggattttgttaatgtgttgaaaacactacctagtaatgggaacctgttggccgcaatttttgatgatttaaacttaccagagattgtgggcacgctggcaggtcacgatacaatcctgattattagtgctaatgcagatgttgccaagcagctccatgataagattgctgctgaaatgaatccggaaattatccactaattgttgatagaatatgtcgtggcgtctagctggacatgttctttttttatcgtaatgacggttaagctattttaaaggttcataaagtttcgcctaaatgcgggtgcgaacacaggtttatgctagaattgttttattacaattgaaataagaagaggctattttatgaataaccaacaacctaatcagaccttttggtcaggtttcaaaatacgttttagacgcttctggcgacggtttcagcttactcgttggttaatcgttatttttctcacgattgtgtttgtcatgagtgcttatttaacgtttatggcaaagacggccaatgtgggggacttgaaagcggccctggaaaatccaacgcaaatttatgatcgtcgaaataaaaaagcgggaaccctgtattctcaaaaggggacatatgtgccactgacgaacatctcaacgaacgttcagcaagctgtcatctcgacagaagatcggaacttttatcatgaacatggcttttccgtcaaagggattggccgcgcgtttttcctgtacgctaaaaataaagttttacggcagaattatattagtggcgggggaagtacgctgacccagcaactggtaaaaaatgcttatttgacccaggaacagacatttacgcgaaaatttaaagagttattcctgtcagttgaggtcgaaaatgtatatagcaaaaaggatattttatcaatgtacctcaataatgcttactttggtaacggtgtttggggagtgcaggatgctgctaaacggtattttggtaaaacggcagctaacttaactgtcccagaagctgccgttttggcggggatgctaacctcaccgagtgcctataatccagttgatcaccctcaagcgtcacgggctcgacgtaatgtggttttgggattgatggcagaaactggggctattacgcaagcacaagccaagcaataccaggcaactgccattacgacaaatgatagctatagctacaaaaattcttacaaatatccttatttctttgacgcggtgattaatgaagcagtcaataagtatgggttaaccgaatcagagattatgaataaggggtataaaatctatacaacgcttgatcaggccaatcagacgcagatgcagatgctctttagaaatccgagctacttcccggcgaacgccagtgatgggactaaggtccaagcggcttcgattgctatcgatccgacaactggtggggtggaagccgtggttggtggacgtggtaaacatgttttccggggttataaccgggctaatcaaatgcggcgtcagcccgggtcgacgattaagccactggctgtctatacgccagctttggagaatggttattactacgattctgagcttacggataagaaaaaatcatatgggacgaatgattatacgccgcacaattatgggaatcagtatagcggtcaggtaccgatgtatgaggcgttggcccagagtaaaaatgcgccagctgtgtggttgctgaacaagattggtgtcgataagggctatgactctgtgaagaagtttgggctaccagtaactaaatcagataaaaacttggctttggccttaggtgggttgaagacaggggtgtcaccacagcaattagcccaagcctatacggcatttgccaacgaaggaacgatgacatcggctcattacattcggaagattgtggatgcgtctggtaatgtggtcgttgataatacgcaaactgaggctaagaaaactaaggtcatgtctagtaagacagctaagcagatgaccagtatgatgatgggtgtcttcaattacgggacgggaacgagtgcgaaaccgtatggatataccattgctggtaagactggtagtaccgaggcggatggtgattctgatgctacacgggataagtggatcgttggttatacgccagatatcgtggttaccacttgggaaggtttcgatagtaccagtagtaaacaccatttggaaaacgttagtggtacgggtgaaggcccactttataaagcagaaatggaaagcattttgccaaatacaaagggaaccgcatttaacaccaaggatgcatcgacaatcgctaatgctaaaagtagcgggagttcgtcaagcggtgatatctgggattctgtacaaaagggtatcaataatgccggcaagcaatttaacaatgcagcggatacggttaagtcctggtggaataaggctaagtcaattgtggaataactgggaatccctcctagggtgagttgctaaagcatggtacaatggaaaggtaagtcaactgggtcatagacccactgaggaggaactgtaatggctgataagatgcaagctctgggtgcacagttaacccaagcattacaagaaacagatgaatttaaagcgctcaaggcagcgtttgcgacgatgaaggaagacgacgcaacttataagttgttcaaacgtttccagcaaattcaaatggatctacaacagaagcaaatggctggtcaacaagtgacggatgatgagatgagtcgtgcgcgcgacgtggctgatcaggttgctaagattgaagccgttaagacgttaatggatgcagaacgcggcgttaatgctttgttgaatcaactgaaccagaccatcacccaaccaatccaagatatttacgcgggttaggttaagtagagattgtcggcgtggctgctcatttgggtggttaggtcgactttttttaatcacagaaaggtcaagtgattgggatgaaatttattcatgcggcagatttacatttggatagtccctttctgggactgactaatttgcccaatagtttattaacagtcattcgtcagtcaacttttgccgcggtaacgaaggtttttgaccgggcgattagtgagcacgttgattttgttgtcctggccggagatttattcgatcgttcagaacagagtgttgcggcgcaggcttatttatttgaacaatttgatcgtttgcggttagcgaatattcccgtatttgttatttttgggaaccatgatttcttggctgatcaacaccagcccattgcttaccctgaaaatgtacacgtatttggagcgacggttgaaacaaaaacgctgacaaccgctgccggtgaaacggttgccctaagtggctttagctatccgcaacgctgggtcgaagccaatccattggcggcgtttcccaatcgtgcggcgactgattggcatcttggtctgttacatggcgctatcaaatctggaagtcaggatcactatgcgccgtttacacgggctgacttactgagtaagcggtatgactattgggctttggggcacattcaccagcaccagatattaaacacacaaccgcccgttgtttatgcgggaaacacgcaaggccgatcgattaatgaaacgggagccaaaggcgcatacttggtggaaagtgatggcacagccttagtcccgcatttttttgagacgaccgtaattggttgggatattccagaggttatgacaacgtcggccgccgatttaccggcagtgggccaagcgttaactcagtgggtgaccacccacgcgactactttacccacactgacggcattgtccattcaggcgccacaattggtgccaacggatctacatgatttagagactgattggttggctctgtaccagcgaacccacgcgcgacttttaaaggaacatcagcgttacttcattcgattaaacgtggcgttgccagagtcaactctgacagcaccacaattggatcaacaatattgggaagctggggccgctaccgtcttcacaccggaaaacttgcgtgatctatttggtaagttggctcaggagccagccttggccgagtggtttgagcaatcacagacgcagactgacttaaaacggctgacagaacggcaaatagctactttaatggggaaggcggattcggatgtatcttaaaaccttgacgatttatgggtttggtcattttcatgatcggacctttacgttggatgccgggttaaactatcttgtcgggcctaacgaggccggtaagtcaacgctaacccaatttattgtcgccattttatttggattccccaccaagaagcatcccgaattacggtatgagccgttagatggtagtcggtttggtggcgcgctgacctttgtccaagcaaagacgcattatacggttagccgaacggcaggaccgcatggtgggacggtcaccttacatgataatacgaccgatctgacactgccggcaacccaattacccaagctattagcaccgatggatcagcttttattcacccaagtctatgtgatcaatgaacctcggcttggccaggtgttctcggcgtctaaacaagctttaattgaacggctacgtcacgttggcgcggttggaagtgactattggttacaacgggcgcagcaaatggataagcaagccgatacgttatacaagccgcaagggcgtaatccccagttgaatcaacagctaaggacttatcaggaactaactgataagttggataaggccaatgcggcttatgagacgtattggcaattacgacaggaacaacaacaacgtcagcggcagcaagcagatttgcagacgcagctccaacaacagcggcgagtaacaactactttgacgcagcgcgtctctcaatggtcaacgtatgtggcttggcaacggttagcccagaaccagcaggcggctgtcagcggtttttcggcgacggatgcgacgcaactagaacagcttcgaggtcagttaacggcggctaagcagacattaactgcggaccagcaacgtatagccacggcccagcaagcagcagaactcccagagttttttcaagaatacttgcccgtagccgcccaagtggatcccttactgaccgagttaccagacgtgcaactggcgagccaacaacaaacggctttgaaaacgacccgggccgagttacaacgacgggcgactgaaatcgaggcacagtttgcgcaagatggtcaaatgccacgggcgttttctttggcaacgacgcaacagattgaccaattgcagcaacgattaatcagtgcaaatcaacaacggcgtcagttacagcaaaccttgaatcagcttaatgagcggtatcagcaattgcagccagcaaaggctcatgcgactaaccccttagcggataagcaagttgtttggctgaccatgggcttagccgtactaattggcgccatgtttttacctggcgcgatgttcaagctggtgggcgcactactgggtgtggcggttggttattatggtgtttttttagtggatagtagcacaccggcaagtcggcagttgcaggcactgaccgatgatattcgggatagtcaagcacaattgcgagagaaaggccggttaattgatgatttgactaatcagttggatgtgattgggaccgcacatgggttaggacacgtgccagttgaacagtggtcggctacgcaagcggcaattggtgaatgggaacggttgacccagcaactagaaacaacggatacccagttggcgaccattgcgcaaaaagtgacgaattttcgtcaacaactggcgacagtattgcctaagctagcaacaagtgacgatgcaacgttgtggcaacagttagcaacgattgtccggttgaagacatcgctgaagtcccaagaaagcgagctggcaacgattgccacgcgattaactcatgatcaggccgctgtgacgtcggcacaacaacaagtgacaacgttcttgaggacgcgaaatttgcagcaagttgatgatttctatgaccgttatcaggttcaacgagaacgggccagtcaagctaaacaacaggccgcgctggcagctcaattggggcccgagaatttggccgcgctgcaacaggtgtctgatttagcagccttacaagcacaattacaacaagcgcaagcaaaacagcagacagtgcaggcacagttggatcattgtacagaacgccttgcaacgttggccggacagctcgcacacctcacaaccagtggtacgcaagccacgttgcgacaacgccggcaaaacttggtgacagagatgcagacgactactgaaaagtggttagtcgatcggttggcgagtcagtggattgaaacgacgttggctgctgcctccggcgatcgactgccgcaaattatagcgcaagctagtgaattctatggtaaattaacggaaaaccggtatactaaaattgaattgacgtcaacgacattacaggtgcaaaaacaaacgggggagtggcgaacggttagccagttgtcacgaggaacggctgaacaattagatttagcagtgaaattagcctttgcggttgtcatgcagcagcaagtggcgatgccattaatcattgatgatggctttgtcaactttgacgagcgtcgccggcaggctgcctatgcgctgttagcagaaattagtcataaaattcaagtgatcttattaacggcggatacaactgtgattcaattggcaacaggacgagtgagtcaactaagtgactaggaggaattttcaatggcaataggaaaacaattactagattacgacgaggacgaggcagtcgatgcatttgcattattaaagtctgctgacgtacgcacagccaaaaacggtaagcagtatattgctttagtatttgaagatcaatccggtgagatttcgggtaaatactgggatgcctcaccagaagacattgccaactatgttgcggggcgtgtggtgcacgttcaaggaaagcgggagaattaccaaacgcatcctcaaattaaaattatgcacttacgggtaacccatgccggagagcccaatgacccccaagccttcattgaacatgcgccgatgagtcgagcggatatggaagattatctgacccaaaccgtgtttgagattacccagccaacctggaatcggttggtgcgaaagctattgagtgagtatgctgagcgattctacacctttccggcggccaagagtaatcatcatgcgtttcagggcggcttagcgtttcacaccatttcaattctgaaattggcgcacgcggtaaccgcacaatatccggatctcaacgcgccattgttgtacgccggtgccattcttcatgatctaggaaaaacgattgaactgtcgggtccacagtcgacaacgtacaccttagccggtaacttagttgggcatattgttttgattgatggggaactggtgcgggcgtgtgatgccttgaagctggacccacaagcggaagatgtcttactgttacggcatatgattctgagtcatcatggtctgttagaatatggttcaccagttcgaccagcattgcgggaagcggatgtcttgcatcagctagatgagttggatgcctcgattatgatgttagatacagtggttgcccacacaacacccggagaattctcggagcgggtctttgcgttagatggtcgccggttttatcgaccagctagcgacacaccgcagccaccaaaagattagaatggcacacaaaaacgctcaacgacgatactggtcgttgagcgtttttggcgattaataagattacttagatgaagatgaagcggaactagaacttgatgatgacaggtaatcagaaaggatgttcttcaagtcgttatccttgatagaaacgttacccttcttcaagaccttggcaacgacattgtgaaggacagtactgtcgttcatgtcgttatcaatgatttgcttcgtcaattcagccttgtgttccttgatcgttcccttaccagggttcttcaacatcaaaatgacgtggtaaccgtattgcgtcttaacaggcgttgcggtgtattcgccagtcttcagcttgaaggcggccttcttgaaggttgaatcaagagacgtatcggtactatcgaagctgctcaacttaccacccttgttcttggtagccgtatcagtcgagtacttcttagccaacttcgtgaattcactcgtcatgtcactagacttagtgctcttcaagtctttaatgatggtctgagcggttgacttcttagaaactaagatgtgggcaacggagacttcaggttcgtaactcttgaattgcttcttgagttgcgcatcggttaccgtaacgttatccttaacggcttccttcaacagtaagttagaacgaatttccgtcttcaaactggattgcgtcatcccactttgagataagacactgctaaatgatgaaccatactgtgacttgtacttgtcaaactgttttgtaacagcagacttgctaaccttgtcaccgtattgcttttccaagaccttgtttaagatcatttgttgcagaacttgcttaccagaagacgtgccctttaaactactgtaataggcactttcggtaattttgccaccattagttgtggcaacggtttggctgccacaaccggcaagcgttacggttagtaacaagccagcgagcgcgataaaccattttttcatattactcaacacatccattcatcaaaattggtgtaaacaccatactcagacatcataacacaaataaccgcgaacccaaaaaggtcggcaaagctttacaaaaagttcaaatttaattccgatcccattttgccacgatttcctcaatattggcaactcgcggcgcaattttaaaagtgaacttatcaacggccccctgaatatcggctagtactggttcaacggcggtgattgcggcagttagctgctgggtgctagcagaaacccggtcggttgattgacgaatcgcggttatttgatcgctggtttcgcggacctgatgtttaacgtgttgcccccaagtccggggatcttgttgggtcgccaccagataggcggccaggccaacaccagcggccagtgttgttcccatgataaagcggccaattcccatgattatccctccaactgggcgctaatcttagtttggatggcggtatagtcatctggcgtataattagcggcattgtctttgaaaatcattttgaaatcatcttgatccgtatagcggggaaccaaatggatatgtgaatggaaaacggattgataggcaactgatccgttgttattcaaaatattcattcccacaattcgtggatcggcagcctttacggcacgggcaatcttaggaatccgtgaaaaaacagctgccgctaaatcagcatcgtaggcgaagatgtctttaacgtgggtcttagggataaccagggtgtgtcccggtgttccttgcgaaatgtccagaaaggccttaacgatgttgtcttcgtaaacggtgtaactgggaatatcgccggttaagattttacaaaagacacaatcatcggcgtaatggggctcaagggtcattttgtccataactaaaactccttctttcgattcaattgggttcattatacaccactgactagcgagaatgaaccgtgactctggcgttggttaagtggtatttagggttaggtggcgtctgtgattatggcacactccaattgggtgtaaattttatttgccacaatgacctatggtataatggggcggttaacttaaaggaaaagaagggatgtatgatggctttagaagtcagccatgttgtgggtggttactcacagatccccgtcttaaaagacattagttttgacgttaaggacggagaactcgtcggcctaattggattgaatggggccggcaaatccacgacaattaatcatgtgattggattattgacaccacataaaggaaaaatcacgttaaatggtgtgacgattgatcaggatagtcaggcctacaaacaacagattgcttatatcccggaaacgccggttctttatcaggaattgacgttgcgagaacacctggaaatgaccatgatggcttacgatcttgatcaacaggtggcatggaagaccgcacatgggttattaaagaccttccgtttagataataagctggattggtttccagccaacttttctaaggggatgaaacaaaaggtgatgattgtgtgtgccttcttaacgcaggctaatctcttcatcatcgacgaacccttcttgggactagatccactggcagtcaacgatcttttgcacctgatcgaaagtcgtaagcagcagggtgctagcatcttgatgtcaactcacgtgttggatacggcgcagcgttattgtgatcggttcgttctgctacatgatgggcaagtaaagaccgaaggaactctcagtgaattacaagccgctcttccggaagcgggggaatcgctgaacgatatttacctgtcaatgacgaaggttgatcgctcatgagtggactatttaaaacacggcttcaacgccatctccgggaaatggcaaaatatctgcggctagtgtttaacgatttctttgtgtttgccttgctgttcttcttaggcggcttggggttggactactcaaacgtgttaaagacactgcggcctggcctgtggtgggcaccggtcgtggcgctgattattctcgcaattgtcagtcaaatcggtcgattggcaacgttggttgaagatgccgatcgggtcttcttattgcccaaagaacgggcgatgcatgcctacttggtggctgctcgtcgttacagtcaaggattggcgcagtgcacgcaattaattgctctgtttattctatcgccatttttacgtgtggcgttgaactggtcagttgcggctattttgagtttagcggtggcccaggtgatcttgaaggacaccttattacgtttggacttggcaagtgcttatcaagtgacgggacaacggcgaatgaatcactggtcgattaaatggctgttggctctaatagtcattgccagtggattatggctgacaccgtatttggcggtcggcttggttctaatcagcgatattggtgttgccgtatggttgcatcggcactggcaacggcaacaaattcgctggcgtgaacagattaagttagaagataaccgaatgttaggtatttatcgcttcttcaatttatttaccgaggtcccaatggtggcaggaaccatcaaacggcgacgctatttggattggttgtttaaggggattaaactgcaacagaaccaaacttatctctacctgttcagtcggggcatggtgcggggaacggagtttagtggccttgtcgtccgactaaccattattggcatgttattactatacttcgtgcaaggtcagtggttacccattattttggcggcgttattcatctacttaattgggtttcaactgttaccattcttccagcaatacgatgatgtggtcttcacgcacgtgtatccaatcttgccagcctggcgattgaagagctttgtcaaattggtcacactgattttgagtgtagctgcgggactgctatggctcgttctagtgattgctaatcggcagatagaaacggctgggattgccttggttgtcgaagtcgttgaagtctggtatttggcccgtgtttataccccacagcggttagccaaggctgataaaaataaagcttgacgtcacgagcatttgcccataaaattaataatagctgacaaatcgaggaggggtggcacgcatggcactagatcttagtgacggctggagcttgtttccgctaggcggaaatacaggaacggcatatatgggaaccaaagcgtcacaaaaggtattcttaaaacaaaatgcgtcacctttcctagcagcgctatcaatggaaggaattacaccgcggttggtttggaccaaacggttggcttctggagatgtgatgacggcacaagagtggttgaacggccgcaccttgcatcgacaagagatgcgcgaacaacgggttgcccggttattacatcgcgtgcatcattctcagctactacatgatatgttattaaaagtcggcggacggtttaccacgcccgcccagttgttgactcagttacgcccggccttagccgcggatttagcccagcatccgttgattcaatcagcgtttgctagtctagagactgagcagccacaactgaccaaggcgcattatgaagtttgtcatagtgatttgaatcataaaaactggttgctgtctgatcgtcaacggctatacttagtcgattgggatgccgcaactttcgctgatccagcttttgatctcggcgcactgttatgtgagtacgttccgttagaagaatggcgtcgttggctgttggattatggtgaaacactgaccagtgagttgattgcccgtgtgaactggtatgcgcgggtgcattgcttgcgggttattgcggagagttatcatcaacagcgattccaaattatgaatcaacatttaattttactggaaaaactgacgcgtgagtcagtgactgattaacacaaaatggcggcgggagcggggcaaacctcgcgcccgccgttgtgctaaggaggaaataagagatgcgtgtacgcaataaaccttgggccaagggctatatggccgatcatttggaccggttggtggtggagccagaaccattaaagggaaattggcaaagtcgttttccaagtaaccaaccgttattcgtggaaattggtactggtaaggggcaatttatcattgaaatggcccgtcagcacccagatcgcaattttattggaattgaaattcaaacgtctgtgattgcggtcgctttgaagggtgtcgtcaatagtggcttaaccaacatccagttggtgcatacggatggtgaagccattaatactttctttgaagctggcgaggtcgcaggactttacttgaacttctccgatccgtggcccaagaagcgacatacgaaacgacggctaacatcaccagtctttttggcgcattatgcggatgtgttacagccagaggggcaattgcaattcaagacggataaccggggcctatttgaatattctttgggtagtctgaacaattttggcatggtgtttgaaggcgtatggctggatttacatgcagctaccgacggcgttgaggatattcaaacggaatatgagcaaaagttttccaagaaagggccaatctatcaagtgattgcccactttccaaccaacaactaatatttaagtggaagttcgggtcaaatggcccggactttttgtgtcttcaaaatctagttggaatgacgcccttttacaggttagtggctattctttgcggatttactcgtagaggagggatgcttcatgttaattgcggcgcatatgtctggcttgatcgatgccagcgaggcaactcggggacttgattatcggtgtcctgcttgccagcagccggtggtattacgccatgggtcacagatcccaccatactttgcacatcacccccaagcgccttgccatttagctggcgaaggggagacgcgccaacacctgttgggcaagcgtcagctagctaccttcttttcggactggggaccagtgacattagagcgtattttaccggccattcagcaacgtgcagatgggtggttggacttacctcagccagtggctttggagtttcagtgtagtcccatcagtcgcgaggcagttgcacaacgaacagctggctaccgacgtatagcctgttacccattttggctactgggaagccggtatgcccaacaaaaattgaattggcggttaattgagcgctttgcctgctggttaacgggatgggacctttgtctgttattctgggaagttgaccagaatcgattacgggtagtccatcacttacgccaaacagcaactggggcttacattaatgaaacatcgtgggtaacgacgctgtctgagttagtggcagggcccacctcatgcaccactgttgttcgaaaccttgggcaaaaacagtatcgatcttaccttaatcaggcattacggcgtgctacgccaactttacgaccgattcaagaggccctttatttaacgggacaccaagtcgccggcttcccagattgtttgatgacaacgaccttaacggccccaatttttggtcagggattgatcctgtggcgaatcgtcttaactacgtggattgaagaacaggtagatatgacgtttttaaccctagccgaattaagtcaacgggccttgttactagtcagcggtcagactactgccgttcgatttgatggtcagtcagcttttcggcaagaacaacgaaaattattagcacttctcacgcaagctggcattttgcgccccacgacgcagggatggcacgtgtgtggtcatctcgaatgggcacgtgattatactgattggttagaaaatgatgagaaaagcggatgctagttcacctaatgttagcttgaaagtggtaaactatctctatgcaatcttaaaggaggatgagaaaaagtgaaacaaattccgaaacgatcagaggttcccacggcactgacttgggacctgacaactatttttcccgacgaagcagcttttaagaccgcaattgccgcgattaaagcgcaaataacggttgtggccggcttgaagggacaattggcccaaagtggggtcgcgttatatcgtgtcacgacggcggtatttgatttgaatcgccagttggagcgggtatacgtctatgcgtctttaaacaatgatcaggataccggcaatgctgcggcccaagcattaatggggcaggccgagagcttggtggcaactgtgggtgccgccacggcttggtttgaacctgaggtattggccttgtcagcggatcagctgcaaacgctgattgataacgacccccggctggcagattatcagcatgtgtttgacgtattgggccagcaacgggcacatacgctgtcagtggcggaggaaaaattgttagcgggggctagtgatatctttggtgcatctgctaaaacttatagtgtgctgagtgatgctgatctaaagtttccggttgttcaagacgaggccggcaacgatgtgcgactgtcagaaggactgtatggtgttttgctacaatccacaacaccacgggtgcggcagcaggcctttgaagcattatattcggtttatcaacaattccgacatacctttgctgcaaccttggcgagtgaagtcaaaacgcataattttagcgctgagacgcgtcactatgcgagtgccagagcggccgcaatgagtcgcaacaatgtgccagcagtggtctatgataccttggtggaaacagtcaatgagcatttagactcgctgcatcgctatgttaatttgcgcaaagagattttggccttgccgcaactgcacatgtacgacctgtatacgccaattacgggtgaacccagcttgaaatatacctaccaagaagcacaagagatggcgttaaaggcactagcagttttgggaccggattacactgccaatgttcaaaagatgtttgatggtcgggcaattgatgtggttgaaaatcagggtaagcgaacgggcgcttactcaggcgggatgtatgataccaaaccgtatattttgttgaattggcaagatagcttggaaagcttgttcacgttggttcatgagatgggacacagcatgcatagccattacactcggacaaatcaaccgtaccagtatggtgattattcaatctttgttgcggaaattgcctcgacaacgaatgaaaacttgctgacggactacctgttgaaaacccagactgaccccaaggtgcgagcttatgtattaaaccattatctggatggctttaaaggcacggtataccgccagacgcagttcgcagaatttgaggactacattcaccaacaggatgccgctggcgaaactctgacagctgacttcatgagtgatttctacggcaaacttaatcagcgttattacggtgatggcgtgatttccgatccacaaatcgctgatgaatggacccgaattccacatttctactatgactactatgtgtaccagtacgcaaccgggtttgcggcggccacgacgttatcgcaacgaattttgagtggcgacgaggcaaagcgggatgcctacttggcctatctaaaggcgggaagttctgccttaccacttgatgtgatgaaacaagcgggcgtcgatatgacgcaaccgggctatttgcagacggcttttgcaacgttcgacgagcgtttggcagaattcacgcaattggcgcatgaattaaaatagagaatgcactaaaaagcacgactcattcaaatcagaatgggtcgtgctttttaaacggttaatcagtaggcaaccaatcacgttgccaaattaaccccatagttttttcaccggtgtgcacgctaatagccggtccgagctggctttgaacaagtcggacttcggggaattgttcagtaagcgtggcggtccactgagcacccagttcaggattattcgcattgataaccgtcacgacgagtggataatcgacttgctgtaaggtagctttcagcttagcaagcatgtagttaaaggctttgcgcatagtgcgctccttaccaatcgcaatgatttgaccggcgtcattaaaggtcaataggggcttgatatttaacaggttgccaatcatagcggagcggttggttagtcgtcctgttcgcgccagatgactgaggttttcaaccgcgaaataaacgtgcatggtgtcgcggagattctctaattcgggaacaatttcactggcagagtcaccattggcaaccatttgaccagccagaaggcaaagattagcttcgccagcgctggcaacgagtgagtcaaccggataaatcttggcctttgtgtaggtttggcaaaacatcttgaggttactcataaatgacgtaatcccacttgaaaggtgaatcgaaataatctcatcaaaaccagctgcagccaaccgatcataggcagtttcaatttggcctaaggagacttgcgcagtcgttgggagttcttgattggttttcaagtagtcgtagaaagtggcgaggctgagttcggattcaggatactggtggtcgcccaaaataacggtaatcggcagaactgtaatgtggtactgtgcgacctgctcagcggttaaatacgcggcagtgtccgtgacgatagcggttggcatagacgttccccctttgttcttcaaaaaatagttggatcaatcataccatattgattatcatttgcgtgtttttcttcaggataaacgcgaaataatactatttttgaccaaaaaaacaccactagctgtctggtaatagctagtggtgagcattgattaaacttagagaacgtgcaaattaggctgtaaagtggtggttgagcctaagtttggtgcataagttggttcagccattaaggattgttttgtcgcaattccttggctttcgcagacttcacagagtgcttcgtaagtcacgtcatttagcagtaatccgcattgagaaacatcacaattgaagataacggccgaaggagattgggtaatcttcatttcagcagccaacttctgatcggtcttgaatgcctgcttggctaggtcagaagaacaatcttccttaaacatatcaatatccaaatgacaggtttgagctaaagataaggctaaatcagtcgagaactgttgatgatccgcaacaacggctgtttgcatcttaagtagaaaatcacggcctttgcgtttaccttgaaataacgccgctttataagccaaaatagcattataatgaaccttgaactgggcattacgctcagctaaagtgggctgtgccggaagtgatcgtgccaccacctgttgtgtcaacaggggcacgaactgaaaggataccttgctattaagacgcgccgctaacttcataatgttttgttcggaacgcatacacggtgcgcccaatgggttaacgaacaaatagacttctaacacattgcttcctcctaatatccatcctggttggtgaccaaccaaaaaataacaataccactacattagcaaaatttcaaaaaatagcaactcggaacatttgtttgttagtaacttactcgtttaaaacgcaacctaatcatgcaacatttttccagataggtaaagctaaacgccttgtaaaaatgaaggggcgtgacgaattcataattagtgaagaaaaccacaagtcgttgaggtaattactctcgattctggttaaaatatggtagaatcgtaagatggaacgtgtaattaaagttgggggatagtcagtatggtaaccaattgggatcaatttttattaccctatcaacaggccgtgagcgagctgaaagtgaagttacgtggtattcgtaaacaatttgagaatcaaagtgaacgaccaccgattgaatttgtgacgggccgagttaagccaatcgctagtattaaggaaaagatgtcccgacgacacgttgcagaagaacggttggaacaagatatgcaagacattgcgggcttgcgcatcatgtgtcaatttgtcgaagatatttatcaagtagttgatcttttgcgacgccggactgacctaacgattttagaggaacgggattacatccacaatgaaaaaccaagtggataccgttcttaccatattgttattgagtatccggttcaactggtgtccggtgaaaaaaagatcttggctgaaattcaggtgcgaacgttggccatgaatttttgggcaacgattgaacattcgttaaattataagtaccaaggtgcgtttcctaaagcgttaagtgatcgactgcagcgtgcagccgaagcagcgtttaagctggatacggaaatgtctgaaattcgcgaagaaattcaagaagcacagcagtatacccccaaacatgatgatggcaccaccggttcgccggcacggccaagcaaggaagaatgatatgaaggtttccatttttagtaataatgggttgtcctctcaaaaggtggcgaccgctttacaaaaaggtttaacagcagcaggcgttccaattgatagtttggaccctgatgtggtcgtgacggttggtggcgatgggacattattgtcggcctttcaccattacaatgaccggctagataaggttcgctttgttgggatacatacggggcacctcggcttttatacggactggcgcgactatgaggttcaagagttaattgatagtctggcgcaagacaacggtcaaagcgtgagctacccgttgttgacgatacaggtagagtatgcggatggtacccatccagatcaagcattggcgctaaatgagtcaactatcaagaaggtctcggggacaatggttgccgatgtttatattaaggatgagttattcgaaagtttccgaggagacgggctgtgcatctcgacgccaactggttcgacggcttataataaatcagtcggtggtgcggtgttgaacccacgttttaatgccgttcagatggccgaaattgcctctattaataatttggttttccggacgttgggatcgcctttgattattccggcggatgagtggattcgtatcgagccggctgatccgactgacaacgtgttgatgtgtgatcagttgggaatcgagggccgaccaatcaaggccattacgtaccgaattgcccggcagcggattgcctttgcggagtatcggcatacgcatttctggcaacgtgtggaatcttcctttattgggagggagaacgcatgatgacatttgaatggcaagtcactggtgaaagtcccgtgcacgtgcggaccgtgttaatggcccacggtgtcacgcggacttttttaaaacaggtgaagttccatggtggtgtggtaacgttggatggtcaaccggtgcgggtgattgcgatggctacgccagggcaagtggtcggattgcaattaccaccagagccagataacccgcacgtgacgccgtcgtttgcgcccttagatattctgtatgaagatgagcactttctggtcgtcaataagccagcagggatggcgtcagtgccctcgcacctctattcggaggatacgttagcgaatcgggtcaaagggcatctgctgacgattcaagcgccgagtacggtgacccatattgttacacgattggatcgagatacgagtggcgtggtgttatttgccaaacaccactttgcccactcagtgttagacaagcaattaaaactgaaacaaattgataagcgttatgttgcggtggcaagtggtcggatgatgccggctcatcagcagttgacgggaccgattgggcgcgaagcagggtcctttattaaacggacggttagaccggatggacgagctgctgaaacggaggtatgggtgcgagcaacgtcagcaacggcaagtctattggcggtcaagctgcatacggggcgaacacatcagatccgggtgcattgtgcaaacgcggggcaccccttattaggggactggttgtacgggcgaccaactaatccgtggattcagcgacaagcgttgcactgcgcccgcgtgcagttttttcagccatttgcgggtaagtgggtaacctgttatgccccgttgccagatgatatggcgcgagttatttctcaagaatttgatagttgattaactctaaaaaaggtggagctgggtaaaactggagttccgctagctgcggcactttcagcaattagtgctggttcatggcggcttattgatggtaaacgccggaaacgcgacgatgatcaataaccaaaaagaaagagtagtcagtgagctactagcgaaaaaggccatgcttaattgcgtggccattttcgtgtttatgggtggattaatgttgaaatgttaaaatcacacatatcggtaaatgtgagcataatgcaatccttgtggctagaggtaattgggataaataggccttttaaatttcattttaaaaatgatgcattttttagtaaatactgaattaaattaaaaaacaacataatgaaagagacaccagtttgaataagaatctcgtaatcgcgtatttttcactagttttgataatatggttgtgataaatcagattttaagtaataataatttgacaaaactatttcgcagctgtattagtatgtagagcaaaactatgctaatataaatttatacgagcaatgaaccaaaaagctgattgataagctatgtaaaaggggttgccatctgactaggaggatggctgtccaatggtcgacgaaggttcgcgttggtggtaataatcggtatgaagaaaagcctaataaaagattttaaagcggctatggaaaaactaggaaatatgaaggattatgcaactgacagcgttacgttagcggtatctatttccgatcgacggcaccgagctgatgtaaaatttattcgtgcggtgagctttaagcatgcttgggaaccgattgaagggctattagcgaaagcaccgcagaatatttggattagaattgaagtcatccattcggttcaaagaaaacggcgcgctcagttagaacggattttacatgagatgacgcggatgaattactggcggcaaggtgttagctttgatgcagattttaaaacggccctcttagagatgtgtaggtaaaggacgttcggagtcgtggattgattatcagcaagttactaagtatctgagacggcgaaatggacaactaagttttgatattgagagtagcgagtatgtttggttatttacgacttctggtatcttttctgatggtgagcagatttgggtgttaaatgatacagagacagcggaaaagggagtacgacgcttagaaaatcctaaaaaggaattacagtcttacttagtagcaggtgaggctttcttgactcggcaaattaaagaagacggtaagtttatttacggatattatccgggacttcagcggattttaagcaattataatagtgttcgacatttttcctcagtatatgcattattggaagcgattgattttactggaaactatgaggatactagacgagctaagaaaacgctacaatgggggatagattaatcaccagcatgaaaaaaagccattgttgtttgtggtagaaaaacggaaacagggaaccgatgaaattaagcttggcgcccaagcaatgcttattttggccctatgtaagtatcaggaggtcacaaaagatgctagttttttacggcgacttatggaagcattcaatgcagttgtgttcttccgtcaaaagtctgggcgctataatcatgtattaaatactgatttaacggtcaaagatgagtttcggattatttattatgagggtgagattacattcgcattggcccggctctacgaactcactcaagataaacaggtcttaaaaatggttaagcaatctttagacttcatggttgataatgattatggcaaatatcatgaccattagatatcttatgtagtaaatgagtccttgcagattcttccgaataatcgagagtatatgaagttgggccttaagaatgtttttagtcacctagattttattacgaagcgagatacgtcatatccaacgccgttggagctaatgaatgttgctgtgaagatgacggatatcatcaagcttacgggcaacgatgatttgttagagacgtatgatttaattcgattacgaagaatctggaagtatcgagttgaatatgagctggcaacgggaagcttccagccagaattagccatgtatttttatgcaccatataagtttgttggtggcttttttgcccggcatgatcacttccgtacgagaattgatgactgtgagcatttcttatccggattaattaattactataactatacgtattaaggaaagggttaagccatgattattctgacgagcattttcgcctataagaaggttcaatttgccattcgaatgtcgctttacgtcatcttttgtgggttagtactgtttgtgcgcttcaagaacaagaagaaaacacgtaaacggctagataaaagaacagagcatatgatgaagaacacccctaaagacaaagatggcaaatatccttgggaaaaaaagtaagcgctcaataactatgaagaggagtgttaggccgtgttttattttattaatgaatacattctgcaaaagaattctagtgtagaacacactgcgattaatcgggtgaaactatttacgcactataagcaaccagctaagattgtcacaaagatttatgatcgtttgctgcatcgaacgattactgactttagtctgacagatgagcaagtgataaacatgtttgattattttcaggaagcgacggatttaaaacaatctgtttttttgaaagccgacgacattcatttaccaattgactatgaaatctcagtcggtgcgaattatagtcaagtgtctaatggagatacattggttgaaaatgtgggcttcattcccggcactattgggcgagtgttttatcaagaattttttgatccccaaggtaatcgaattgaaacagatctatgggactggcgaggattcaagtcagcgacgcaatactttgggcagaatggcaaattaattatgcaacggtattacacaccaactggtaaaaatgtgctggaagaatactatgcaccagatactcaaggcaatccactactatcacgagtgattttaaagaattatcacggtgagggagatcgcttcttccaaaacagtgacgatctgttcgtctttttcttaaaagaattgagtaaacaagctgaagggacgactaccttcattagtgatcgaccagggaccggagttaaaccgctcttagcgttagatgacgcttcccgtaagtatgtatacattccaatcaatcatgctgttaatccgaatgatccagttcacgcggatttggatggcttcttacagccggcctttgagcactttaagcattttgatgggtttattactgctacggtccaacaagtagaacatctctcggtgcgttatccgactgccaatatttttgcgatgccggcggcgacaactttgccgttatccaaagaggctgatgatcaggttacaccggaccagcgtaaacggcatagtttactgtacgttggtcggatcgcacaagataaacggattgatcaattactgcggatgttttctctagttaaggatcgtgtgccagcagctacctttactctgtttggatatggtgatcctaagtatttggaagatatgcaaaagctaattactgaattaaatctggaacataatgttaccttgaatgactacacaccaggtattgaaagtgaatatgatcattatcaggttttggtaaacatggcctttgctgacgggggtccagttgcaatggctgaggcaatgatgcatgggttgccagtcgttagttatcgatttaactatggaccggctgaatatattgatgaaggcgttaatggttatttgattgattccggtcagagtctggcaatggctgaaaagattgttgatttatttaatgatgataagttattggctgactttagcaaggcagcgtatacgtcagcgcatacgcgatggactcgccgtaaggtttggaatcgttggcaacgtaatctgaaaacctcattttaaatttgcctaagaagggaagacatctggtatgtattatttcttgaacgataacatgcaatattctaagtcggggattgaacatgcagaaatcaatcgcttagatctgtttaaaaagcatcatgtccccgctaaaattgtgacacgtgtgttttccatgaaattagaaaatgttttacagcagtcgggtattgcacgtgaagactttattaatctgtttgaattcttttgtggcagtatgcatgtggctacaaagacttttacgatgaatgatctatcgctaccggttaataccacttccacgcgtaaagataatcaattgcagattttcagccaaggaaagatgctgatgattatttacttccgtcaaaatagtgaagaaattagtaatatccagtactttgacgtcaatggtcgaacactgaagatgacctggtgggacgtacgaggttttaagtgtctagaacagtattttgactgggatggcaagatctcacaagaacagtactttggtcctgatggtcaggttcatatcgagaaaaatcacttgttggatcgtacgggtaaagaacgcatttcttggaaggttgttaactaccatcaaggaagctgggtttttacagggatgaatgatttaactcgatttttctacgatgagttgaatgcgaatggtgaagacaatgtctttatttgtgaccggacagtggaatgtgactgggggttgttccacatgcagacgccggcaaagaaggtcttgcatctgcataacgatcatgttagcgatccaagtgatatgttgcactcaaccttgaataataattatacgaatgccttgaataattgggataagtgggatgcggttatttctgcaacaccagaacaaagcaaggatatcgaagaccgttttggtaagagcatcccggcctttaccattccagttggctatgtgactgatgcggaaattgcggctaagcatcaggactttgaacagcgacaaaaggggttgattgttcacgtggcccggttggccccagagaagcaacaaaatcattccattcaagcctttgcgaaagttcgcgaacagtttccgaatgcgcgtctggaactgtgggggtacgctaacggtgatattgaaaagcaattaaaacaacaggtagcagatgcgggattgaatgacgtgattagctttaaaggctatacaacagatgtgaatgccgtctataatcgtgcccaaattggcttgctgccaagccgcgctgagggattttctttgatgttgttggaagcccagtcccacggtgtagcgatgattgctaatgatgttaagtacggcccaagtgatattattcaggatggtgttagcggtattttgacggaagatggcaagccagaacaattggccgaggccatgattaagctgttggatgatcagtcgttactgaaccagtacagtgatgcagcttatgagaatgctaagcgttattcagaagatacggtttttgagaagtggcaaagattactagattactttggctaaagaaaatatggtggtggctttaattgattctgtctttggaggattgttgtatgaactattttattggtcagaatttaggggatagattgactggtattgagaaggcacaactgaataggctgaagctttttgaaagcaagaaacttaaggcaaagtgtgtttatactgagtatagtggacgattgtatgaacacacaacgcgttttggggctacggataattgttttatgatgtatgatttctttcggtgatattcattcggaatcccattaataagaaaaactgtgaaagatggctgatttggcaatctttcacagttttttgatagtgattataaatcgatcacagctggaccagcaatcaaatggacgtcaagctgctgactaattttggcaacttcggctacagtgacatctgttggcactaacgttaaaccaacagaatctgccaatcgtttgctagccgtccagtcggcaagccggtctgttgagttaccagcgctccagatccgatcaaatccttggtttgctaaccaatcaatggccgtcccgcggtcttgtggacgaatctgatcaaatgctgtgctgaacgtgaggctcataccgcctgctgccgcaatcagcggggttagggcttcggtatcgacctgttgttgatcagtcaaagcacctaagatgacaccatctacacccagttgttgggcctctagcaggtcagcttccatcattttaatctcaacgtcattgtaaggtgacacaccgccacgcggcgcaatgaccaactctatgcttacttgatgttcatgggcatatcgaacagcttcacccatcacgcctttactaacggtggttccgcccacagctagattatcagctaatgcgacacgcttactaccagccgctactgcgttgggcaactgcacatagttctctaataaaggttctgttaatagcaaagttgacatcctctctaacgttcccgctttagtcacagcaggtaacagtatgttacaatatatgcacttaaattaattcagattaggagggacaattaatgaaagaacccgcgaagcaacggcgctcttggttctggaattgggttatcaacaatcgcctagtttccgtcctaaccgtcatacttcttattttactcattttattagtcttaagtaaagtcccttggctcgcaaccccctttgtcttggtgggcgagatcctcggtttacctattgtattagcaggagtcgggtactatctcttaaatccgattgtggattggctggaaacgaagcatgtgaaacggacctggtcgataagtggcttatttgtgatcgtggctgggttactcgcgtgggggattatcagcttaattcctatgattcaacaacaagtaactggattgatcacggagtggcctcattactggcgtgaaattaccaatacgaccatgcattggctcaaagatgatcgactagatggtattcgaaaacagctagagcaattcaaccagcaattgtctgacagttcttcgtccgcgatctcaagtctggctaagaacaccgtcagctccgtgggcgggattgtgagccgcgtagtttcaattgctgttgcggtggtgacggcgcctttcattctgttctatcttttgcgtgatggtcatcgacttcctgagtacttggcacgattatttccaattaagcgacgagaagacgtggttcatctgttacgggagatgaacttacaggttagtaactacgttcgaggacagttaattgttgcctttatcgttgcgatcatgttttatattggttttctcatcatcggtctgccatttgcgctgttgttggggatttcagccggtattttgaacttggtaccgtatctggggtccttcttggcgatggtaccagttgtcatcgttgccgcctttatttccccgtggatgctgataaaagtgctgattgtctttgtgattgagcaaacattagagggacgagcaatttcgccacttgttttgggtagctctttgaagattcatccgctaacgattatttttatcttattagtggccggcaaagcatttggtgttgttggtgtggtgctgggaatcccaggctatgccgtgattaaagttattgccactgagtttttccagtggtatcagaaatttatcggtggatatgaagccactcaaccggccgataaaggcaatcaaggagtcgaaaaaaatgaagaaaattgaccaagctgccgtttttttggctgctcaaccgggattatttcgttgcccagtctgtctaacaccgtatgaggccgtcgtgggtcacagcttgcggtgtcccaacggtcatggcgtggatttatccaaaaaagggacgttatactttatgcaacgagcagtggccagtgaatatgacaatgcgatgttagctgcacgacggcggatgcttcaagcgggcttgtttcgtggaattacggatgagtttgtcgcccaccttccccaaatgtcacagacgattttggatgtgggctgtggtgaaggaacaccattagccgatgttttacgccaacggaataatactgaagatgtagcgattggtttcgatttatcaaaaccagggatcaatttagcgacgcaactagctagtggggccttcttctgtgttgctgatttggcgcagatgccgtttgccaaccagcagtttacggctattttagatctgttctcgccgtcagcttatcaggaattcaaccgtgttctggcaccagggggacaattgctcaaggttatccctaacgctgattaccttattgaattacgtcaggcaatctttcctgcagggagcactcatgcaagttatgataacagtaatgtgttgaacctgttccagcagcattatcccatggccacaacacagcgcattcgctatcaagtgccggtgcccacagaattgtttgcggatctcatgttgatgacaccgatgcactggggcgcagacgagtcacgcctagcagaagtgcgggctaatccgtttcccgcaattacggtggatgtaaccctcctaacggcacaaggggtttaggtaaaacgtttaaaaatcttaggaaaaggacttgcgaagctgacagcagcgtgttatattgactcatgagaaatcgtttggcggtcgatatcagcgtttaactgttagcggcagacaagtagcacttcactaaagtagttcctcgccgtgcccacaccgaggagctgctttttttgtcccattaatttgataacagatgggcatctcacgttgggacacctcttgtcaaacactagccgaaatggctataatagtgagacagaacgaatgtttgataatagatcggagaagagaattttatgactaaccacattgcgctatttgaaccgttatttccagccaataccggaaatattgcccggacgtgcgctggtaccgacaccattttggatttaattaaacccttggggttttctgtggatgatgcccatcttaaacgggctggcctggattattgggacaaagttgatgtccgctatcatgaaaacctaccagcttttctagataccatttcagatttgagccaactatacttagtgtccaaatttgcggatcaagactatacggagccagattaccaggtgaatgagcatgatcattacttcctatttggtaaggaaacaactgggctaccagagccctttatgcggcagcatgcagagaagtgcattcggattccgcaagacgacacgcatattcgggctttgaacttgtctaacagtgcggccattgtgatttatgaagtcttgcgccaacaacaattcttgaatttagagcgggttcatcagtatccccacgataagctcaagtaagtgaaagggggcagttgattggctacgaaacgaaaaacaccccgccggcgcccaactaagcgcaaaccagcccatcgcaagtcagctaaacgacaaccatttccctatacgagcaatgtactaggcctagttttagttgcgcttgccatgctcggattatttaatctaggggttctcggcacattagcagctaatatcgtgcgactctttttgggtgacacgtatcagttcggattagtgattatcggggccttaggcgttgctttgacggtcactgggacgtggccgcagttagcacggcactatctgattggcagtgcgacgatttacggtggctggctcttgtggatcagtgcgaaccattttatcgatgctgatcagcaccggcagtttatggcaaccatttggcatgcgagtctggcagacttgtggagtggtggactaacctcacaactgggtggcggactaatcggggcctttgaattaagcattgttgcgtggttgattgcactgctgggtgcccagattgccgcttggctaattatggctggtggtgtgatgattttcttccagattccctgggccaaagtcgagcagggattacagaccgtttggcagatggtgcatacgggtgtccaagctagtggaaccgcattgaaacggggcagcgagctggctaagaaacgacagaatcaacgaccatcgaagccagcttcggtggcaccagcagtgacgccaatggatccagatgataaggacttgccagaaccaattgcccaagccaaaccagcggctgaagaacccagctatcatatcacggtggcggccaatgaatcagctaaggcgccagtcgcaccagctacgacttcttctcatgaagaggacacgaccgcggatgcgttggctagcagtacaccggttgatcccaattatcagttaccaacggcggatttgttgaaacaagtgccaccaactgatcaaacggcggaggttaacgccattgatgcgaatactaaaattttgaaacaaacgctggatagttttggcgttgatgctgaagttaagaatgttagtttgggaccatctgtgactgagtatgagttgcatccagccattggggttaaagtttctcgaattgtgaatttagcggatgacttagcgttggccttagcggccaaaggcatccgaattcaagcacccatccctgggaaatcactgatcgggattgaagtgcctaatcgggaagtctcgacggtggccttccgcgatgttgtcgaagcccaaccggctcaccccaaccatccgttggaggttccgttaggacgtaatgtaacgggacaagtggtcaccatggatctaacgaagatgccacatttactgatcgccggggcaactggtagtgggaaatcggtcgccatcaacgatattattaccagcatgttgatgaatgcacgaccagaccaattgaagctgatgttgattgatcccaagaaggttgaactgagcgtgtacaatgggattccacatttactaacgccggtggtttctgaacctaaaaaagcggcccgagccttgcataaggtggtggccgagatggaacggcggtacgaattgttctcacaatttggtcagcgtaaaatttctggttacaatacctttgtgcaaaaggctaacgctgaagacgggcaagaacggccgttactaccatacattgtggtggtggtcgatgaattggctgacttgatgatgacggtttcgagtgaagtggaagatgccattattcgcttagcccaaatgggtcgggcggctggtgtgcatatgatcttggcaacccaacgaccgtccgttgatgttattaccgggctgattaaagccaatgtgccatcccgaatcgcctttgccgtttctagtggaacggactcgcggacgattctcgatgctaacggggcagaaaaactacttgggcggggcgatatgttataccaaccagtagacgccaatgctccagaacgggtacagggagcttttattcctgatgaggatgtcgctaacgtggttgactttattaaggaacagcaaccggctgattatgatgacgatatgatggtcacggacgaagaaatacagcaagaagaagctggtgacagcaatgatgagctgtttaacgatgccttgagcttcgtggttgagcaacaaaaagctagtacatctttgttacagcggcgctttcgaattggatacaatcgggccgcccggattatggatgatctggagcaacgtggttatattggaccccaagagggaagcaagccacggcaagtctataaacaaccagacagctctgctgatggaccaacgcaatgatcaaataaaaataggtgtcaagtccatttacggacttgacacctattttgtgttggtaattaccccatcaaacctaatgatgaaatggctccaaagacgagtgaaccaatcgttgcgagaatcatgatccagacgaaaacgttcgtaattttttgaaatgttgattttttcttcttttccatgtggaaatagccacctctttgcgtctaatttactcaattagtttaccgtggctaccgcagaattgcaaccggcagggggaagttgtcaagagcttgttacaaatggcgattgcaactctcatgggaaatctctataattaaacggaaatcaacgtgtaaggggatatgaacatggcgttttggatcacacctggtggtcagctcgtaattttagttgtaggatggctattaatccaggcggttaaacggattttgcggcgaaactggccgaagtatttgaatacatgggatctaatggcgccactactactgctttgttcggtgttgttaatccctaatggtgctggagccatcttgccgtggttggttataggttggatgggaatcggcatcgctgtggcgttattgcaggcaattcacaacaaggagttactttatgggacctttttgcgaacattctggcgtttgactgatctttattggacagctggttttgcctgctgcttcttactggtaatcagctaagatggctgtataaatgcataaatattaagttaattgattatctactcattttaagtaagcgctgtgaagcgtgttaagccatggtgaacacctgttcgccatggcttttttgtcgttggtggggaaatttataaaaattcggaaacgttgtggtagaaagtgggggggtgtggtaaacttgatagcagttacagttgggagtgattggccatgtttatgggtgaatttgaacattcagttgacaccaaaggacgactaatcattcccgccaagtttcgggagcaattaggagaacaattcgtggtcactcgcgggatggatgggtgtttgtttggctatccgatgaccgagtggacggcattgcaagaaaaattaaaagcgttgccagtcaatcgcaaggatgcccgggcctttgtccggttcttctactccgctgcaaccgaatgtgaacttgataagcaagggcgcattaatttacccaaatctttacgagaccacgctgcgttaactaaacaatgtgtgattgttggggtcgcaaatcgatttgaaatttggagtgccgaacggtggaatgatttttccacgaaggctgaagaagattttgacgatattgcagaaaatttgattgactttggtatgtagcaattacagctatctagaaaggagagtgttcatggaggactttcatcacgtcacggtattactaaaagaagcagttgcgggtttagcaattaaaccaacgggagtctacgtcgattgcactctcggcggtggcggccatagccagcgcattctggagcaattgacgaccggacacttatacgcctttgatcaagatcaaacggcgattacttacaatgaagaacatttgaaaacttatctagatgccggcaaattgacatttattaaaagtaacttccgtcagattcaaacagaattaacggaacgcgggattacccaggtggatggtatcttatacgatctaggtgtctcatcgccgcaatttgatgaagctgatcgaggatttagttaccaacacgatgcacctttggatatgcggatggatcaaagccaaaagctttcggcgtggattgtcgtgaacgagtggtcatttaatgacctactacgaatctttcatcgatatggtgaagaaaagtttgcgaaacccattgcccgggcgattgaacgacatcgtgagcaagcgccgattgatacgaccggtcagctggttgagattatcaaagaaggtattccagcggctgccagacgacatggtgggcatcccgcaaaaaaggtgttccaagcgattcgcatcgcagtgaacgatgaattgggagcgctggaggattccttagaacaagcggtttcgctactggacgtcaatggccgaatcagtgtgatcacttttcaatcgttagaggatcgattagttaaaaccatgtttcgagaacaatcatctctaccggaactgcctcatggcattccagttattccagataatttgcaacctgattttaaattggttaaccgtaaaccgattttgccgtcagaagaagagttggcagttaaccaccgcgcgcacagcgcaaaattacgaattttagaaaaaattaagtaatgagtggcactcaaataaatatcgacataggaagatgataacttatggcgcaaaacagcttagcagaagccgttccgtttaccgcggagccgcaacaacgcccaaacatagaacaacccgaacgacaaacacgacaggccccacagcagcacccccaaggggagaagctaccggtctccaagtttgaaaagtgtttaatgaccgtttgtggattagctttggctttgttgatggtttgtgtggtatcgtctaagattgcaatgagtacggctgaacatcacttacagagcattaataaccaagtgacaaccattcaaaatcacaatacgagcaagcaacaacagattaatgagttgcagagtcgtagtcgacttgataaaattgctaaaaaacagggtttgactctcgaaaatgctagaataaggaatgtaaacaaataatgaaagattcccaaaagcgacaaacgatgaataagcaacccagcagaaaccgcaagagtgttggtcggtttctgttttacatttttctcggggtgtttatcctcatcgtcggtcgcttttcgtatatctccatcggcaaaaaggtccaaaacgttaatttgagtcggcaggcacaaaaactgtatacggcaaatgaaacgttaaaggccaaacgcgggacgatttacgatgctaacggccaggcgattgcggaagacaccagtgtgtattcgatttatgtggtgctggacaaacggcaggtatcaacgagtggccaaaaactctatgccacaaataaagagaagattgcgaccgtgttagccaaaaacttaccgatcagtcgcaagaaagttctgaagattttgaaccctagcaaaaagaatacgttccaagttgaatttggaacggccgggcaaaacatttcgttgatgacgaaacaaaagattcaggcggcccacttgagtggggttaactttgtgcaacaagaagctcggttatatcccaatggggtatttgcctcgcatttaattgggttggcacaatcgacaactaataagtccgggacaacgaagctaactggaaccatggggattgaacaagcgtttaatcagcaactaacgggaacgaatggctcacaaaagattaagaaagatatgtatggttaccagttgcccggaacgaaacagaaatacaaaaaagcgaaaaatggtgacaacgtctatacaacattggatacccgattacaaacgctgttggaaacggaaatgtctagcgttcaaagtcaggtccatgccaaatcaatgaatgccgtcttaatgaatgcgaaaacgggcgcgattctcgcggcaacacaacggcccacgtttaatgcgtcaaccaagtcgggcctcagccaaatttggcgggatacgttggttcaggatgcttacgaaccggggtcaacgatgaaaatcttcacgttggcttcttcaattaatagtggaaattataatggtaacgcgatgtatcaatcagggaaatacagaattgggacccagacagttcccgactggaacacgtccggatggggcacaatcacgtacaataagggatttgctttatccagtaacgtggcaatggctcatttggaacaacagatgggggctaaaacctggcgtaaatacattaatcgtttccgcttcttgaagagcacgaagtcagggttacctggtgagttgacaggaagtattgcctttgaacgcccaattgagcaagcagatacggcatttggtcaaggaattcaggttaccgttttccaaatgttacaagccttaacgtctgtcagcaataatgggacgatgatgaagccgtacgtgattagcaaagtcgtcgatcccaatacgaataagacggtcaaaaagtattcaccaactgaggtgggtaagccaatttctgccaccacggctaagaaggttcggcagcatatggaagacgtcgtgtataagagctacgggattggtagtgactacaagatggctggcgaacgagtggcggttaaaactgggacggcacagattagtaacggcagtgggtacctaaacggtgataataattacttgtactctgttgcggctatggtgccagcaagtcatccgaaatacgtgatgtatattacgatgaagcaacccacgctggggagcaaaacggcgactaagttattggcgtcgatcatgaagccagttatggcgcgggctttgcaagaagatacgcaaaccaagcagactacaagcaccaaaatgccatcggttgttggtcaaagtgccactagcgcaaccacgaaattgacaaaggccaatacgcaagtgacaacgttggggaccggtagcaaagttactaaacagtctgtcgcggccggaaccacactgtattatgatgaacgggtctttttaaccacaagtggtgcggttagcatgccaagtttaaccggctggtcgaagggcgatgtggtaaaattagcacagttggaaggtttgaagctgactgtgtcaggtgacggttatgtgacgaagcaaagtatcaagacggggacgaccctgtcagcgaatgacaccttaacggttactttgaaacaaaataaatgagaatgaggattgagtaagacaatgatgaatatactgttgcccctgttgggtggatttataattactgcggcatttatgcccgcgttgatccggtatttccgggcacggcatgaaggtcaaatgattcgtgaagaaggcccaacgtggcatgagaaaaaatcgggaacgcctacaatggggggcctcctattcattgttgcgattgcggtaatgacgctattgaccagctgggtactagcgcctcatcatatgttaccgacaacgtggattttaatttttatcctagtactctacggggcgttaggcatgtgggatgacagtattaagttattccaccgacaaaatgaaggtctaaaggcctggcagaaaatgctggggcagatcgttggggccctcattttgttttgggtctacacgcatgaacagttaccaatggcgctacatgtgccaggaattggtaactggcacatgagtggctggtatgctgtgtttgtcatcctctggttggtcggctttagtaacgcggtgaacttatcagatggattagacggcttggtgagcgggttagccagcattgcctttgcggcgtatggtattgtcgcttggcaacaggcccagattaatattgcgattttctgttttgccgtagtcggcagtcttctcggatttcttatcttcaatcacaaaccagctaagattttcatgggtgataccgggtcattggccttaggtggcgccttagcggcagtttccatcctgttgcaccatgaattatccctgttatggatcgggctgatatttgtgatcgagacggcgagcgttattttgcaggttgcctcatttaagctaacgggtaagcggattttcctgatgagtccaattcatcaccacttcgaaatgaaggggtggagcgaatggcggattgatttgactttttggggtattggtttggtcacggctctgagtggtgtttgggtgatcttggcaaagtaagttttggtcgactaatgggctaactggctcgttaggagtcggttagtccttttttagtgaaagtaagtcaattaacgatgaatggagagcgaacggttattatgaaacatctcacgacatatcaaggtaaaaaagtcctcgtattggggttagcaaagagtggtgtcaatgcggcgcgactattacggaaattgggggctcaggtcaccgtcagtgatgttaaaccgttggctgaaaatcaggacgcgcaagagttacaaaacgacggatttacggtaattacgggagaacaaacagccgatctattagatcccggatatgatcttgtcgttaaaaatccgggaatcttttatgatgtgccggtggttaaacgggcattggctgataaggtgcccgttattagtgaaatggaactggctagcgaagttgctgaagccgaactgattgcggtcactggtagcaacggaaaaacgacgacgaccacgatgatccaaaaaatggttgaccatgatcggcgtgctggcaaggctgtgtacgctggaaatattgggattcctgcgagtcgggttgcccaagcggtgacggctgatgatacgctagtattagaggtctcgagctttatgctggtgggaacaaccaccttccatccccatattgccgtgttgaccaatatcttctccaatcacttggattaccataaaacacgggaaaactatgtcgctgctaagatgaagattacggctaaccaaacggctgatgattactttgtggtaaatttcgacagtccggaacttcgcgagcttagtgaacagtcagcggcgcaagtagtgccattttctcgggaagcacggtcgcaagccggtgcttatgaattgaatggtgacttgtatttcaaagacgagaagctaatggcggccagcgatattaaagtccctggtgaccacaacgttgaaaatgcactagcagcaatcgccgtagctaagatcaaaggggtcagcaccgcggcaatcgtggctgtattacgtagctttggcggtgttcgccaccgaacgcaatatgtcttagaagcagacggtcgtcaatactataatgattctaaagcaaccgatatggaagctacagagatggccttgaaggggttcactgcaccagttgtcttaatcgctggtggattggatcggggctatacgtttgagaagttggttccttcattgaaggcccatgtcaaggccgtagtgctggttggacaaacggcgaaattattagaagatgccgctaaaaaagctggcattcaaacgattcgactgagcgaaaatgtagagacggcagtgcctacagcttacgaactgagcgatgccggtgacattatcttgttgtcaccagccaatgccagttgggatcagtatccaaactttgaagttcggggcgatagatttattaaggcggttgaacaattaaccggcaaacaggaggaaaaataatgcgattaatggtatcaggtggtgggactgggggccacatttacccggcacttgctctgatcaaggcgctaaaaaagcgcgaaccgaattccgcagtgatgtacgttggatctgagcgtggtttggaaagtacgattgttccggctaaagggattccatttcaagcaacgcgcattcaagggtttaagcggtccctctcgttagaaaatttcaagacagtctacctgttcttaaagagtgttcacgaggctaaaaagatgattcggcaatttaaaccggatgtggtcgttggcacggggggctatgtgtcaggggcggttgtctatgcggcagcccggctacacgtgccaacgctgattcacgaacagaacagtgtggttggcattacgaaccgctttttgagtcgttacgttgatcgaattgcctacgtctttgacgccgccttagatcaattgccagtgaataaaatggtcaagactgggaacccacgagcgcaggaagctgctgaggtggtcagtcactttagttggaccgagtatggacttcaagatgatgtgcccacattgctgatttttgggggctcccaaggggctttgaagattaacgccgccacggttgcggcgattcctgaatttaatcatcgtgagtatcaagttgtgtttgtcactggacagaagcgctacgacggtgtgatggcccagttaaaaggtacgactgttgcggataatgttgtgattaagccatacattggaaatatgccggaagtgttacctcgggttgcggccattgttggtcgggctggggcaaccagtttagctgagatcacggctgatgggattccatcaattctgattccaagtccgtatgtaacggcggatcaccaaaccaagaatgcaaattccttggcaacggtgggggcagctgagatcattaaagaagctgacctgacgggtgagacgttaattgcaaaggctgatcaattaatgaccaatgatgcgttgcgacaagacatggcaacggcctctaagcaacttggtgtacccgatgcggctgatcgggtgttggatgtggtagaagctttgaaacgtgactagaccaatttcaatgagataggaggtgaataatcgtgaaattccggctaaaccgtcaggagtctaagcagcagcgttctttgacgccttgggagcagtaccaggaacaagcaaaacaaaagcgccgacagcagcagcgtcaggcgcgaacgcccaaatggtttcaccaagctaaacggattggtgataaattaccacggctcaagcatcaacgaaatcggcagttagttcggcgactggccattctattaacgagtttcacggttgttatcctagctatggtctatctggtatcaccattgagtcatttacaacgtgtgcgggtaaccggggcgcatgcgctatcggttcatcagattcaaacggcgaccggtgtgctgccaggcgattcgatttttaacgtgatgggtcacgaaaagaagttgcagcaacaggcgttgcaacgaaattcgcggctaaaaaaagtcacggtccagtttcatttacttaatcacgcgaccattcgagtcacagaatatgtgactgcgggctatgtgatgaggcaaaatcgttactatgaggtactagaaaatggtattgttagtcaacagtcggtgagccagcctaagagtggtaccccagtttacgggcaatttaagacgaccaaacggctacaccgaatgattttgcagtatgctaagttagatagtgacattaagagtagtatcagtgaaatccaagattcaccgactaaaagtaatcctgatcgcgttcatttgtttatgaatgatggcaacgaggtttacgctagtattcccagtttcgctaagaaaatggcctattatccaagcattgcggccaagatgaaacaaaagggtgtggtcaatctggaagtgggcgcctactcatatgcgtttaaaaaataatttcattttgattgcattgcgtaaaaaagcgtcatttaggctttttcaacccctatcaagtgtgttaaactgaaaattattagggaaaaagcgaattcatgcagtgttataagatcattaacttaggaggttcctttttctatggataattcagggatgtacgttggcctcgatataggaaccacctcaataaaagtcattgttgctgagaatgttaaagggcaaatgaacgttattggtgtgggaaatgaacgttcgaatggtgtcagtcgcggggttatcgtggatattgacaaggcagcggaagcaattcagcgcgccgttcgacaggccgaagaaaaggctagtatcgagattcacgatgtgattgtgggaattcccgcaaatatgttaaaaattgaaccttgcagcggcatgattgccattgacgatcagtcacgagaaatcactgggcgtgacgttcggagcgtggccacggcggctttgattcaaagcctgccgccagaacgagaagttgtggatattttagccgatgaatttgtcgtggacggttttgatgggatcaaggatccccgtggtatggtgggtgttcgcttagagcttcatggtaccttattcaccgggcccaaaacgattatgcacaacacgcgcaaagccgtagaacaagccgggctacatctccgcggcacggtaattaatccgatggcgcaagggatgatggtgatgaatgatggtgagcaagactttggcacggtcttgattgacttaggtggtggccaagcaactgccgctgtgattcatgatcatcagcttaagtatgtggacgtggatcaagaggggggccaattcattaccaaggacatctccgtggtcttgaatacgtcactggacagtgcagaaaagctcaagcgtgactacggctatgctgattcaacgcaggctagcgatgaggatgaatttccggttgacgtggttggtcaaagccagccaacgccaatttcagaaaaatacttagcagagattattgaagcacggttggaccaaatctttaaacgactacgtgctaatttagataaggtacaggctttggaactgccaggtggcattgtgttaactggtggggtagcagctttgccgggcattacagatctggcaacggatgaatttaataccaatgtccgggtttacgttccggatcagatgggattacgtcatccatcattcactttggctttagccttggtgaactactatgggggactgagtgaaattgatttactcattaagagtgcattaacgggctccacccaattagccgatgaaaccgacgagattcgtcaacgcgaacaggttgctgaagatgcggccaacgaagcggcgcaggtaactcaaggcaaatcagcgaaaccaaaacagaagaaaaatcggaccgaaggcattaaaaagttcttcagcgacttcttcgactaacctgagatggaggaatacacaatggaatactcattagattctgcgcagaacaatggcgcaatcattaaagttatcggtgtcggtggcggtggaaacaatgcggttaaccggatgatcgcggaagacgttaagggtgtcgagtttatcgtcgctaacaccgatgttcaagcacttgaggcctcaaaagccgaaaccaagattcaattaggaccgaaattaacgaaaggacttggcgcgggtgccaatccagaagttggtgccaaggcagctgaagaaagcgaagaagcaattaccgaagccttggatggtgccgatatggtcttcgttactgccggaatgggtgggggtactggtaacggtgccgcaccgatcgtggctaagattgccaaggaaagcggcgcgttaactgttggtgtcgtgacccgaccatttagttttgaaggcccacggcggggacggttcgctgctgaaggggttgcccaaatgaaggaaaacgttgatacgttgatcgtcattgctaacaaccgcttattggaaattgttgacaagaagacgccaatgatggaagccttccaagaagctgacaatgttttacgtcaaggggttcaaggcatctctgacttgatcacgagtcctggctacgttaacttggactttgctgatgttaaaacggttatgaaggatcaaggtgcggccttaatgggaattgggtctgctaatggtgaaaaccggacagaagacgcaaccaagaaggctatctcatcaccacttctggaagtgtcaattgatggggctgaacaggtcctgttgaacatcactggtggtcccgacttgtccttgttcgaagcacaagcggcctcacaaattgtgtccgatgcggctacgagtgacgttaacattatcttcgggacatcaattgatgaagatctgggcgatgaagttcgggttacggttattgccacaggaattgataagaaaaaagaagaacgcgaagcggctcacagtcgcgtagcacgacgggctgaaagccaaaaccgggctgataatgcaaccgaaacaccagcaaaggaaaccgaaaaggatccattcggaaactgggacattcgtgaaccagctcatcgaccagaaccaactagttcggcggctaacaccaataacgaattcgctggggttgataaaccagattttaatattttcaatccgaaccagaatgatagctcggcttcagatgataacaagagtgaagatacaccaccatttttcaaacggcggcgtaagtaaccgtttggaattcgttgtgagaggagtggcgaatcatggcggaaaaatttagtctcagcaagtttttcgggatgaatgatgagtatgacgatgactacgcggaagagccaacaccggcaactaagtcaacgccaacacctccaactcggccgaatgatagtcggaaggtggttgctatgcgaactgcaaaacctaatgccagtcatatcgcgatttgtgaaccgcgaatctactcggatgccaagtcaattgctaaacaattgacgaacggtgatgcagtcatcgttaattttgcccgggttgatgaagcacaggcccagcgaattgtcgatttccttaatggaactgcgtacgctgtaggtggcgaaattaaacgaattggggaacagatttttctatgtacgccccataatttcgaagttagtggtgatgtggccgctaatctaggcacgcaagtcacacgataaaggagcgacattgtgttaactttagtcttatggatttttaaagccttaaactggctagtcagtgcctatatattactgatcgtgatgtatgccctattaagctggttacctggcggttatcagtctagatttggccaaattgtggggcgcttggttgaaccctttttgcggtacttcgaatttatttcgttgggaccgattgggtttgggccagtagtagcgattgtggtcttatcgttggtccaatatgggttacaggccctacaaataatgattttaaatttactttttacgtagcaacgctaggaggcgaaaacgttggatgagaatgtgttacaacattttcggtctgatgaagcgccgctgattgatgctgtggggggctggattcagcagtcacaagacgaataccggcccgttctcaccaactttttgaatccgcggcaggtttatatcgcaacaactctcgcacagcgagccgatgtgccagttcggtttaatgggggttatgcccacgctgaaatgcagcgggccctattttatccagactactatgaacccgtggctaaagactttgaattagcagttttgcgggtcgattacccagtgaaatttgccaccttacatcatagtcagattctggggacattgctaggcgctgggattgaacgggaaattcttggtgacattttaaccgatggcactacctggcaggtcgtcactgaggcggggatggccgattacttaactgggcaggtcgaccgaattggtcgcgttaaggcgcggttacagctcgccgattttgctgacttggtgcaccccttaagtgagtggacagcagaaggtgcgaccctgtcatcattgcggttggacaacatcgtggggactgggtttcatttatcccggcaccgcgctaaagaattgattgaagccggtcatgtgcgattaaattgggcggaaacgcaaaagcctgactatgagctagatgtggccgatattgtttcggtccggggatttggtcggattcgcttagatgaagtcggcggtcggacgaagaaagataaaatacgcgtcacactagcggtactacagaaatagatgcggagggaacagtgcaatggtattaagtccattagatattcataataaagagttcggcaccaagatgcggggctacaacgtcgatgaggttaacgatttcttggatcagatcatcaaggattaccaaatcacgttgaaccacaacaaagaattagaagaacaattggatgcggctaatgggaaactcaagtattttaacgacttgaaggattccttgaatcagtccatcttagtcgcgcaagaggccgccgataaggtgaaagccaactctcaaaaggaatcggaaattatcattcgcgaagcccaaaagcagagttcagatattgtttctgaagcgactaataaggggaaccaaatcatggcggaagcatcgaagcgagcgaagaagctggctgtcgaaacggacgacttgaagaagagtacccgggtcttccgccaacggcttcaggtaatgttggaaagccagttagaagtggtcaagtctaacgattgggacagcttgcttaaggaaggttccatgtcgagctacgaagaaatcaagaaggtcgttggcgatcgacttgacaatgaagcggctcagggcgtacactcaaagcctgaacaaacagttgcggaaccgactgaagaagctgtgactgaagcacccgttacggatggtggggacaatggtgaaactgttgtgatcttccctgaaaatgacgacgagcattttgatcaaaataaataatggcatgaagaaccacgtcaactaaaaagatggttttagcgagttagcgatagtggaaggctaacagcccgctcttttaggtgatatcactcttccaagctctgtagccgaatcacagtaagctatagcgagaacgtcgcgatatgacgattgagggttaatgttagttgaacattaaccgaatttgggtggtaccacgaacgatttcgtcccttgacgaggtcgttttttgtttgccatcagttagattgattctaggcaattgatttggtggaccggtgagctgagaccagacatggtttgagctcaccggttcaccaaccgagaaacatcacttaaggaggaaatggtatgcgagtaaaagacacgctgaacttaggcaaaaccaagttcaaaatgcgcggtaatttaccggtcaaggaagttgatcggcaaaaagcttgggccgaaaacaaaatgtatgaagcccgccaaaagttaaatgaagggaagcccacatttattttacatgatgggccgccatatgcgaacggtccgattcatatggggcacgcgttgaataagatttccaaggatatcattgtccgctacaagtcaatgagtggcttccgggcaccttatgttcccggttgggatacccatggcctaccaattgaacagcaattaacgaaggtcggttacgaccgcaagaagatgtcaacggccgaattccgtgatttatgtcgggaatatgcattaaagcaagttgatcaacagcgagagggcttcaagcgactaggggtctctgctgaatgggataatccatatctgaccctaaagccagaatttgaagccgccgaagttcgcgtgtttggtgaaatggctaaacggggcttgatttataaaggaaagaagcccgtctactggtcctggtcatctgaatcagcgatggctgaagctgaagtggaatatcacgatgttacgtcaccttctgctttttatggtgagcaagttgtcgatggtaagggcgtcttagatacggatacgtacctagttgtttggaccaccacgccatggacgattccgggttctgaaggaatcacaattgatgctgggatcgaatacgctgtggttaaaccagctaatgatgaccgcaagtttgtgttggctgctgatctggtcgatcaaaatgcagaaatgttcggttgggaagacgttcaggttatcaagacggtcatgggtcaagatctagataacgtgacggcacaacacccatttattgcggatcgaaagctagttgtgatgctgggtgactttgtgacaactgaatctgggactggcttggttcacacggcaccaggtttaggggaagatgactttaacgtgggtgccttgtatcacttgccagtcttagttcccgttgatgacaaaggatacatgacagctgaagccggtgcggattttgcgggtgtcttctacgaagacgcaaaccaaatcgctttggataagttgaaggcggctaacgcactgctgaagtacatgccttatgagcacagctacccattcgactggcggactaagaagccagttatcttccgggcaacgccacaatggtttgcttctgttgacaagattcgggatgaaattttagcccaactcaaagacgtcaagttccaaccagactggggtcaacggcgcttagccaacatgatcaaggaccggggcgactgggtcatctctcgtcaacgagtttggggtgtgccactaccaatcttctatggtgaagatggtgaggccatcatcacaccagaaacggttgatcacgtggcggacttattcgctgaatatgggtcaaacatctggttcaagcgagaggctaaggatctcttacctgatgggtttactagtgaacattcacctaatggcgagttcactaaggaaactgatattatggatgtctggtttgattcagggacttcccatcaaggcgtgttggctgaacgggattatttggatttcccagccgacttgtaccttgaagggtccgaccaatatcgtggttggtttaactcaagtctgatcactagtgttgcggcgactggtaaggcaccgtacaaacaagtggtttctcaaggcttcacgttggataaagatgggcacaagatgtccaagtctttaggcaacacaattgccccagacgaaatcatttcaaaaatgggggccgacattgtccggctctgggtgacatccgttgactcttctgccgacgttcgcgtctctaccgaagcctttgtgaagatttcggatagttacaagaaactgcggaacaccatgcggtacttgctggccaataccagtgatttcgatccgcagacagatgcaattgcagttgatgatttacaaccggttgatcgccacatgttgtatcagcttaatgaatttgccaagagcgttcgtgctcactatgatcactatgacttcttgaatatctacaaagagctgattaactttgtcgtcagcgacttgtcagcgttctatctcgacttcgccaaggatatcttgtacatcgaagccgctgatagtccagttcgtcggtcgatgcaaacggtcttctaccagattgctgtaagtttgaccaagttaatcacgccaattctgccacatacggctgaagaaatctgggacttcttgaaggaaccagaagacttcgttcaattagcagaaatgccggctgttctagaattgaccgatgctaacgaacaaccggacgatggacatcagtcagcgtgggatcatttcatgacgttacgaagtcatgttttaaaggccttggaagaagcccgcgatgctaagttaattgggaaggctgctgaagcgcaccttgacttgtacgtggacgaggaaactaagcacctactcgatcaattgaatgtgaatgttcaacaaatcttgttggtttctggtttagacgtcgccagcttagatcaagcaccagcagatgcgttgacgtttgaccacttagcggtgaaggtcacgccagcggccggtgaggtttgtgatcgttgtcggttgaccaaagaagacgttgggagcgacagtgcttacccacacttctgtgcccggtgtgccgctattgtgcggcagaatttcccggaaacggctactgagggatttgacgaaaactaaagatcactaagttttaggaaacggcagcgctccgggagaccggggactgtcgtttttgtgtgaaaacgagtataatttgttctatgtaatgggagggataccatgttaaccggaaaagtgaagagttataacgagcaacgcggctttgggtttatcacaacccccgctgatggtgatgtgttcgtgtattacacgggcattattggcgaaggctttcgtaaattagaagcgggacaaactgtccaattcgtgattgtccaagggatgcgtggtcctcaagcggccaaagtgacccccgttgtcaccgcaagtactgaggaggattaacatggatttagaagaacatgttgaatcgacagaggagctttataatggggtaatcatcaaggttgaacgccaacaagtgcgtttgcctaatggtgactctgcttctcgtgaaattgtccgacatgctggtgctgtggggattttagccctgacagcagataataaaatgattttagaacgccaatggcgagcaccaattgcggcagcaacgttagagattccagccggaaaactcgatcagcgtgatgcggataatgttgaacacgccgtcattcgtgaattaaatgaagagattcggtatcaacccgggcaactaaaacggattaccggtttttattccagtgttggtttttccgatgaatacatgacgttatttttggcaacggatttaaaacccgtgacgactgaattaccgcgagatcagggggaaaatctggagttgctgacagtaaccaaggaagaagcccaagcgatgattgatagtggcgaaatcaatgacgccaaaacgattacggccatctattactggctattacagaagtaggtgacgatatgcgtaacgattggcaagatcaagatgaacaacccaaaacacgagctgactatcggcgagaacaagaacgtgctgagcaggatttccaggagcgcgatcgtaaacgggtggaagtggaaaaagagtacgcccgcacgcatggtcgatcgatgcccgaggatggtgctgatgatcatcagcgcatcagtccggcggaacaaaagcaacaacgtttgggacgacgattaaattgggccattggctggcttgtcgtcttaattgtcattgtgtatctaattttatttttagttgattaagacttaaggagtggacagcaacatgacatttggcattatctgcgccatggaagaagaaattaaagaattacacgaagccttggtggatgctaagacaaccagcattcacggtttggaattttacacgggtaccattcatgaccaagcggttgtgttggttcgttctggaattggtaaagtggaagccggattgacgacggccctgttaattacacaattcaatgtagatttagtgattaattctggttctgcgggagccttggcaccggacttaaatattggtgatgtggtggtttcaaccgaaacggcctaccatgatgccgatgcccgggcctttggctacgaatacgggcaattgccccagcaacctgcccgattcattgcgtctaaagaatggggcgataagattgtggccgctgccagtgaaacggggctgacaacgaagcaaggcttgattgtttctggtgatcaattcttaaatagcccagctgtcattaaagaaattatgggttacttcccagatgccctttccggtgaaatggaaggcgcggcggtcggccaagtggcgcatcaatttgatgtgccttatgtggtcgttcgggcaatgtccgacaatgccgacaataattcaggcgttgattttgatgattttattattgatgcgggtcatcgttccgcacagatgttattagctctgctagcagcacagaactagcacgggtgattcaggaggttttgagcgtgcaagagattcacattgacaatagcaatgcagttcacgaaatttatttagacaatgcggcgacgaccccattagccccagaagttttggcagaaatgaccaataagctggcaacggtgtacggtaatgcgtcaacgttatatggcttaggtcgtcaggcccatacgattatggaaaatagccggcaggtaattgcgcagagtattaatgccgctcacgacgaagagattatcttcaccagtgggggcagtgaaagtgataatacggcgatcacacaaacggcgatggcccgtcaatcattgggtaagcatattattacgaccgcgattgagcatgaagcagtcttgcggccgttacacgctcttgaagagcaaggctttgaggtgacctatttgccagttgatgagcagggacggatcagcctagatgattttaaagcagccttgcgagatgatacgatcttggtaaccatcatgatggggaataacgaggttggcagtcggatgcccattcatgaaattggcgatattttgaaagaccaccaagcttggttccatacggatgccgtccaagcttatggttcattggatattgatgtgcaacgtgatcatattgatatgttatcgacgtctgcacacaagattaacggccctaagatgattggttttctctataaacatgagggcgttaattttccaagtctaatcaagggcggcgaccaagaagaaaagcgacgtgcaggcactgaaaatgttccggcaattgcaggctttgctaccgcagcgcagttgttaacgccaaaggtgaaggctgaaaagcgaacacggttccatggctttaaagagcaagtggttcaaggcttgacggctaacggcgttgactttgctgttaatgggtcacttgaaggcgaaaatctggaacatgttttgaatatttggattaaggggatttccacgtatgtcatgcagacaaacttggacttggccggaattgccgtttcgggtgggtcagcttgcacggccggatcgattgaaccgtcgcacgtgttgactgcgatgtttggtgcggacagtccccgcatcgccgaatccattcgattatcatttggtcagcaaacaacgcgtgatgatattcaggcattcgttgacaatgtgacgaccattgtcaatcggttatcccacagtgaggtgaagtaggatgttatttgaaaaacagatgcaagttgatggtgatacagagacatatgaactgcaccccaacatcaagccgtatgcattaaaggatgttggctttcaagtgtccaacgctggtaattacacattggagcggtccgttgatcccacgtcaccatacaataagaatcaaatgttaaaggtgacggtagccaaggatctgagcgggtttaagatggccacgaccaacgcttccggtaatcgccggattaacatttttaaagggccccacgccactgaaaatgtcgagcaatatcactttatcttacagaatttaatggaccgagaaattctacagaaaaaataatgagacaagtaggccgaaaagacatgactttttggcctactttttttgaatctggatttgacgaccggccattcttggatagtcaagaccaccatgtttcacttgtgatacgccaggcttgcaaaacgctgtcagaatcggtaaactaggtcatactggatttgtgcgaccttcaaatcgtagattctccagaatctgatagaaatgatggtgataccatgcaagacaacagccaaacacgggttgtcgttggtatgagtggcggggtcgattcttccgttgtagctttgcgattaaagcagcagggttatgatgtaatcggcgtctttatgaagaactgggacgatacagatgaaaatggggtctgtaccgccactgaagattacaaagatgtggctaaggtggctgccaagatcggcattccttactactccgtaaacttcgaaaaagaatattgggaccgggtattcacatacttcttggacgagtacaagaaggggcggacaccgaacccagatgttatttgtaacaaggaaatcaagtttaaggcgttcttggattacgcgttagagttgggtgccgattacattgccacgggacattacgcacagttgacccgtgacgaggctgggcatgcccacttaatgcgtgcagttgaccagaacaaggatcagacttacttcttgagtcagttgtcgactgagcagctagatcgggtaatgttcccaattggtgacttagtcaagcctcaggttcgtgagattgctaaggaagctgggctggcgaccgctgagaagaaggattccatgggaatctgctttatcggtgagaagggacacttcaaggacttcttgaagacttacttaccagccaaggcgggtgacatgatgacggttgatggtgaaatcaaaggccatcacgccggtttgatgtactacacgattggtcagcgtaagggcctgggtatcggtggcgatggtatcgacaacgagccttggtttgtgattggtaaggacctgcaaaagaatattctgtatgtgggcaaaggctatcacaacccgcatttgtacgcgactcacttgtcagcgtcagatattcactgggtcaacacgattgaccgtggtagtgacttccactgtacagcgaagttccgttatcggcaaaaggatacaggggttacggttcatttgaacgacgatggtcagcaagtgacggttgaattcgatgatccggcccgagcaatcacacctgggcaagcagtcgtgttctacaatggagacgagtgtttaggtagtgccattatcgacgcagcctataatcaggaacgtgaattacagttaatctagttaaataaggagtattgctatgaattagcaatgctttttttatttgaaaaaaattcgtatttctgatatcccggctttgaaattcaggttaaaactggcataatatagactatgtgactttatggaaaggacggatcgcagcgtgaaattatactttattcgccacggaaagacccagtggaatttggaaggtcggtttcagggagctggtggggattcaccgctactggatgaaagttatcaacaaatgattcaagtaggccaatttttacggcaaacgccatttgttcacgcctatgccagcccaattaaacgcgcccgaataactgctcaacgcgttatcaaggaactgcatcaatcggtcccgttgacactgttaaatcggctagaagaatttcacttaggtaagatggagggcatggcatttagtgcggttaaggatcagtatccggctgagctggatgcgtttcgcaatcacccagagcggtacgacgcccgaaccatcggtggtgaaacatttaccgaggtgacagctcgaatgacaccagcgatccgtcaaattgttgcggctcacaatcaccccacagataacgtcttggtcgtgagccatggggcggcccttaacgcagaaatcaatgcgttaattggcacgccgctagccgactatcggaagcgcggcgggctgcgtaataccagtgtgacagtcttggaaacgacggatggacaatcctttaagttaattgactggaatgatacgagtttcttaacggcaacggccacgccgaccgatacaatttaaggtgagaaaatgacagaaaaaaagagtgatcgtacggcagcaaaaaagcgttcggaacaggccgtacatgaattgataacgcggatcgatacccatccgggggatgctgacgcctactatgaattagccaccgttctagttgatttgaaatcatttgcccaagcagaagaattgctgatgaaagcacttgggctattccaagcgcagccggcagttgtcgataaactacattatggcctaggcaacgtttactatgctgccgaagattatcctaaggccattcaacagtttgacagtttaggcgcgcagtggaaagggaccggttatttgatgttggctcagagctatatggccaatggtgaccacaaacgagccttagcgtttgcgttgacggctctcgccagtcaacctgatgatgttgccacactgcaagtggttggcgaaaatttgttagcattggggaatatgacccaggcagctcagtattatgatcaactcttggcgattgatcctaaaaatgggcgggcaacctttgatcgcgggctggtggcgatggtgctaggaacaccttacgccgattactttgaacgcgcccagacgttagatccccaatacttcgagcaaggccaacaacgattggctgatattgaaaaattcatgcaacaaacccctgattcagatcagcagtaaaggagacgacacagatggcaaccgaatcactagacttatttgcaaccgataacgctgggcaaccagactttgtggtcggcactgtcagtgcggtcttttttgccagtaatgatagtttttataaggtgatgctggttaaggtttctgaaacgagtctggattggcacgaagatgagattgtggtgacgggcaactttgccgatgttaaggatgacgtgacgtaccgctttacgggtaaacgtgtcgaacatcccaagtatggcgtacagtttcaagccgataactatcaaaatgaaacaccgacctcccgtagtggggtgattgcttatttaagtggtgatgatttcccgggactgggtaagaaaacggcagaaaaaattgttgatgcgttgggcaccaacgcaatcgaagaaattctaaatgacagtgcggtgttagcgccattgggtttgtcacctaaagtgacggctacattggtgagccaattgcagaccaataatgggatggagcagattatcattggcttgaatggatatggatttggtagctcgctcgctgcagccatttataatcgatatcaagaaaaaactttggacgtcattcacgagaacccttatcagttagctgaggatattacgggagtcagcttcaaacgagccgaccagattgccacgcaactgggttatgccgcggatagaccagagcgactgcaggcgggactcttacagaccttgacagatttatcagttgctaatggggatacctatacaacggccaaaccactgttaaaccaagcgctgagcttgttggaaaattcgcgcaatgtgcgattagagccaactaagctggccgatcaactcttagaattggctaaacagcaaaaagtggtgggcgatgaccaacggatctacttgaaggccctatacgatgctgagtggcaagtggctgaacatttgcaacggttgttacaagcggatacccatcaagcgacgttcagtgacgaggcggttgccaaacaactgcggattgttgaaaagcaggccgatattgtctatgatgattcgcaaacggcggctttaacggcagccttgcaagcaaaaataatgctcctaaccggtggccctggtaccggaaaaacgacgattattcgtggactggtgaacttatatgcccggctgcatgaggtctccttggatattaatgagtataaagataaaccctttccgattctgttagcggcccccactggtcgagcggctaaacgtatgagtgaatcaacgggattgccagcgtcaactattcatcggttattagggttaaccggtcgggaaacagatctcgatgcggctacgaccaaagatttagaagggggactgctgattattgacgaagtctccatggtcgatgtctatctgatgaagacgctgttgcgagcagttccggtggggatgcaggtcatcttggtaggtgataaggatcagctgccatcagtcgggcctggtcaggtattccatgatttactggcgagtgatcaattggcaaagattcaactggatacgatctatcggcagggtgatggatcatccattattccgttagcacacgctatcaaggcgggaaagttaccagccgattttacccagaaccacgccgatcgctcctttatcgcgtgccatgccaaccaagtagaaagtgtcattgatcagattgtcgctaaggcgcacgctaagggattctctgccagtgatatccaagtattggcgcccatgtatcgggggtcagcggggattgatcgactgaacgtggtgttacagaatattttaaatccgaaaaaaacggcccggcaaaaagaagtcacttttcgcaatcaacagtttcggattggagataaagtcttacacttggtcaacagtccggagaataatgtttttaatggtgatattgggacaatcacggggattgatttggcgagcgataaaaatagtaaagttaaaagtgatcaattaacaattgcctttgaacaaaccgaggtaacctatgcacgtaatgattggattcggctgacgctagcctattgtatgtcgattcataaggcccaaggctcagagttcaaactggtcattttgccaatggtgagccagtataatcggatgctccaacggaatctattgtatacggccgtaacgcgagctgccgatatgttaattctactgggagaaccgcaggcgtttgaaacctgtgtgacgaatttatccgttaaccggcatacaaccctgacaacgcggattcagacggtcttagatccagataaaacggcaacagtatcgtcaaagtcggttgatgacgcacaaccacaaccggtggcggtagctgcaccggttgcagtggccgatgcttcggccccaacgaccgatcatgacgcggcaactgccacagctcaggactatcaattgacaccggcgctagttcaggcgcgacagattgatccaatgattggcatgcaaggcattaccccgcaacaatttatgccatcgttataaaatagcggttgtaggcgttgcgtttctgaaaaaagattgcgataatatagagagactaaaattacgatttgtggagatcccacagggaggctgtcatggcagaacacgttgaagctggtaaaatgaaggtatttgccttaaactcaaaccggccacttgctgaaaagattgcaaaagcagcgggtgtgacgcttggaaagtccaccattaagcattttagtgatggtgaaattcaaataagtattgacgaaagtattcggggcgatgaattatttttaattcagtcggtttctgatccagtcaatacgaatttgatggaactgttgatcatggttgatgcggcccgacgcgctagtgccgaaaagatcaacgtggtggtgccctactatggctactcacgagctgaccgaaaagcccgttctcgtgagccaattacggccaagttaattgcctccatgatgcagatggatggggttgaccgggtcattacgctggacttacatgcggcgcaattacaagggttctttgatattcccgtcgatcatttacaaagtgaccggctactgacgagctattttgaccagaatccacgattagcagatgaagatattgtggttgtcgcaccagatcacgcgggcgtgagtcgtgcgcggcgcttagccgaattattgggcgccccaattgctattatcgacaatcggtcagaaacagaaaatgcggctcatccggatgcggtgattggaaatgtgactggaaagcacgcgatcttagtggatgacatcattgatacggcaattcgaattacggtgtcagcggaagcgttgaaatgggcaggtgcggctgatgtttttgcttgcgcgacgcacgcggttctatccggcgatgcgacccaacgaattgatgattcagtgttggaaaaggtcgtaattaccgattcgattcagttgccggaggacaaacagagcgataagtttgaaatcttatctgttggtgaactattcggtaaggcgattgatttgatttatcatgagcaaccggtggattccttattccacggttcattgaaacgtcaaaagcaataagtgttgaccgttaccgctactagctggtggcggtttttattttgatgaagaaagtaggtggcgtaaatgcgacgttaccaacaagcccaattatttcaactacgcgagattgctatgggattgacctttattggtggttttatcgatgcgtatacgtttggtcaacggggtggggttctagcggctggtcaaacgggtaacttgatttttctcagtgttgacattgcccagcataacttgccgggtgtgctcacaaagttattgacggtagtattctttatcctcggggttgtgaccgtgggattacttaattatcgattgcggccgacctctcactactggcgcttacccacgttattggcagagtttgtagtttgcctagtcgttggtgggttgccagagacggttcctaatttgattgtgacgccgccactggcgtttgtgatggcaatgcagacgacggcctttggtcacattgaagggcatgggtacaataatgttttttcaaccggtaatttaaaaaaagcaacatcggcgttgacggattattttatctatcgacagcccggaacactgacaaccgggatcatttacggtggtttagtcgtcagttttgcaggcggagcgattatttcagcgttattggaagggtggcttttaggtcgaacgatttggtgtgcagccggcctcttgctgatcgttggtggttattatacgtggttattgtttaagcgccaagatgatgcgttcgatcaatgagcaagttaaaaagagaactgaacctgtggtgaacaggccagttcccttttttaactgacagattagagtagtttcaaatgtgctttaggacgatcaaagtccaaccaccgttctaattgattctgtccggtggtaatgaccacgcaacatagccaatataaaatggcaatggtgatgtaaatagtcatataatcttgattagcgccagctacaattttagcttgcataaacatgtctgtcacggtaatcatggcagcgagcgacgttcccttaaacatatccagcaaaatattaccaagtgcgggaatactgatacgaaaagcctgcggaataatgataaaacgcataactttccgatagggtagcccaatcgaataagccgcctcatattgcccgtgatcgattcctaagaaggcggaacgaaagacttcggagacgaaggctgcagcccctaaagtgaaggaaataatcgccgctggaacggccgttaagccaaagccaaagtagacaataaacaagacaactaacatcggcacgccacgcataaaggaaatataggcgcgggctaatccatggagcacccgcacgtgactcaattgagccagagtgagtaacatgccccaaattgtggctagtccgaaagccatgacggttagaaagatggtcatgggtaacccactcaaaatttgtggaattgacgaccacgctaacggcgcattaaagaatcctgggattgacaaatatttcagcatcgctggtcacctagttttctattggcccgtatatttagacttaatggtaaagttcttagagatatggacagttggtttttgcgttacatcagcgccgtaatatttttcggaaatctttttgattgtgccatctttcaataatttctgaatttcacgatcaatttcttttttcagtttggtattactcttcttcatcaaaataccaacaccttggccatcatcactggtggtaaagtacatgttcttagcaatgtgtaggccattattcggtaccgctttgagagcaagcttttggaggtagtagtcattcatgatcaaatcggtcttgccatttttgacatcttttaagtagacgtcgttagagacattatcatagttgaccagtttggcacctagctgttgcgccaagcgttgataaccagtccccgcttcgccggcagcctttttccccttgatatctgcccaagagtgaatcccggaatcgtctttatcccggaccaccaaactattaaatgagtgcttgtacacggtcgacaaagcatattgcttttttcgagctggcgacaagccaaaatcattggcggccagatcagctttaccagagttgacagccgtcagttgtccgtcaacacttagttccttgaactgtaccttcttgtgcaagcccttagcaaccgcccggacgacttccacgtcaaagccagttaacttactattctttgacgtatggaacgatgtgggatataacgttcccgacgttgcgacaattaaggtcttcttattagccaccttagtattcgttgacgtctttgaggaggtcccgcaaccaacgagagcaccactcaagataacacttaaccctaaacctaaaaccaaccattttttcgtcttattcatcctttttcagtcctttcaatttatgacctaagactttttcagtataccgatttgaaaccgcttttacaaccgaatggtggtaaaataaagctggtaacttactaaagattagaacaaaatcaatggaggcggtttggatggtcgtaacagattggattgggaccccagcgttaacttgggcccgacggattagagcgggagaggttagtcgccaggagctcattgaaacggcgttagcggagattgatcggcaaaatccacagctaaatgcggtcatcacaactcgccgcgagaaggccttagcggaagcggcagcgcagaaagacacaggccagccctttctcggcgtcccattacttttgaaagggctgggccagcaactacagggcgaaccaagcactagtggttcaaaactattaacaaccaacgttgccagccaaacgagcttttttgtgctggccttacaacacgctgggtttattatcattggtcaaaccaattttccagagtttgggttcaagaatatcacggatgcgaagctttacgggccagcgcgtaatccctggaatttagactatcagcccggcggttcgtctggcggcgcgggcgctgcggttgcggccggattggttcccattgcggccggcagcgacggcggtggctctattcggattccatcatcgtggtcgggaacgattgggttgaagcctacgcgcgggcgggttcccgttgggcctagcgattggcgatcatggcagggcgccgccattgattttgcgttaacccggtcaattgcagatacagcggcgctattagacagcttacaaaccctgcaaccagctgcggtctttcaaaccccattagaacgatccgggttcttcgcccagctcgatcaacccgtgcacccgggggtcattggctttacgaccgaatcaccagtggggacgcctgtcagtcccgaagcggttcaagcggttcaagatgcggtgactttcttacgtgagcaagggtttgccgtcgaggaaatccataatccgattgatggcgtggccttaatggaaagttactacaccatgaatgccggtgagacagcagccttcatgacggaactagcggctggcttgggtcgggagctaacggcagatgatatggagttgttgacgtgggcgctttatcaaacggggaaacacacctccgccgcagattatagtttagcgctaagtaagtgggatcaagcagcatggcaaatggcccagttacatgcgacttatccgattatgttgacaccaacaacggcttggccggctcccaaagtgggtgatccattggtatcagccagtgacgcggccaagatggaagagattacgacgatgcgaccagcagcgcaaaaacaattaatttatgaccaatggttaccagccctgacgcggtcgccatttacgcagcaggctaatctgacgggggaaccagccattagtttgccaaccgcggttaccgcaactggattaccattggggattcaatttaatgcagccaagggccaagaattaatattgctgaggcttggtgctttatttgaacgcgcgggaaagttaaaatggttacatgcgacaaaattagattgaggagcgaacgttttgaaaggaaagcatttaggcattttagttggagcagcagttgtgattgcgggaggattagcggcttgtggaaccacatctaagtcaacgaaccaatcgggacaactagcagctaaacagatcgttaatttatcgaccaagtctgaggttacgactttagacgtttccaaagcggcggattcggtcagtttaacgcagctgtatcatacccaagaaggcctatatcggttggggaaaaaggaaaagttgattaatgcgatggcgaccaagaccaccgtttctaaagatggtaagcgatacgtctttaaattacgtggcaataaccattggaacgatggaaaaccagtaacggctaaggactttgtctattcatggcgacggacggtgaatcctaagacagcctctgaatatgcttacctgatggctggaattaagaactacagtcaagttcaaagtggtaagctggcacctagccagttaggggttaaagcccaaggaacgaagacgttagtggtaacgttaagtaagccggttgcgtattttaagttgttattagcgtttccgactttcttcccacaggaacaaagtgtggttgaaaaatatgggagcagctatggtcattccagcgcacagacggcttacgatgggccatttgtgatgaagaactggcaagggaccaaccaaagctggaagctggttaaaaatacgaaattctgggataaatcagccattacgttaaaacaactgaattttcaagtggtagcggatgcctcaaccggacttaatttgttccagaagaaagaattggatgcgacaacgttagacgggacccaagtcgctaatctaaagaataatagtgagctcaaaacttttgttggcggaacgacctattatatgcagatgaaccaaaagaaggtcaaagccttgaaaaacttaaaggttcgccgggcgttgtctctagcaatcgacaagcaacagttggccaagagtgtcttacgagatggttctaaggcaccgctaggatttgtttctcaaaatctgacacaaaatcccaagacaaaaaaggattttgccacggacgcctacgttaagagtggcgtggcctatgacttaccacaggctaagcaattgatgaaggctggcttaaaggaaacgggcactaagaagttgacggttaccttaatggcggacgacacatcggtaaccaagacagtggcccagtatatccaagcggagctacagaagctacctaatgtgaaggtgacgattaatagtttgccttacaagacgcgattgagtcggtctaattcaggaaactttgacttagtcttgtcgagttggggagccgatttcgctgatccaattaatttcttatcattaatgagtacgggtaatacgaacaacaatggtggtttttcggacgcccaatacgatcgtgatgtaaagaagtccgagaaccaagatgctaacaacccaacagctcgttatcaggatttagtcaacgcggaaaagcggctgatgacgaaacagggggttattccgttgtatcaaccggcgaccgccgagatgtggaatgcaaaagtttctggctacgtttggaatccagccgggatgagccgtggttatcaatggatgaaagttgaaaagtaacgcatagttttctgaaagcgaccagcgttagcgggtcgctttttttgaccactcaaatgaatgatgaaaaagttaaggtgaaagattcggaattgaaattaactatgaaacatgttatacctaagttagcaatcatgaaagcgaatacataattgcggaacttatgaagcaggaggctgacacgatgcagtttgatgagttattaacggaacgacggaatcaccgttcaacccacattgaccgggaatccacgctagagatggtggccacgatcaaccgggaagatcatcgagtcgcacgggctgtacaaaaggagcttccccaaattgccgctgcgattgatgcggcttacccgaaatttgatcagggcggtcgcctgatttatgtgggagcagggacatcaggtcggttgggggttatggatgcgaccgaaattcagccaacctatggcttaactgctgaacaaacatttggactaatcgcaggtggcgagccagcgttaacacatacggttaaggcggctgaggactctattgaattggcacaagaagacttggccgctgttcaattgacggcccaagatattgttgtggcaagcgccgcatctggacaaacgccctataccctagcggcactgcaatatgcgcaggaaaaaggggccctaggcattggtttttcgtgcgttgaagatagtcctttggcacaactagccaattatccaattaccccagtcgttggaccggaggtgattaccggggcaacgctattgaaagcaggaaccgctgaaaagatggttctcaacatgctatcaacagggatcatggtgaagtcgggtaaggtttatcagaacctcatgattaatgtggtaccgaccaatggtaagacctttgaacgggctaaaaaaattattgctgaagccacgcaaacgtcactgttggccgcggaacgtgctttggaacgcgcaaataatcacgtgccgttagcgatcgtattgatcgaaaccaagggcacgattgctgaggcaaaggctttgttagcagcaactaatgggcatgtttcacaggctgtaaaattaaatgacaagcagcactaaaccggtgagaaacttgactggtccacaccaattctttatactttaacttaggtataagtggaaaggaatgtgacagcatgtatcttgcagacgaacatcgttacgaaaaaatgcccatcagacgcgccgggaatacgggtttccaattaccagctatttcttttgggatgtggcacagttttggtgaaaatgcgaattatggtgatactcgagacattattctaaaagcttttgacgccggtatttttagttttgatttggccgccaattatgggcctggttcttacgaagccgaacgactctttggcgaagtcttggaacgtgaattgaagccttaccgtgatgaattggtcatcagtagtaaggccggctttcatatgtggccaggtccttatggacaaatgagctcgcgtaaggcgttgatggcgtcgttgaaccgttccttacaaacgatgggcttggactatgtggacattttctatagtcaccgattcgatccagaaacctctcctgaagagactgctgtggctttggatgacatcgttcgccaaggcaaagcgttgtatgtgggaatttccaactatacagcaccgcaagcagaagctatgattaagatcttcaaggacttacggacgccatttgtgattgatcaggtgtcatacaacatgttgaatcaaacggccaatgatgatggcctgtttgacctgttgaagcaaaataatgctggtgcaattgcctatggaccactttcggaaggtttgctgacggataaatacttgaacggtattccggctgacgttgatattcattggtcaaaccaatttgttttggataacggtcgtgataagatgttgcaaaagctacaagctttaaataaaattgcgcagagtcgggggcaaaaattgtcgcatatggcactcgcttggcttttgcacaatccagtgattacgagtgtgattactggggcctccaagccagagcatttgattgaaaatgtgaaagctgttcaaaacctggcctttgatgaagaacaactacaagcgattgataagattttaaaagcataatgttatagggagtggatctaaagctaattgggtccgcttttttagttgggtgacgaatcgtgtttagtggatgggggaaaccacaaattgaccgcaaatttttggaggtcatgcggtataatgtgagtaaggatgaattttgatggcggaggttgctatgacacggaaagtaacgattcgagatcttgcggaagcggctggcgtttcggtaacaacggtttcacagattttaaatggtaagggtgagcggtttagcatagaaacacgccaacgggttcatcaattacaagaggatctgggatacgtgccagattttaatgcgcggaacttaattatgaagtcagcacagacaattggcgtactcgtccctaatttggggaatcccttttttagtatgtttattcggggggttcaacaaaccagtcgagaacggcatttcatcccactgatctttggtgcgaatcatgatgagcaacttgaaagctattatttgcaggaattgattaaacgagcagtggatgggttaattattgcaagtgcttcgattaccggagaagccattgataatattttgaaaaagaatgggattccgtatctgttaatcgatcaaaatggcggtcctagtgttgatcgtattcgggttgatgatgaacaaggcggccaattagcggcgcggcacctattgaccctgggtcatcagcgaattgttgtggtgatgccagagcacccgacccaaaatttgcggattcgcttagcgggtttcaaggcacaattggtcgatcagcaaatacccttggccgatagtgcggtcatcacatcgccaatgacaaagctggggggatatcaagcgaccgccgccgtgttggcgcaacaccccacggcagtctttgcgattaatgacgagacggcgctagggttaatgcggggacttcatgaacagggagtacgagttccagatgatatttcagtattggggtatgatgatattgatttagatgagtatgtcgtccctaaactgacaaccatccatcagccggtggtgactatgggacagcaggcaacagagctattgatcaatcgggttcagaaccaacggcaaccggcccagatggtggatttgcctgtcgtcttaaagcaacgggaaagtacggggcccgtgaaataaattttatttagttcttgtaagccttttcgaaacatgatacgctatgagtaatcgaaaaaaacgaattgctcggtgtgtcagcaatacgtaaaacgttttacaaacaaataccacttaaggagtgacagttaattatggcaaataaagtaacggttctgggaagtttgaatgttgatacgacgctacggatcgcgcggatgccgcaaccaggggaaacattatcgactgaaaacaagagtagtgctgctggcggtaagggtgccaaccaagcggtagctgctgcacgggccggagccgaaacaagctttattggtaaggtggggaatgatgatgctggtcgtttcatggtagagtcattagataatgaccacattgatacacacgcaatcattaccgatccagttgtaggaaccgggtctgccttcattctcttggatgaagctggtcagaacagtatcttggtttatggtggttctaaccaacagattaaggccgaagaagtcattgctcgtgaagatgaaattgccaatgctgatttcttaattacccagtttgaaacgccacaagcagcgaccttggcagcatttaaagtggctaagcaacacggggtaacaactattttgaacccggcaccagctgctgaaattgatccagagattctaaaagtgacggatttggtcatccctaacgaaacggaaagcgcggagttaactggaatcgaggtaacagacgaagcctcaatggatgccaatgcgaagaagttccgagaaatgggtgttaagaacctgattatcacagttgggagtaaaggcgcttactacgcaactgaacaggaatccggatttgtgccggcctttaaggttaaagctgtggatacgaccgcagctggagatacctttattggtgctttgagttcacaattgaagccagatcttagtaatgttgcaacggcgttggtcttcgcgcaacgggcaagttccttaacagtgcaaggtttgggtgctatgccatctatcccaacggttgaacaaattgaggccgctagcaagaagtaggtattttcaataaattggtctaaccgataatttttctgattttttcagaaaaattatcggtttttttgtgttcataaggcaaccggttgcaatatcttaaaaccggtatatttaatttgaatgatcgtatcagattacaatcaccgtattacggcggtttataaaatgggttgcatttatatcgttagattggtatagttgtgaaagtcgatagacaatgtcgaatttaccggtagattcaacacttgaaaatttcagtaatttagaaaatagccgtgattggtccggctaatttaagtgaggttatttaaacatgttgaatgaagaagttctgaataaacaagttaactttgatgaggtggatacacaggctgttacggctgtccgcatgctgagtatggatatgatttcacgagcacggtcgggccacccgggattaccgttgggggcggcacccatggcttatgttttgttctctcgtcacttacgagtggatccatcgtttccccagtggtttaatcgtgaccgcttcgttctctcggcaggtcatggatcggcaatgctatacagtctgttgcaccttagcggctttgcattaagtcgcgatgatttgatgaatttccggcagttaggaagtaaaactcccggtcatcccgagtacggggtaactccaggggtagatgcaacgacaggccccttgggacaagggattgggatggccgtcgggatggcaatggccgaacaacatttacgagctagctacaatcggccgaatttaagtgtggtggatcattatacgtatgcactttgtggtgatggggaccttatggaaggggtcgcggctgaggcagctagcttagctggacaactacaattaaataaattaattgtgctgtatgactcaaatgatgtgtcactcgacggaccacttagcaacgcttgtcatgataacgtggccgaacgatttgaaagttatggctggaattacttacgagtagcagatggtgatgatttggcggccatcgatcaggctattcggacggctaaaaacaatcagagtgggccaacattgattgaagtgaaaacacaaattggtgcagggagtccaaatgccggaaccaataaggttcatggtgcaccattaaattctgaggatttagcggcaacgcgggcgcattatcactgggagtgtgatccatttactgtgccagcgaccgttcatgaacggtttatgacgacgattaaggcacgcgggtgggccagccatcaagagtggtcgagtgtgattacccgttattctacgtatgagccccaattggccgcgcagtttgcacaggggattagtcaaacgttaccggctgatttaaaagcaaccttacctacttattataagaaagatgatttagcttcacgtgctagtggtcatgaagtcttacaacggttaagtgccgcctatcccaatctatggggcggttccgccgatctcttcagctcaaataaaacgaatgttgcggccactgatcggtttagcaaagataatccaactgggaaaaacttgtggtttggcgttcgcgaatttgctgaagcagcggcaatgaacggcattgccttacatggcggaactcgaatctacggttcaacattctttattttttccgattatatgaagccagcaattcggttggcagcgttgcaacacttaccagttatttacgtcttaacccatgattccttggcagtgggggaagatggaccgacgcatgaaccagtcgaacagttggcaggattacgggcaattccggggttgaccgtgtatcgaccagctgacggtaacgaaacagcagcagcctggttggaagccctgaaagcaaccgatcatccgacagctattgtattgtcacgacaggggttaccaacgctacctaagccagcatctcgggtgcatactggggtcaagcgtggtggctatgtggtggctgatgcacagcgagtcgctgaaggaattctaattgctaccgggtcagaggttcagctggcgctagccgcacaaaagaaattggctgaattaggccgggatgttcgggtcgtttccctgccaagctttgagcggttcaacgcccaaccggcagcctatcaggaacaagttctgcctcatcagttacgacggcgcgtggcgattgagatggctagcagtctggggtggggacaatatattggtcttgatggcgcgctggtcacacaagatcaatttggcgctagtggtcagggagccgcggttatggccatggccggatttataccagaggcggttgttgatgcgtacttgaaacttaactaagtaaaaaagataaaacgactcgctgcggcgggtcgttttttgaaaagtctgatccgagagctagtcagcgagtcgttttattggtatattgggggtaaagacactggaggcggtttttcatggaaattcggcgaattaaggtggcaacagcattggtttgggcaaccccaacgaccagtaatcgagcagatcaagcgtatttgaaaactggcgacctaacaacttgggtgaaagctttgaagccagtagatcagatccgattagccgatcagaatgtcattgtgaccgaagcattatttaacgatcgggtggtgttggaccgaattgaagggaattgggcccatgtctttgtcaaacgacaggcaaatcggcaagagcgtcgcggctatccaggatgggtacctctgaaccaattgacgacacaagatgaggagttggcttatccgacgacgacagttcgcttggttcagctgacgacaccgttgttagatgacggtcggcaaccagtgatggatctgccaatggggacgatcttaacaacggtagcgcaagatgcagactggattcaggtggtcaccccattggggaaaggttggatcacggctcaggcagcacaactgggtattagtggagatgacggtcaacggctattgactttagcacaacattttttggatacgccttatttatggggaggaataaccccagctggggttgattgttccggattggtttatgcactacatcgtgccttaggctatgccattccacgtgatgcgcaggatcagtttgctaatggttatccgattgccccagaggaactggtggctggggatttggttttctttgctcaggatcacggcaccggaacgattcatcatgttggtttgtatgctggaaatggacagatgattcatgcacccaagccgggaaagaaggttcaactggcgcccttaacgacaactgagctagcgccagagtacgcaggtgctcggcggttttggcaataatctcaactctgaagaattctctaaggtcaccagcaagccggttttgctattggcaaacatgctatactgaattttgggagagtagatgaaagccaaaaagagagggatcacgatgaaatttacgcgacttattttaggtctatctaccgttttgttgacggttggcttaggtggtcaaacacttagccatgcggataccacggataatacaacaaccagctcaagtacctcagcgaatagtggtagtaccgtccaaactaaggccttatctaaggcttatgtcgtttatggtgcgggtttagcgagcgaagataaagatacagtggcttcagccttaggtgtgaagtccaattacacagccttaaccgcaaccggtagcgactatgcgacttatttgaacgcggctgggacaacggacgccagcatgattagctcggtcgctttagcgccggccgatccgggaaccggggttaaggtcaatattgccaagtataatggtagtaataatattacagaagtgacgtcacaacagtatgcgatggtggcgacaatggccggggttaaggacgtgattatcacggtaacggctgataagtcggtttctggagaatcagccttaactggggtttataaggcattagcagccgatgggttgacactgaactcgcaaaacacacaagcagcaaatggcgtgttggatgcgacgcaaccagcgattgattcaaatagtagcgataaaaagtatccaggaaaattgatgtcagcagttggctcagtttcttccgatttggccaagcaacgtcaaaatggaaatgaactggcgactaaggcggatattgaagaaatgctacaaaaggctttagctaaacaaggcattgctaatcaaacgtcatcaactcagattaccaatattgcgattgctttaagtcaggtacaaaaggcaccagtttcgactagtaagacgtatatcaagaatgtgacgaacgttgctgataatttagctaacagcattggtaataagatggccagtgtaaaagattttgctaacagcgcggatgccaaacaagccgagaactttattgtgcagatttggcataatgtggttaacttctttaagggcttaattggtggttagtacaataagaaaacaaaatggacgcgatgagcgtctttttttgtgctgtttttaaaatttcacaagttaaaggacatgagggttaacttggtagatacaaaaagcgttttcaatagtaatttgtattttacaataacttgctggaaaccgatctctaagcgttagagagaaattagcgggaactacttgaatagcaaaaaagaacgtacgttttcttattaaaacggtgattaaccggtatcataggcttcctagcgtaacacatggtggctagtggctagaatgggaacctcagttctgagtttgaaaacggttaataattccttaataattcacaagaaactgggaaaacgtgtggtactattaatttgtgatttgtatttactgtaaacgactgggtgacacttacattgtaagctcaggtatcactttggctgaaaaatattaaaaggacgtgttgatgaagatgagtacaggacaacggaaaacaaaagcagttgttggggtcgttggtgccatcggtgctttcgcagctggtgccacaattacggctaacgcggatagtattcaagtcaagcaaggagatacagtctgggatctttcacagaagtatcatacaacggtcgccaatcttgaacagaaaaatgggattgatgcccaaacggatctgatttttgtcggtcaacgactacaggtcaagtccgcatcgactaaacaaacatatacggttaaatctggggatacattatgggatttagcacaaacttatcacctgacggttgcccagttacaacaagccaatcatttaacgggtgatgggctgagtgtaggacaacagttagtcatcccacaagcaacagcgagtcaatcacaaaccaccgatgcatcaggtacgacttcggccccagccgcaacgcatcaatcgacgcaaaaggctaatgctgttcaagcccagattgtggcagcacaacaggcagcagctagcaaacaaaaacaacaggtaaagacgggaacggctgcgacaacttcagcgagtcaatcaaccgtttccaagtcaacgacaacagatcaatccgcggcaacaacgactgccaagtcaaaggggcaacaagcacctgcaacttccagccagcggcatacactgagtcagaatcagggaacgccagcggcaagcagtgctagttcggtgacgccagcaaccacgaagcaagcagtagatgaaacgagtacatcaacggctgcaacgacttcgacggccaccagtagtgcgagccagacaacgcagacgagtcaagcaacttcggctaatagctcaacgactagtaaccaatcagtgacaaagcaaagccgggcaactccggtagcgccggctaatgagagtagccagtcaactacgcgttcgtctagtgtttcggctgctagtcagtccacagcaagccaggccgtaaccagttcaactagtcagtcgaacaccgctaacgtttcggtggctaagaccaccaagcggctaaagacgatgacacgttcagcagccacaaagtcggcaagcaatacgagtcaaacgactgatacaaccagtcaaactagttcatcggctaatagtgtcagttcatcatcgacagctagtgcttcggctagttcatcgacagtaacgtcgactagcagcagtgccaaaaagactagtacaagtgggctaacgtcaggttctgtgacggaactggctttgaagttagcctctgctaacatcccttatgtgtggggtggttcatcattaagcgggatggactgttcaggattggtggcctatgtctataagaatgccatgggaatcagtttacctcatagtacagtagcccaagaatcctacgtaacgacgcattcagttggttccgcaaaaccaggagatattttattctggggcgctaaaggatcgacgtatcacgatgctatttatttaggaaataatcagtttgttgcagcaccagcaccgggacaaaatgttgaagttcaacaaatcagtaagtatttcatgccgtcttttgctggaacacttaagtaattgaatgaatccgaatgataacctgacttttgccggttttaagattggcaaaggtcgggttattttggtggagcatgaccgataagctaatcagttacttaacgggaaagcaatcgttttcatgaaagtaatcaatggaacacaaattgaaaagtggttaaaaaagtttttcaaaaggggttgcatccgggattctttggtgataatgtaattgcattgattaacggttttcttaagaaccttaattttcagcgaagagagattaaggcagtccggtagtggattagccgggcaaatcagcatgttatgcaattatttaagaggagttgttaaagatgagtaatcggatggagattctggaagagtatcggcaggctaattcacagttggcgaacttaaaacggaaggaatcggaatgtgttcattctagttctgaaacggtacaaattgagccgcgttatggacaagaaatgaatgatctatctacgaaatgtgctcagctggacatgattctcgaagccatggaagcttcagaagattaataatgctaatattgaaaagaggcgtcatcacaattgtgatgacgcctcttttactatgatcttagagtgtgatgtcgaaccaaaaaggatactgtgtgacaccgacataaacatcgaagaagcgaccacccatttcttctccgtctaactggccgtattcgatggctggaactgtcaggtggacctttgatacctgatagtagtgaacggccttagacgtcaaatgacgcttaaatacaagtcgtagggccaaccaaaccaatttaaagaaattcggtttctcaataacgaccaaatggagctgatgatcgtcaatcgtggcgccgggtgcaatgccaacgccgccaccaaagtaagggtggtttgtcgtggttactagaaaagcatggggaaacatgtcgcgttgattacctacatggaccgttaaggtgaaaccggtttggttataatacacactgagcgcggatgccaagtaggacagggaacccaagtgatgcctgtttaaccaaatttttgctttagattgattagcctgagaaataatggcagcatcaaacccaatgcctaaattattagtaaagacgccccgttcttgtttaattgtttcgttgtaagtaccgatatcgtaattggtgacgtgggtacaatgaatgatctggttaagggcttggtgccaatccaaagacagaccagcaccgcgcgcaaaatcgttgccagagccgataggtaggtaagctactggaatgggatgggatcgcttgatagtggttagaccattgatagcttcgtgaagggtgccatcgccgccaacggctaagacaacccaatcctgatgggggctgtcaggcagttgttttgcaaattgttcacttaataatagggtatggcggggatactccgaaacggccaattggtaggagactgaagcggcatcaagccgttccttgatctgcggccaaagcgtgccggcgtgaccacttcccgcatgttcatttaaaatgatatagaactggacactcaccgaactgctcctctcaaattttattccatcttattataaacgaaaaccagcatggtgcctagtagttctccaataactttgtctggtcataagaattaattcaggaattaagacaataaaaaaagccgagatcagcaatctcggcttttaagctacttagtcataatgaacatcggcaaaatcatcggatgacgttctgttttttcaaacaggaaattttgtaagtcatcaatcaccgcgttccgaattgaagcttccgttgctttgggattacgcatggctcggcgaatcgtttgaaagacgcgacgacgtccttcattaaggagttcaccagattcacgcatgtaaacaaatccacgagacaacaaatcaggaccagctttgatctcttgattcttcaaatcgatggttgcaacgactacgactaaaccttcttctgaaagtagttggcgatcacgcaaaaccacgttaccaatgtcaccaataccagagccgtcgatgtaaacatccccagcggtaaagtgacccgctacccgtgcagaatccttagttagggctaaaacatccccattttgaaggataaagctgtggtctaagggaacgccacattgttcggctaactctgtgtggatttttaacattcggtactcaccgtgaattggcatgaaaaatttaggctgcatcaagcgtagcatgagcttttgttcttcttgaccaccatggccagacgtatgaatgttattgaccttaccgtggataacgttagcaccagcttcttccagttcgttaatcacccgattgaccgaaatggtattaccagggattgggttactggagaagaccaccgtgtcaccgggttgaatagcaatctggcggtgggttccattggcgattcgtgacaatgcagccatcggttcaccctgagagccggtacaaagaatcattaccttgttagcaggtagggaacgaatagcatttgcgtcaactagggcgtcatcgggaatatttagatagcccaattcgcgaccgttaacaatggctgcttccatcgaacgaccaaagaccgcaattttacggccatgagccaatgctgtttcacaggcagtttcaatccgagagatattagatgcgaaagtggcgaaaataacgcgaccttcgacttggtcaaaaatcttgcgaatcgatttaccaacccatttttccgacttggtccagatcgggcgttcagcattggtactgtcagacataagacagagaatgccttcagctccgagcttggccatcttttgcagatcaggcggctgattggtaacgggtgttaagtcgaacttatagtcacccgtttccacaataaccccgaccggtgtatgcacagcgacccctaatgtgtctggaatcgagtgggttgtccggaagaaagaaacgctcatcttgcggaacttaagcactgtatcatcatcaattgcgtgtagttcagttgatttaagtaatccgtgttcttcaagtttgttcttgattaacgcaagggctaatggtcccgcatatacggggacattgagtgccttgagtaaataaggaataccgccaatatggtcttcatgaccgtgggtgatcacaagcgctttgattttagcctggttctcaacgagatactggtaatcgggaatgacataatcgatccccaatagttcgtcttctggaaatttaatcccggcatcaattaagatgatttcatcttggaattgaataccataggtgttttttccaatttcaccaagtccacccacgccaaagatagcagtttcgttatttttgacgtttaacttgttcattcactgaactccgttaatttgtaattcggattctgttgttcgtaagccaaggtttctccttcgatggcttcaatgaattcgatattgtgttccgtgtgtgcttcaactagagcccgcgcttcaacttccgttggggcttctagataaagcgaatgcgtatcctcgcgcttaggattgcgcttttggtcattttgataatatactttataaatcacagacaaaactcctttaattaaacgatttaatccgtcacgacctagggcctaacaacgaatcatggatgttctttccgaactgcgggttgcttacacaacaattagcacaattttagcatagtttccgctgattgtatagaattacccctagaccgtaaaacatgctatcataaaagaaagacgaaacgaatggaggaaatgccatgacttcattaatagtagaagtaattattggcattgtcattgcgggagtcatttacgaagttattcaccgaatggtagtgcaacgagcaacaaggatggtgcgacgatctgcacaagatgaaacggatgtcgctgtcaaagcggccttgcaacgtttagttaatgaacaggtgttgagtgaagcagaatgtcaaattcaatcagccgtgacggtcgcagatgtttggggccggggggttatggcgtttgaatacacattatccgtaggcatggcggctgaacaccggttgccggagcttgagcgggcatttaacgcggctctagccagttttagtgcggatcatcaggttaaaacagttagcactggttcagcgtttgttgtcagtgatatttgggtatatgaaaatcaactgcatttagatgtcgcttacctggtcaatgaatcaaccgtagaatatttaaaagatctgaaaaagttagacgatgttgttgaataaataaaaaggataccaaaatttggtatcctttttatttatcttcttaattgtaactactcaatcataatcatgtcatcatcacggctgaatggttggtctttattaatgtgatcgtaaaataatgtgccatgtaggtgatcaatctcgtgttgacaaacaatggctggatagttttttaaacgaacttggtgtttttcaccatttacatcgtaataacgtaaggtaatccgatcgtgtcgagggacaaatccgggtacatctttatcgactgacaggcaaccttcaccctcagtcaaggcaccagcttggactgattcggaaatgattactgggttaataataacatccgtaaagggcgacttaccatcttcttcaacaggaggaactaagacggaagccatctttttggaaacgccaacctgaggcgcggctaagcctacaccagcacgtagaccatattttttacattgttcagggtcttgtgaaacgaccaaatattccattaaatccttagccagttgttgatcctcttctgagagtgggaacgttacatccgctgcttcttggcgtaaaactggatcgccatcacggacaatatctttcataagaaacaaagcgattacctccgaaattaaatcataattaccacctattataacataggtattgtgaaaaatgaaatgaaaagaaaacggttgcggttttcaaaaaaagacgaaaacgggcgaacacaatagccgcaatgattcccaacaaatccgtttattcacaagtatgaaagggcttgcaaggcctgtgaaaaaatggtactttataagcgtagtcaggaaacgcaacgttaactcacttttagttaacaatttcatatcaagtgaaaggaaagtgttacttatggctaatggaagcaaacagattgtagactttgccaaaatcaaagctacgatggctgacccatacaagcacccggttcaagtcatcgatcgcgaaggcaaggttattgatccagacacgttggcaaaatattcagatgaccaacttgttgacttcatgaagaaaatggtttgggagcgtacgttacacgaacaaacaatgaacttctcccgtcagggtcgcctcggtttctatgctccaactgccggtgaggaagctagtgaaatgggtagtgttaccgcctttaaggaacaagactacctgttaccagcttaccgtgatttaccacaaatgattcaacacgggactaccgttgcaaaaggtttcttatggtcaaaggggcatgttgaaggtaatcaacatgaaaaccctaatatgatgttcccacaaatcattatcggtgcgcaatatgttgaaactgccggtgttgctttgggaattaagaagaacggcgatgaagatcgtgtcgcctttgcttacactggtgatggtgggacatcacaaggtgactggtatgaaggggttaacttcaccagtgcttatcaagcacccgctgttttctttgttcaaaacaatggctgggcaatttccgtcccacggaagaagcaaacggctgcggaaacgttagctcaaaaggcggttgccatgggtgttccttctgtccaagttgatgggatggatattgtggcggttcatgaagtttctaaagccgctcgtgaatttgccgcagctggtaatggtccagtagtcatcgaaacattaacttaccggtatggcgctcactcctctgctggggatgatccttcgcgttaccggactaaggaagaagaaaagccttggttcgatgccgatccattggttcgtttgcggaaggtcttaactgacaagggtgtttggtcacaagatcaagaagacaaattagtcgacggatacaaagacgaattcaagcaagcaatgaaggaagctgaagcagcccctgcacaaaaggtttctgatttcttgaagtggacttacaatgtgcctactccagctgttaagaaacaaattgcagaatttgaagcaaaggagtcgaagtaatcatggctaaaatgacgtatatcaaagcgatcacttccggtctggatcaagtgttgactgatgatcctaagacgttaatcttcggtgaagacgttggtaaaaacggtggtgtgttccggacaacggttgatttacaagacaagcatggtgaagatcgggtcttcgatacacctttagctgaatcaggtattttaggcttagctattggtttatcattaactggttggcggccaattcctgaaatccaattcatgggctttacgtttgaagccatggatgggattgtaggccaattagctcgtgatcactatcgttttggtggtcaaaagaacttccctgttacgatccggacaccatttggtggtgggactcataccgctgaaatgcacgctgataacttggaaaactactttgttagcaccccagggttacgagtggtaacaccttccaatccttatgatgctaaaggcctcgtgatttctgcggttgaaagcgatgatccagtcttattcatggaaaacttgaagttgtaccgttccatgaaggatgaagtgcctgatgacaagtatacggttccgttagactctgctaaggttgttcgtgaaggttccgacattacgttggttgcctacagtgctgaagtcaacgaagctttgacggctgccgatgccttggctaaggacaatatctctgctgaagtcattgacttacgttccttgtcaccaattgatacggatacgatctttgcttctattgataagacccacaaggtggttgttattcaagaagcacaacgcatggctggtgttggtgcggttgttgcctccgatattgccgaagaaaagatcatgtcattggatgcaccaattggtcgggttgcagcaccagatagcgtttacccatttgcccaagctgaaaatgattggattccaaatgccgatgatattgaagccaaggcacgtgaaatttataactattaaaaatcttaaactaattgataaaaattaacgatgtgggagacatcctgcattagatgaaagaaaggaagttttcccatggcttatacgttcaaactcccagagcttggtgaaggaatggccgaaggtgaaatttcttcatggcttgtaaaagaaggagacgcggttaaggaagacgacacattagtcgaaatccaaaacgataagtcggtctcggaattaccatcacccgtttcaggtacgatttcaaaaattgttgcccaagagggggacactgttgaaattggtgatccactgattgtgattgatgatggatcagataccccagctgatttaagcaagggtggcgaagaaaatgatgcagcacctgctgaagaagcagcaccggcacctgccgaagcgccagcagcacctgctgaaccagcagcggctccaactggagttcctgctgcttctgatcccaataaattggttatggcgatgccatcggttcgtcagtatgcacgtgacaaaggcgttgatattactcaagttgcgccaactgggaatcatgggcaagtattgaaagctgacattgacaactttaatggtgcggctgcaccagcggccacggcttcagcaactactgacgctgcaccggctggtaaggcagctgcaggtcaagcaatcaaaccttggaacgctgataaccctgatttggaaactcgtgaaccaatgtcaccaatgcggaagatcattgccaagagcatgcggacttctaaagacattgcgccacacgtaacgtcctttgacgaagtcgaagtttcagctttaatggctaaccgtaagaagtacaagcaagccgctgcagatcgcgacattcacctgactttcttaccttacattgttaaggctttggttgctgttatgaagaagttccctgaactaaatgcttctattgatgacactacccaagagattgtctacaagcactactacaacattgggattgctaccaatactgatgatggcttgtatgtgccaaatatcaaagcagcagattctaagggtatgtttgaaattgccaaggaaatcactgaaaatacgcaagccgcttacgataacaagttaagccctgcttccatggccggtggttccatcacgatttctaacgttggttctattggtggtggctggttcacaccagttatcaaccaacctgaagttgctattttaggggttggccggattgaaaaggctccttatgttaatgaagatggcgacattgctgttggccggatgttgaagctttccttgagttacgaccaccgtttgattgatggtgccttagctcagaatgctttgaatgaattaaaggccttgctgcatgatccagaaatgttgttaatggaagggtaggaataatatggcagatgttgaaaaaaaggacaccgtcatcatcggtgccggacccggcggttacgttgccgccattcgggcttctgaattggggcaaaaagtaaccttaattgaaaagtccgatacccttggtggtgtctgcttgaacgttggttgtgtaccgtctaaagccttaattcaggccggtcaccggttggaacaggccaaggatgggtccacttatggaatttctacagactcagccacaattgattttaagaagacccaagaatggaagcaaaagaaggtcgttgatcgtatgaccagcggcgttaagatgctgatgaagaagcaccatgttgacgtggtcagtggtgaagctgttttcctcagtgacacacagttacgggtaatgccgacaggcgaaaagcaattcatgtcaactgacacgggtcagactttcgagttcaataatattattattgcctctgggtcacacccaattcaaattcctggctttaagtttgatggtcgggttgtggattcaactggtggcctgaatctgccagagattcctaaagaatttgttgtcattggtggtggctacgtcggtacggaattagccggagcctatgcaagtttaggtgctcatgttaccattcttgaaggaagtccatcgattctgcctaactttgaaaaggacatggtttctgttgttctgaagaagttgaagaaaaaaggtgtggacgttattactaacgcaatggccaagagttctagccaagatgatcaaagcgttagtgttacctatgcggttgatggcaaggaatcgacaattaaagccgattactgcatggttactgttggtcggcggccaaataccgatgacttagggcttgaatacaccaaggttgagttaaacgatcatggtcaaatcaaggtcgataaccaaggccggacagcttccgaacacatctgggctgttggtgatgtggttcctggtgctgcattggctcataaagcctttgccgaagccaagacggcagctggtgcgattgctggtaagaagacggctaacgactggttaagtgttccagcagtttgcttctctgatccagaaattgcgaccgttggttacagtgaatcagctgcaaaggataaaggaatcaaagtgaagacggctaagttcccatttgctgggaatgcccgggctgtatctttggattccccagatggttttgttcgattcatctatacagatgatgacaaccaaaacatcgtaggtgctgaagcagttggtcctgaagccagcacgatggctggtgaattatcagtgatcgttaatgatggcttgaatgttgaggatgtggcgttgactattcacccacacccaacgttaaatgaaccaattcaagaaacggctgatattgctttgggcttcccaacgcatatctaaagttttgtgaaataagcagtatgtgtattgagagattagggcgaaagctctgatctctttttttgtataatactggaatcgatcagccaatagtgtgaaatacctcgcatttgtgaaaaaagccgactaacaaacttgctatccagtggggctcatttataatgtagctatgtggttatttacggaatacaccgaggaggggtgttatgaaaccgacgttaattattcaggggaccattacccaggccagtcaattattacaacaattattaattgcggatctacctttagactgtgtggtgatgcctgatagaacagaggatacaccgcgttaccagtcgttagtggtcgccagtgcattatgttcacactttgacttgcgtgttggaacaaccgctgattatgggcaagccacctggttggtcattttagatcgaacgacggatgattcggctgtggcgactgaaatagcggaactgcgggtctttatgaatcggattgttcaaaatgggttcaaaggacagctcatttttggtggcgcgcatgacgaacaactaagctactttgcttggaagttttctggacttcaagcaaatcaaatttggggattaggcacctacccgttggctcgattattaacggctaggttggcagatcatttaggcgttggttcagctgccgtacaggcgacggtgattggaacggcagacttgcccattgtcgtttggagtcgaacatatattggtccagtccccatcctgatgtatttggccaatgccgatacgaaaattagtgctgatgatttggataagatggcaaattggctgcaacgggaggccaagggagatcaaattagtttgcgcttaatggcacttattgagctgttagaggccgctttaaatgatcaaccattaattgctccagcaacgacaattcacacggaaactccggattttgcggccgcaacaccggtgctagtgacggctagtggcgttaagcatttgacgaatctaattttgtcggaagatgaacaacaagactacagcgaacaagtcacaactttgcgagctaatattgatgcgattgaaaatcagcaaacggagggacggggttagattggcagatagttatgagtacccattgatggcagagtggtcaacaacggatattattgctgttacaacactatatcagtgtgtagaagcagcatatgaacaaccacaaggagttgaccggcacgccttattacaggcttatcaggattttcaacaagtggttccacaaaagtttgaagaaaagcaacttgatcaggcgtttcagacggtctccggatatagtatttatcggactgttaaacaagcccgggcaacggacggtatggttaaaatgaagggatgagcatcagcatggaacaggagtggcaacaactaaatgaacaggttgtgtcgttgctaaaaactgcacgccagcaagtcttacaaaaaatgcaagaaccgctgacggtggcagcaaagtcgaatcgtaaggatttagttacgaatattgataagagcaatgaacaatttttaattgctggtattcgccgaattgatcctaccgcgcgtgttttaggtgaagaaggctttggtgacgctttgacggacttaaagggccgcgtgtggattgttgatccaatcgatggcacgatgaacttcgtcaaacaacacgatcatttcgcaatgatgattggtatatatcaagacggtgtcagccagttggggtacatttatgatgtgatgaatgatatcttatacgccggtggaccacagttaggtggcgtgtgggctaacgaacgtcaattgacggcgccgactgatttggcattgtctgagggcctgattggtgccagtgggccgctggtcattcacgacattgcacatatgcaagcgattgttcatgctagtgctggaatgcgggtgtacggtagcgctggtattgaaatgatccatattctagagggaaagtcattgggttatatttcacatttgaagccatgggatattgcggctggaaaaatcttgttggaaacgttgggcgttcaggtctcaactattgacgggcgaccactcgatatgctatcatctaaccttgtactagtagcgacgaaaaaagcgcaacgtgatattctccaaattgaagaagatgacgtctcactgtgacccctgtcacagtttttttatgcggctggccggtacggatggactttaccagctattgacgctacaataagcgtacttaccgaggtaagcgcgccgtgatccatctaatttaccaagcatgaaaggaagaaatacacttgaaaatcagagatgatatccgcaacattgccatcattgcccacgttgaccacgggaaaacaaccttggttaacgaaatgcttaaacaatccgacacgttagatgaacacgcgtcaatcgaagaccgtgccatggatacgaacgccattgaaaaggaacggggcattacgatcctgtccaagaacacggccgttcgttatggtgataagcaaatcaacattctggataccccaggacacgccgactttggtggtgaagttgaacggatcatgcgcatggttgacggcgttttgttggttgtcgatgcctatgaagggacgatgccacaaactcggtttgttctgaagaaggcgctggatcaacacttaacccctatcgtggttattaacaaagttgaccgtgaaggtgcccgtcctagtgaagtggttgatgaagttttggacctattcatcgaattaggtgctgacgaagatcaattggacttcccagtggtttatgcttctgccatgaacggaacctccagctatgaaccagaattggatacgcaagaacacaccatgaagccagtgtttgacaccattgttaagcacattccagcaccaattgacaacacggatgaacctttacaattccaagttgctatgctggattacaatgactttgtgggtcggattgggattggccggattttccggggcaagatcagagtcggtgacagcgttacagttatgaaacttgacggtagcaagcaaaacttccgggttaccaagctctttggtttcttcgggttaaagcgtttggaaatcaacgaagcccaagcgggtgatttgattgccgtttctgggatggacgaaatcaacgttggggaaacggttgttgccccagatacgttggagccacttcctgttttacggattgacgaaccaacgttgcaaatgactttccggaccaatgactcaccatttgctggtcgtgaagggaagttcgtgacgtctcgtcaaatcgaagaacgcttgaagcgtgaactgcacaccgatgtttccttacgagtggatgataccgataacccaggtgcttggattgtttctggccgtggggaattgcatttatctatcttaattgaaacaatgcgtcgtgaaggttacgaactacaagcttctcgtccagaagttatctacagaacgattgataacgttcgttgcgaaccatttgaatccgttcaaattgatacgccggatgaatacacgggttctatcattgataccttgtcacaacgtaagggtgaaatgaagaacatggaagctgttggtaacggtcaaactcgtttgacgttcttggcaccttctcgtgggttgatcggttattcaactgaattcctatcattgacacgtggttacggaatcatgaaccataccttctctaagtacctaccagttattaagaactggaacccaggtcgtcacaatgggaccttggtttcaattaactctggtaaggtgacgacttatgccatcatggctgttcaagatcggggaattattttcaccgatgccgggacagaagtgtatgaagggatgattattgggcaaaacagccgggataatgatatttccgtgaacattacgcgtggccggaaccaaactaacgtccgggccgctggttctgaagatattgccaaggttaagagcccactgaagatgtctctggaagaatcattggaattcatcaacgaagacgaatactgtgaaattacaccagaacatgttcgtctgcggaagcaaatcttaaatacgggtgaacgggaaaaggctgctaagaagcgccggactgccgctcgtaagtaatttaaaatttaattgaatctttaccggtgagagtcgtgggtctaccacggctgttgccggtttttttgtggtaaaaaccggcaacagctatgctataatgaaaacattcgattgccgcgtggcggtagagtagacttggagcgaatgaatcgtatgcgaaagttaaaatatttagattattggctattagtgccttacatgattttaagcatttttgggattgtcatggtttattcagcgagtgccgatattggaactcaaaatggtggtagtccgggcagttatctggtgaagcaggctatttatgtggtattgggcttaatgatcctgacggtaatggttttgatgaatttacagaaactgcgggataaaacggtcttaaaatacgcggggtatgtggcgctaggatctttgttcttattattagtaatgggacagacgattaatggggcagcaggatggtttcatgttggcccggttagtattcaaccagccgagttcgttaaattttatttgatcatttggttggctaatgtgattgcccaacgacaggaccgaatccagctagagggttggtgggtaacgatgcgtcaacccctcatcatttgttgtggcattgttggattgatcttgttgcagcctgacttgggtggtgcaacgattaacggcgccattatttttgtcatgattttggcgagtggctttaattcacggttagctaaaacgatatttgttggcgcctttttcatcatcgttggtgttttctttcccattctgatcaaaatatctgaactgggttttgctaagaacgtttatcaactacaacggattgtggcttttgtgaacccatttgagcattcgcaatcggtagggcaacagctggttaattcatattatgcgttgagcaatggtggaatttttggcgttggttggggaaatagtatccaaaaaacgggctatttaccggaacccaataccgattttattatggctatcttagcggaagaactggggctgattacagctctggcagtgattatgctgttgtttgtcattatcctgcgaaccacgttggttggggttcgaagtaattcaacgtatcaagcgctaatttgttatggcgccgcgacttacctaacagtgcagaccttgtttaatcttggtggtgtgctaggaatgttgcccattacgggagtaacttttccctttatcagttatgggggctccagtacgtggacattggcattggtactaggtttggtgatgaacattagtgcccggcagaagcggtatcgagcaactcattaattttcgaggagggttttagcgatggcttttacgattcaaccacgacaaagtttgatcgtgtatacgtatagcttaaaacaaacgcgacagttaaagcgttatggtacagtgatgtatgtctctaaaaagatgcgttatgtggtcttatatgtgaaccgagaagatgtaacgaaactcacggatcaactgacccatttacggtttgtgaagcgggtggttgcttcttcacggccaacgattaacgagacgttcaatggtgtcgccgccgaaatggtcacaacaacggaaaccgaggatgatgatgaatgagaattgtagctggagattttggtgggcgtcggttaaaggcggtccctggaatggccacacggccgacaactgataaggttaaggaagcactctttaacataattggtccttattttgatgggggtcgtagtttggatctttttgcgggatctggtggactcagtattgaagccgtttcgcggggaatttcccaggcggtcttaattgaccgacaatatgcggcaattcaaacgattaaagataacgtggcagtcactaaggcacccgagaagtttgaaattctgaaacgagacgccaataaagcgctagttgaattgggtcgtcgtggagatcagtttgacttggtgttctttgaccccccttacgcacaacaaaaaattctagcgcaaatggcacagttacgtgagttgaaagtgctagcaccagcagctcggattgtttgtgagactgatcaacaggctgcgttgcgagatgatgtaccgggatttgaatttgttgagcggcgagattacggtattacggagttgacaatctatcggttgggaagtgatgatcagtgacaattgcagtatttcccggaagcttcgatcccttaaccaatggtcatgtcgatctgattacgcgggctagccgaatgtttgatcagttaattgtgacggttggaaaaaacacctcaaagcagggcctgtttaccacgtctgaacgggtggcctttattgaggccgcgattgctgctcttccaaatgtgacagttcaagtcgagcagggattaacggttgatttcatgaagtcagtacaggctaccgttttagtacggggtatccggaatagtactgattttgaatatgaacagggtatcgctaatttgaaccgtcacttggcacctcaggtggacacggcttgcttaatggctgatcctcagtatcaatatgtttcttctagtttgttaaaagaagttgctcgattcggtggcgaccttaagcagttggtcccatcaatggttgccaaagcgatggttgcccggttagaaggtgaccattaggtgtggaatttaacgcgacggcaatggcggcagattctagtaacggtgatattagcacttgcagtgttgctattttttctgtggccattgcccaagtatattgagggtcccggtgaggcagacaatttgaaatcatttgtcacagttgacaaacatcccgataagcataagggaaaatatatgattacctcagttgcgttggcgcaagctcgtccagtttcctacctctatgccaaatttaatccttattacagcattgagagtgtagcgtcagtgacgggtggcgagagtaatgcgacctacgataaagttcagaacttttatatgaaaagcgccatcaatgagtcaatttataccgcatatcgggcggcccataaaacggtgaagcgtcattatttgggaatttacgttttgagtgttgatcgtcagtcaccctttgcccaagcgttaaaggtgggcgatacggtgacggaggtaaatggtcatcatttcaactctatgacgggatatcaacgatatatccagcgacaaaaagtgggacaacgggcgaccattacgtatcagcgcaatggtaaaacacaccacgtaactgccaaattgatgcgattgccaacgaaaaaagcgggtattggaattactttaacggataacatcaaagttagtgctcggcctaaagtgcaggtgaaccccggcaacatcggtggtccgtcaggcggtttaatgtttagcttacagatttatacgcaagtgacagggcaagacttacgtcacgggcgtaagattgcaggaaccggaacggttgatggtgacggcaacgttggcgagattggtggtattgataagaaaattatcgctgctaagcgcgcaggggcgacggtcttctttgcaccctacgtgaaaccgacaaaattgttactgaagtatgaagaacaacaccaaacgaattatcaattggctaaggcaacagcgaaaaagtatgcgccgaatatgaaagttgtgccagtaaaatcgtttgacgatgcagttcattacttaaggacacaccgttaaataacttagaagcttggttgggattgccgaccaggctttttttaatgtctttgaatatttgggaaagttatttcggagttaacccaaaggaggcgtgaatgtggaaaaaatcaaaatgtggtggtcactacttagtgagcgacagcgatggtacgggctgctggtaatcgttggggtattaggaatgggtgggtggtggttaaccagaccagttgctaacccagcgtttccagcaagtgtccctagtgcaacgcaagcgtcggcaacaagtcgagctggtcaagtggcaaccagcccgacagccagtaatagtcaggtggccagtagtcacgatgagcgagtatttgtggacgttcaaggcgcagttaagcatccggggttataccagttttcatcaaccatgcggatagctgatgccttgaaggcggcggggggactagtggaacgagctgatcgacaacggattaatttagcaatgcgcctgacggatcaacaacaggtttatatcccactgaagggggaaaaggtgtccgaaacagccggaagcgtcccaagcgggtcaaccgccactacggcaagcagtcaggcgacagggacaccagttgcggtagtcaatttgaataccgcaaccgtaaccgagctccaacagttgaccggaatcggtgaaaaaaaggcccagaagattgtggattatcgcacggatcatggtcatttccaatcggttaaggacctcgcacaagtaccgggttttggcgaaaaaacggtggctaatttacaagatcagctcactacttagccggtggtggtatactgataaaataacttaattaaaggagcaatcaacgtgaaacgagaacgaattccctgggatcaatactttatgttacaggcgttggtgatgtcgacacgaagcacgtgtaaccgtctgtcagttggggcaacaattgtccgtgataagcgaatcattgctgccggctataatggctcagtatcgggtgatgatcactgcttagatgagggatgttacctagtcgatgggcactgtgttcgaaccattcacgctgaaatgaatgccgttttgcagtgtgccaagtttggtgaagcaactgatggtgcggaaatttatgtcacggattttccatgtttacaatgcacaaagatgttattacaagcggggattactaaaattacgtatatgcgtaattatcataatgatccatacgctcagaagttaatcgctctaaagaacgtcactttgaatcaagtgactgtcgatccggcgttgttaacgcacctctcgtttgatcaacccgaaacccattagtgggtcataaatacgcgttctttatggtattaccgttggtagcggtaagcgtgatagttggcggccacttttggggtggtctaggtcttttaggcctaacactggggcgtattcttgccttacgaaattggaaagtagccctgatggcggtgattgccgtggggggctttagtggctatctgttaggtcgcgagcagcaaattaatcggcgacagttaccaattgatgctaatcaatcggttaatgtggcactcaggatccagcccgacgcagtcgttttacggggcgctgcctattatctggtcgcccaaaacgttcaaaccggtgagtggatgagtgtccggggctatgccaaatcggcagttgagctgcatgcgttgcagcgactgcagcaaccgcagatctggcaggtggcaggacaacagcaaggaatcctaccggcgacaaatgttaatcagtttgatgcagcagcttattggcggcatcgcggaattgttaagtcacttaaaataacgacagtcaatcaaagatcaccggcaacgagtcactggtatcagtggtttaacgattggtggcatgttcggcgagcacaacttattcagtattgcgatcagttgcccggtgcactacggatttatgcattgggattatttccggggagtcgggcagcagagacggccaatgaacttcaagggatgcagcaattggggttattgcacttgtttgcaatttccggattacacgttgccctattattaacagcattggaatgggtgtgtgtgcatctgaaaatacctcgagaacattgggagtggctcacgttactcagcttacccggctattttatactggctgggagtaatagtggcgttttgcgggcttgtttgatgcgtggtagccaactggctagtaaaaaactgggaagccaggtagacacgttaacggcttggtcatgggcattatttgtgggtttactgatcaatccgggattagtatttgaattgggaagtcagctgagttatggtttgtcgctgggactgatttttttaacgcaagagacacattggtggcggcagatcgggttaaccttactcgggctacctagtctgcttaatggtgtctatcaatggcatggtttaacgttactggccaactggttgattgtcccgctgtttccggtcgttattttgccgataaccatcgttggaacgcttagctttctttggttaccaggacttagtcacgcgtgtgcctttttattagaacagttagaccatggtttacggcttgttggtagttggccagggaatattttgtttggtaagccgtggtggggattttgctggttatggtggggcagtgcgtggtggctgttctcaaaaccagttgctcagcgccggcgttggttacttggtttattggctagctatggtctagcgtttggtgtcattcatttaccactccacggagaggtcacttactttgatgtgggacaaggcgacagtattttaattcgcgagccgtttaatcgtcgggtgaccttaattgatacgggtgggcatttgtcctttgcgcagcctaaatgggtgcccaaaacagttcccacgtacgccgccacccagaccaatattaactatctaaagagtcgcggaatcagtcatattgatgacctttatttatcccaccatgatgccgatcatattggcgatttaccagcaattttacaagcctttcgagtggagcggatcttagtcccggctgggatggaaaccgagacgggctggcaacatctattacggggcgtgcgtcaatcaccgcctgtggtgcccatcacggttgggctgcaaccacgcttacaggttcggcatccatttacggcagcccccgcagaaaacgggcaatcaacagtccttcagggatcctttggtggcttgaatttcttgtttatgggggatctggatcaggctggagaacgggcgatgctgtcggcggatgtgcacttacggacggacgtgttaaaattaggacatcacggcagtaagacggcaaccgcaccggactttgtggcccagattcagccacggttagcgattatttcggctggtcgtcaaagtcggtatggtcatccccatgaagagaccttgacgaccctacggcaggcacaagttccagctatcagcacccaaacaagcggtatgattcgctatgtttacgccggtgaccatggatactggcaaactaaactaaaaggagtggtcaaacagtgaccattaatgaacttttaaagactttggcaacggggcaaaccttatctaatgtttatgtcattttaggacaagcggattattttcaacgacgactcaagcggggctttaaacaacaagtcccagcggaagaacaaacgatgaattttgccagttatgatatggatacggtacctctggcggtggctttggatgatgccatggcagcgccgttttttggtgaacgtcgggtagtatgcattgataatccccagtttttgactggggaaacgaaaaaacaaaaggtggagcatgatatagatagtctccaaaaatacttagaatcaccgatgccgagtaccgtgctggtgttctttgcgccgtatgacaaattggatgcccgcaagaaggttaccaaacaattaaaaaaagtggcaactatagttgaaattaatcaatttagcgaacgtgatgtgcgacagtttgtgacggatcaattaaagcaggatgggtatacgctggaaccagcggctttaaatgacttgattcaacgaacagatgctgatttgacactcattatgagtgaactacccaagttggagttgtatacattacctgaaaagactattacccaagcggcaatctctgggttagttacccaaacattgacccaaaatgtttttgatttggttaatcgtgtattagcaaagaatacggcaggggcggtaaccttgtaccgggagttattgcaggcaaaagaagaaccgctaaagattaatgctattttgcaaggacaatttcgattgttgattcaaaccaaggttttggccaagcagggatatagccaaggcaagctagccagtatccttaaagtacatccgtaccggattaaattagcactgcaaacgcatcgccgattccaattgacagacttgaatcgcgcttatttgggcctatttcgggtggagaagcaaatgaaatcgaccactatggatcctgaattgttattttcattatttatgacccagtttgccgggacggcagcataagaagcagcaaaaaagggcgttgaccatatggtcaacgccctgattgcatcatctaatcattttgattaattgattatttagctaaacgtgcagccatccgtgacttgtcacgggaagccttattacgcttgattaagccctttgaagcagccttgtcaactgcggcactagccttacggtataattcttccgcattgtcggcgccagcggtcttagcttgttcaaaacgcttaacggcagtccgcatcgtactcaattgagcagagttacgttcgttagcctttacgttcgtcttcgcacgttcgattgctgatttgataattggcatgaaaatttcacctccgaatgagatatcctggtaccggaaatcttaatttcaacgtaagttattatacagaagccgccgaccgaatgcaatagctgagaacgattaaatgtaaagtaattttacttgataggctgtaatgggaaaaagcttgctatttaatgcgaattctcgtatgataaataactgtgctaagcacaaacctcttacttagttcgtcaggcggccaccgccggcttactcagttcggggcacttatttgaaaggtggtacttttaccatggctattagtcaagcaaagaagaacgaaatcatcaagcaatacgctcgtcacgaaggtgacacgggctcaactgaggtccaagtggctgttttgaccgctgatatcaacgaaatcaacgttcatatgcaagaacaccgtaaagacttccactcacaacgtgggttgatgaagaagatcggtcaccgtcgtaacttattagcttacttgcggaagactgacgttcaacgttaccgtgaattgatcaagagcttaggcttgcgtcgttaattcgtcgcaccgagtccctttccatctttggagaggggcttttttctttgccctcgcaaccagatagttctctaaaattgtaaagtatggtagactgaaagaagtttaatcatggacgaatgtgggcaagtctgcccagcagaaaacactggcaatcagctaggattgaattgaaacgataaaagatacttgaggtgaacttatgagtgcaaagattaaaattatcccgtttggcggtgttcgcgaaaatgggaaaaatatgtatgccgtcgatgttaacggcggaatttacattcttgattgtgggttgaagtacccggaaaatgaattgttgggaattgatgttgtcattccagactggacgtatttacgggagaataaggaccgaattgtggcggttttcctaacacatggtcatgcggatgcgattggggcactaccttattttctgagcgaatttaatgtgcctgtcttcggatcagaaatgaccattgccttggctaagattaatgttgccgatgaaccgaaaattaaaaagtttgatgattttcacgtcattgatgaaaaaacagaaattgattttggcgatgtagtggtttcattcttctcaaccacgcattcaattcctgaatctttgggaattgatttgaagacagatgaaggacaaatcatctatacgggtgatttcaagttcgatcaaacggctaagccgggttatcaaactgactacgcacgtttaggcgcaattggtcaggccggggtcttagcgctgttaagcgattcggctaacgctgaaaatccggcgatgaacgcctctgaacagagcttagcagagtcgattgaagaaacatttcactatcgagatagtcgtgtgattgtggcttgtgtggcgtcaaacattctgcgaatccagcaggtcttcgatgcagccgctaagacggggcgcaaggtttgtttaaccggtaaagatttagaaaaaatcgtgaatacggccatggaacttggcaagttgacgtttgatgccgacttattggtgactacggatcaattggatgatttggcacccaatgagattgttatcctacaaactgggaagatgggcgagccaattaaagccattcagcggatggctaataagcaggaaaaggactttaacattcaagcgggcgatttggtgtacatcacgacaacgccatcacatgcgatggatacgacggttgcccagacgcgagatatggtctatcgagcgggtggcgaagtaaaagccatttctgatgaattgaattcgtcaggtcatgcttacaagcgggatttacagttgatgttaaacttgatgaagcccaagttcttaattccaattcaaggtgaatatcggctactcaatgcccatgctgacgcggccatggagttaggtattccagccgatcacatctttatcttatctaagggcgatgttttaacttatgctcagggtgatatgggcttaggcgaaggtattgatgtgagtgataccatgattgacggaattggtgttggtgacattggaaatattgtattacgtgatcgtaaggtcttagcagacgatgggatctttattgcggtggtgacaatcgatcgtaagaagaaacaaattgtggctgatcctaagattacatcacgtgggtttgtttatgttaaggccaataaggacttgatgcaggaaagttcacaaattattcgtaaggcagttcagaataatttggataacaaagagtttgactggggacacttgaagcaagatgttcgggaacaccttagtcattacctgtttgaacaaactcaccgccggcccgttattttaccggtcattatggaagttaaccaacatcaccgacggacgactaaggaaaagccaggtgccggtgcaacaaatgaaaaaccggttactaagtcagcgcctaaagctaaagctgaacaaacagctaagccgacgcataagccacgtcgtaaccgtaagcggcggccaacgaaaaaaacgacaacagataacgcataaatttaaaacgggtcgccagtccagttaggctagcgacccgttttgccatcactttaaggaggcctattggctatgacagagttttccagtccggctgcacgcgaggaggcattaaatgccgctcgccaggcttttgacaagcaacagtggtcacaggccagcagtttgtttgaacgtttatacacggacgatcagaccccacagcttaatcataaagtggttgccagcctgtattacgatcagcagtatttaaaggcagaacaacttgctgctgagcaggacggtagttatttagacagcgaagctgattttcaactgcggttagatgtggccctagaaaaccagcagtttatttttgcccgtgaattttgtatgttaccagctgccaagccttggcgtcaaagtggactggctcaaattacgcaggccgagacacgttcgcaatcacgcttagaagaaaagcagcggattgtggccaagcagttctatcatttgggagatgtgagcttcctggaacaacgccaacgtttagaacaggcgcgtcaactaccattagatttgtttatgcagggagttcagtacttgctagttgatccatttttacatccactaatgcgagcaactttactggaggagttgttgcgactacgagtaacggctaccgtgaaacttcattggttggatgaccaagttcacacgttgaagacccaggatttaagaccagttaatgccagtcgtgcggctgcggctattcagacttatctccaaggacaactgggacaacaggacccgatcttggctgctaatttacagcaaacagttacgttacagttaatgatgctctatccgttcatcgatcgcgtaatcacctatccgcaagcttgggtccaattggcgggagacttaccggtaactggaacagtttctgatgagcaactggcacagatacgtgactggcaagcgcgtttgaacaagtatctgagtgcccttttaggtgaataatcgggtaaaataccgaaaaacctgaaaatgagtgattttttagtttacaaataattctgcagcatatatactggtcaaggattcttttttgggagggttccagctttccctttccgaaaagaagtagtataattttacgcaaagggtgattaattttcgttttcgagagttagtcatgcttgcgataaaatacaggagggtttcattaatggctgaaaaagaacattatgaaagaactaaaccccatgtaaatattggtactattggccatattgaccatgggaaaacgacgttaaccgctgctatcactaaggtacttgctgacaaaggtttagcaaaggccgaagattatgcagatatcgatgctgctccagaagaacgtgaacgtggtatcacgatcaacactgcccacgttgaatacgaaacggaaaagcgtcactatgcgcatatcgatgccccaggacatgctgactacatcaagaacatgatcactggtgccgctcaaatggacggtgctatcttggttgttgctgcaactgatggtcctatgccacaaacgcgtgaacacatcttgcttgcgcgacaagtgggtgttgactacatcgttgtcttcttgaacaagactgatcttgttgatgatgacgaattggttgacttggttgaaatggaagtccgtgagctcttgtctgaatacgattaccctggtgatgacattcctgttatccgcggttcagctttgaaggctcttgaaggcgacgaagaacaagaaaaggttatccttcacttgatggatgttgttgatgattacatcccaactccagaacgtgaaaacgacaagccattcttgatgccagttgaagatgtcttcacgatcactggtcgtgggactgttgcttctggtcgtatcgaccgtgggactgttaaagtcggtgacgaagttgaagtcgttggtttacatgaagacgtactgaagacgacggttactggtcttgaaatgttccgtaagacgttggaccttggtgaagccggggataacgttggtgctttgcttcgtggtgttaaccgtgagcaagttgttcgtggtcaagtgcttgcacaaccaggttcaatccaaactcatgaaaagttcaagggtgaagtttatatcttgagcaaagaagaaggtggccgtcatacgccattcttctcaaactaccgtccacaattctacttccacaccactgatatcactggtgttatcgaattgcctgatggtgtagaaatggttatgcctggtgataatgtgacgttcactgttgaactgatccaaccagctgccattgaaaagggtacgaagttcactgttcgtgaaggtggccacaccgttggtgccggtaccgttacggaaattgacgactaatttcgattagttagtaccgagagggctcgaaaagtttaacttttcggcccttttattttacgcaaaattgagtggcgaaagactactgatgatagcggttttctgtggaaatgaattttaggataaatccgcgtcattcatggactttcggcaaaaatcattttacaattgtcgatgggtaaggtacactaagaaagtatgcaattgatagaattgtaaatagattattatctttcatttcggagggaaaatcatggctgcaaagtgggaaaaaaaggacaataaccaaggcgaattaacctttgaaattgccccagataaaattaaggaaggtttagacaaagctttccaacggacaaaaaagaacttagcggtacctggcttccgtaagggccgtgttcctcgtcaaatctttaaccaaatgtatggtgaagaagcactctaccaagatgctttaaacattgtgttaccagaagcttacgatgctgcgattaaagaagctggcatcgaacctgttgatcaaccacaagttgatgttgaatcaatggacaaggatcaaccatgggtattgaaggccgttgtcacggttaagccagacgttaagttgggcgaatacaagggcttgagtgttactaagcaaaacacgcgggtttaccaaaaagatatcgatgctgaaatcgaaaagcaacgtcaacaacaagcagaattagtgcttaaagaagacgaagctgctgctaagggcgatacagttgtgatcgactttgacggttacgttgatggcaagcaatttgatggtggtaaggctgataactactcattggaattgggctctaactccttcatccctggctttgaagatcaattagttggtcacaaggcgggcgaagatgttgatgttaaggttacattcccagctgattaccaagctgaagatttgcgtgataaagaagcaaccttcaaggtaacgatccacgaagttaaggaaaagcaattgcctgaattggatgatgaatttgctaaggatgttgacgaagatgttgacagcttagaagaattagaagccaagaccaaggatcgtttgaaggaacaaaaagtcacggctgctcatgatgcaatcgaagacgaagccatcagcgaagctgttgacaatgctgaaattgctgcagtacctgaagctatgctcaaagatgacatcgatcggcaaatggaccaatacttggccaacatgcaacaacaaggtatcgaacctaagatgtacttccaattgactggaacgaccgaagacgatttgcgtaagcaattcgctgatggggctgaaaagcgggttaagaccaacttggtactagaagccgttgtcgaagctgaaaagatcgaacctagcgaggacgaagttgctgccgaagttaaggacttagctagccaatatggtatggaagaaagtgctgtacgcagtgccttgtccgatgacatgttgaagcacgatattgctattaagagcgcggttgacttgattgctgactctgctaagcaagacaagaagaaggatgccgaagacgacgaataatcgctgttgttagacatgaccgggacgacaggcactgttgttccggtttttctgttattttgtgagtttttgcgaccttaaaaggaattggcgaggcgaattaattttctccggtcaataactgtggtatagtacacgattgatagggatcgggtgtatttttccggtttactgacctaagcaatttgtaattatagcaagcgcttgaagagaaagggtgaagtttattgtttgaaaacaccgaaacagaaggaccagtgacctgctcgttttgtggcaagacacaggatcaggtgcaaaagatcgttgctgggccaggtgtttacatctgtaatgaatgtattgacctttgcaaagagattattgatgaagaatttaatcaaactgctgcacaagaaacgttggaagttcccacaccagccgatattgtcaagacgttaaatcaatacgtgattggtcaaacagaggctaagcggaccttgtcagtagccgtctataatcactacaaacgggttaacgaaatggctcaggagactgatgatgatggtccagaattgcaaaagagtaatattgccgtgattggacccactggttcagggaagacgtatttggcgcaaagcttggctaagattcttaacgttccctttgctatcgctgatgcgacgaccttaacggaagccggttacgttggtgaagacgttgaaaatattttgctgaagttgttgcaaaatgccgattacgatgttgatcgggccgaaaagggtatcatctatatcgatgaaattgataagattgccaagaaggctgaaaatgtttccattacgcgagatgtctctggtgaaggggtccaacaggccctattgaagatcttagaagggacaattgctaatgtgccacctcagggcggacgaaagcatccccaacaagaattcatccaaattgatacgaccaacatcctctttatcgtgggtggcgcgtttgatgggattgaaggcattgttaagcgtcgtttaggggatcagaccattggctttggtgctgatagtcaggaacagcatgtcctgtcttccggtgatagtctgatgcaacatgttattcctgaagacctattagaatttgggttaattcctgaattcattggccggttgccgattttgacggcacttgaaaaattggacgaaaatgatttagtccggattttgacggagcctaagaatgcactggttaagcagtatgaaaagcttttggccttggataatgtcgacttacaattccaaccagcggctctgcgtgagatggcaaagctagcaattgctcgtaatactggggcccggggattgcggtccatcatcgaagatgtgatgcgtgacatcatgtttgacttgccaagccgtaccgatgtggctaaagttgtgattacgccagaaacagtgacggaacacgctgaaccagaattagttttaaaggatcaaaaagcatcataaagaactcatttacacggagagtgactagctgatgggctagccacttttttgttggacgcaaagtagggccagacgggctttattcgatgatctcacataaaaagctaagagattcatgccagtcagctcacgttctgtgttaaaatgatgaaagagattttggagaggatggcatgaactaatggaagtcaatcatgtagaattagtgatgagcgcggttgatcccgctcaatacccaacaacggggtatccagaaattgcgttggtggggcgctcgaacgtgggaaagtcctcattaactaatgtgttaattaaccgtaattcgtatgcccggacgtccagtcaaccagggaaaacccagacgctgaacttttataacgttgaggaccagctttactttgtggatgttcccggttatggttatgcaaaggtctccaaaacagaacgagaaaagtgggggcagatgatcgaaacctacctgactcaacgcgatcaattgcgcggtgtgatttcgttagttgacgcccggcatgcgccaactgaggatgacattcagatgtatcgttggttggcttattatgagttaccaacgctgattgtggcgacgaagagtgacaagattgctcgcggaaagtggaatcaggcggttagtcaaattaagaagtcactggagttgcctaatacagataatatcgtgatgttttcgacgccaaagaaaatgggtaaggatgccgtgtggaactggatcgaagcccaagcatttggaggcgaataaacatggaatttaatgagtatcaacaagctgctaatcgaaccctgtatggcaacgaacaggtcttaacgaactgtgcactcggcttagccggagaaaccggacaagtggtagacttggttaagaagtatacgttccacggcaaggatctcgaccacgatgccattgtgaaagaaatgggcgatgtgttgtggtatctgagtcaaattgcccagtgggccgatattgattttgatgaagtggcacaggccaatattaaacgcctgaatgcccgttatccacatggttaccaaccaaatcggtaacaaaaaaggacgacccttgtggtcgtccttttcgattgatttaatcgttggcgtgtttctggtcatgtttgagttgatcgtctttgatcaacgctttacccttcttgtcacccttgtgatcgtcttgacgctttaagaacttgtcccgcttaacgtcagtagggtccatttgggcgaatttgccaaacatggaatcaaggtcatcttgtcgtttaacttttaatgccaaattgaggcacctccttgcttttccgttatcatagcagaatttgacgcgtttgtcatttttgactcatgctggtcaaaagggatttcacttgcaccaaacaaacattcggcatatactttattagcttattaacacgcctaaacgggagggattatccttggcatcagaatacttggagcataagcttgcgttactgccgggccttcccggctgttacctcatgaaaaatattaatagtcaaatcatttatgttggcaaggctaagaacctaaaaaatcgggtgcggtcttactttaagagtagtcacactgggaaaacggcacagttagtcagtgagattgttgactttgagacaattattacgtctacagataaggaagctttcttattagaaattacgttgattcaaaaacatcaaccttactttaatattaaattgaagcggggaacgggatatccttacattaaaattactaatgaacgggatccccaactgcttttagtgagtgatattcggaaagatggcgcttattattttggaccatatccgaatgtttacgcggcagaagaaacaatgcacttcttgcaaaaggtttatccgttacgtcggtgtcctggacatcaaggccgaccgtgcctctattatcatatggggcagtgtttgggtgcctgttttaaagaggtgccagaagcggagtatgaccagcagattcgcaaaattaagtcgtttttaaatggcaacgtgggacatgcgaagaaggatctaacgcaacgcatggaaaaagcagcggcggatatggcctatgaacgtgccggcgatctgcgtgaccagattcgctacattgaagcgacagttgaaaagcaaaagatcatttctaatgacagtacgccacgagatatttttaatttttatctggataagggctggttatccattcaggtattctttattcgccaagcccgcctaatgaagcgcgaaaagcgactctttccggtggtcaactcagcggaagaagaactggctagctttattgttcaattttatcagcgcaaaaatacagtcttgccgcgtgaaattttagttccggccagtatcgaccatgacgttatcgaagagctgctaaaggtgcccgttagaacgcctcagcgggggactaaacgcgatttgctagagatggcagggaagaatgccaaactggtcttagaagagaaatttcggttattggagctggatgaaggcaagacaaccggcgcgatgaaagaaattacagatgcgttagggattgcaccgggacacaagatcgaggcgtttgaccactcacatatccaaggcgccgatttggtctcggcaatggtggtctttgtcgatggtcaaccgaataaaaaactttaccgtaagtataaattacaaacggtcgatcatgctgatgaaacggctagcacgttagaggtcatccggcggcggtacgggcgattgcttaaagaacatgcgccaatgcccgatctaatcttgatggatggtggtgacatccagatgaatgccgttaaagaagtccttgaagacgagtttgacttgcatattccagtcgctgggatggtgaaaaatgatcatcataagacggccgatctcttatttggaccggatgaccaccatgtccatttggaccctaaaagtcagggcttctatctggttcagcggattcaagacgaagtccatcggtttgccattagcttccatcggcaagtgcacaccaagcattccctgagttcacgtttagatcggattccgggagttggacctaaaactcggaataaattattgcgcaaatttggctcgacaaagaagattagtgaggctagtatggccgaaatccgggagttgggtatcagcgaagcggtggcacgaacgattcacgttaccttagccgcggaaacggccgagattaagaatcctcgaaccccaacgagtctttgacgtgacggccgtttgccggtatactgactagcaggagattaacagagcagacagcacgggctgactgagaaaacgaggaaattaattatgtttgtagatcaagttaaaattaatgtgaaagccggtaacggtggtaacggaatggttgcctttcgccgggaaaagtttgtgcccaatggtgggccagccggtggtgatggtggccgtggtggaaatgtcgttttcgtggtcgacgaaggtttacggacactgatggattttcgctatcagcgtaaattcaaggcgaagagcggtggcaacggggcaatcaaatcgatgaccggtcggggggcagaggacacaattatcaaggtgccccaaggaaccacgattatggatgcggaaactgaccaagtcattggtgatttggtggcccccgatgattccgttattgtggcgcatggtggtcgtggtggacggggaaatattcactttgcctcgcccaagaatccggcacctgagatcgcagaaaatggcgagccaggtgaggaacgtgagattcgtttggaattaaaagtgctcgccgatgtcggtttggtgggtttcccatccgttgggaagtcaaccttgctatctacagtgacgagtgccaagcccaagattgcggaatatcattttacaaccttagtaccgaacttaggtatggtgcggttgccagatggtcgtgattttgtgatggccgatttacctggtttaattgaaggagccgctaatggtgtaggcttgggattccaatttctgcgccacgttgaacgtacccgggtcattctacatttaattgatatgagtggtctcgagggacggacaccttatgatgactttgaaaagattaatcaagagttgcagacctatgatcctgacattttgaagcgaccacaaattgtggtggccaataagatggatatgccggattctgccgaaaacttggctcaatttaaagaagatttgaagcaggatacgctattagcgcaaacgccagaaatctttgcggtttctgccttaactcacgacggattgacgccgctactgcaacgtacggcggatatgttggcagaaacgccacaattcccagttaagcagccagaagtggctacaacggcggaatataacttccagccagaagccggattcaccttgaatcaggatgccgatggtacatggatcttgggtggcgacaagctggttaagttatttaagatgaccgacgttaaccatgaagaaagtctcctacgctttgcccgccaaatgcgggggatgggtgtcgatgatagcctccgtgaacatggggctaagaacggcgatttggttaaaatcgacgactttacctttgaatatatggcctaacaaaaaagacgtgaccgttgcgtacgggacgtcttttttgtttgggcttaaactgttagtgttaaccagtcagtgggactaaccacttgtttttggttaacgtaagcgccagcaaaagccactttaatggttttgaacgttggtttcgttttttcgctggccaggccagtcgcaaaggtggctagttggcccttaccagcaatcgttttacctgcgctggcatcacttaattggttagtcgcatttagttgctggttagctgataagcggatcgctttaatgccatcggtcgtgacggcctgctttccgtggttgtaaatggtaaacttaagttgaatcgtatagtagggactcttcaacgcgctgaggtttagggcttgagctgccattcgcttggcggcggcagtctcggctgtgtttttaatcaggcgaacagtcgtaattttataagttaattggccgctctttaaggttgtctggggatgctttactttggtcagttgtaaccgtgtgccgaccttatcgtaagtgaactgtcccgacttctttaggttaccggactttacgtagctggcacgcttcgtttgagaagctgcaggtcgataagtttgcgcttctgaggaactagacgatgatgtggccgagacagcggcgtcgggattggcggcgctgtaatggcggctggactggctactgctgtttttaaagctagtggtgctcttttgtgcggatgattggcagccagccaatccgagtactagaagacttagaccggctaacaccaaggtttgatgtaatctcatgaaaaaaactcctttcaacctaataaaataagatgggtaactaaacgataaccgtatagtcgttgtgccggggtgccggcgatgaagagggcggcgtgcggatcgacttgctgacagcgcgcccgaaactgatcgagtgttaggggccggccagaacgcgtgattaataaaagttgatgcgggcctgtctgtaaatcagtaatggcgaaacgctggtcgtgatgctcccagtaaagggccagtccgggatgtaaatcagcagtggaacggttaaagtcaatgagttgcatacaacttcctcccccgaagtctggtttttctgctttaagtataccgaattttggtggggaaccctagcaaaattactgatttggataaacggagcgggaaaagttgcggtttggtctaaaatcccctaaaatagtgaacggactttaaatatagaataggaacgaaaaaaatatggaaattgaatttttaggaacgggcgctggttcgccaggaaagttccgtaatgtaaccagtacggcattacggctgttagacgagcgaaattccgtttggctgtttgatgtgggggaagccactcagcatcaaattttacggacaacgctcaaaccacgtaaaattgataaaatttttatcacccatttacatggtgaccacatttttgggttaccaggattgctaagcagtcgttcctttcagggcggcgatgccccgctaaccatttatggacccaaaggaattcgaaattttgttgaggtgagtctgcgtgtttcggaaacaaagttgtcgtacaagattcggtatcaggaattaacgactgatggcttagtttttgaagacggtaaattccgcgtgtatgcgcaacacttggaccaccggattgaatgctttggttatcgtattgaggagaaggatcatccgggtgaactgcaagttgagcaacttcaagcggctaaaattccttctgggccggtatatgggcaattaaaggccggtaagacggtgactttaccagatggccgcgtgattaatggcgctgatttcttagggccggcacaaccagggcgaattgtggccattttaggggacacgcgacaaacgcccaatgcagaaaaattggcgatcaatgcggatgttttggtccatgaaagtacgtttgccaagggtgaaagtaaattggcccgatcctattaccactcaacgaatattcaagcggcggagttggcaaaacggatgcacgttaagcaactgctgttgaaccatatttcggctcgttacaccggaaagatggcggctgagttgcagcatcaggcgcgtgaagtctttaaacagacgcgggtcgtcaaggactttgatgagattgaggtaccatttgagaagctaacgaaggagggaacgccgtcatgaaaaatcagtggcgaatcgtgatcactattttattggttattgtggttgccgtttttgcaattcttaacgtggagagtgtcccagtttcatttggattcacaacggttcactggccactgattctcattttgttggtgtccattctgatcggtgcggtgctaatgatcttgttctccacgattacggttttccagcataatcgcgcatataaggacttagaacaagccagtcaggagcagttagctgctttacaaaaggaaaatgatcagttgaccaaacggctgcaaaactctaagagtaagcagataacggggcaacaagaaaagcaagtgcaggaacttcaagcacagattgctgacttgcagaaacaattagcaattaaataggtttattgagaagagtggtgccattgacaccgctctttaccgttttagaaagggtggttcggacgtgattgctgcacactatcattggaatattaaacacgttgaccggccgtcagctgaagctcaggccttggcaactgcggcggacatttcgcctatcgtggcccaaattttgtggaatcggggataccagacggcaccagctgcacatgattttttaaatccggggccggagcaattgcatgatccttccttgttgcatgatatggataaaggcattgagcggattgagactgcaattgatgaagaacaacagattacaatttatggtgattatgatgcggatggtgttaccagtaccgcgattctatatgaaacgctcaatgagatgggggctaaggttaattactatattcctaatcgcttcagtgacggttatggaccgaacgtcgcggcatttgaaaaactaattgcggccggcacacagttatttgtgacggtggacaatggggtcgccggtaatgaggccattgcagcggccaaaaaagctggggttgacgtggtggttaccgatcaccatgagctgccagaagaattaccggatgcttacgcgattattcacccccggtatcccggagctgaatatccatttggtggcttgtccggagccggggtcgcctttaaggtggcacaggcgttacgagaagaaattccccaagacctattggatttggcggcaatcggaacggtggcggacttagtgccattggtggacgagaatcgcgtgctggtttattttggcttacaactacttaaacaagatgagcggccgggcttactggccttaatgcaaacagctggaattaaatccgatgacttgacggaacagtctatcggatttgggatcgcaccacggctgaatgcacttggacggttagatgatgccagcccggcggtagagttattgacaaccgtcgatgaagctaaggcagaagaattggccaagatgacggagcagaagaatcgtcaacgccaagagctcgtccagtcgattagcaccgcggctttacaacaagcagtggatgcagatcaccaagaccgggccacgcttgtcattagtggtcatgattggcatgagggcgtattgggaattgtagccagcaaagtggttgaggcaacgggaaaaccgaccttggttctgaacattcaagcaggtcgtgccaaagggtctggtcgaagtgtggaagcctttaacttatttgcggccttagatggtcatagagacctgatgacggcctttggtggtcatcacatggccgttggcttaacggtccctgaagaccaattgacagccttagccgatgcgttagatgatgaggctcaaacgcaagcgctcgctcaaagtggtcctagcgaactgccggtagccgcgacgttaccggttgcggccgttacgccatccttatatcaggagttggcgcagctggcaccgtttgggacggataatctacagccgctatttgcttttgaatcggcgacggttactcaagttaaggtgattggtaaagaccatagtcatttgaaatttcagttacaagaaggacaacaccaattgaatgccattcaatttggcgcggcaaagtacgttgatgatcttaccgcagcaccagatgatgcggctgttttggggacgattgaggataatgtttggcagggtcgccattcattgcaggtaatggtcaaagacctcaaaacgagtgtaacgcccgttcaagatcaacgaacaacgacgttgcatgcccaaatgtttacgacagtgggtgtctacgttttctttcaccgcaatatctatcaacaattgcggtcacaactgccggagcaggccacggcaatcctagttgatgggacgacgcaggcaccagtaacggctgaacagcgggtatttatcgttgattgcccggatatgacagtcgacttaacgaacgtgctacagcaattacgaccaactcagctgacggtttatctctataagaaagaaagtctttcgcaattagggatgccaactcgcgcccagtatgctaaactatttaagttcgttgcaacccatcaacaagttgatgtggggcatcaactggcccaattggcgacctttttacaaataccgaaaacccagttggtattcatgattcaagtgttcttcgagtgtggctttatcacaatcgcacatggaatgatgaacggtgtggcaaacccggcgcataaagagttaacgacggcaccgagttaccaattacgacaacaacaaatgcaaacggaagcagaactcttgcagtgtccaaccgcggctttgttgcaacgtctacatgccccatttgaacaaaaataaaggagctactcaatcttatggcaactgattttacgaaatacattgcaagtgttccagactatcctgaaaaggggattatgttccgtgacatttcaccactgatggcagatggtcaagccttccatgcggcaactgatgagattgtcgcttacgccaaggataagggcgttgaaatggtggttggtccggaagcccgcggttttattgtgggctgtccagtggcttatgaaatgggaattggttttgcaccagctcgtaaggaaggtaaacttccacgggagacggtgaaagccagctacgatctagaatacgggcaatcagccctatatttgcacaaggatgcgattaagccaggacaaaaagtcttggtcacagatgacctgttggccactggtgggacaattggcgcaactattcaactagttgaagacctcggtggtatcgtggttggaacggcctttttgattgaattacaagatcttcatggtcgtgacaagttaaagggttatgacatttttagtttaatgcagtactaagtagaaaagcgccaatcaacttccgattaggaaagctgattggcgcttttgattaacttgaaattattggtcgtcttcttcgggaacgtcattgacgacaaagacattcggctcggcgtgctgaacaatatagttagtggttgaaccaatcactaaccgggagaaggcgttagtcccggacttaccaacaacgattaaatcaatacctaaatcagcatcgttggcaatctccgtaataatttgtttaggagcaccttccttgaggatcatgtcagcatgaaccccagcgttgtcagcgacctgttttgccttttccatcaattcacgaccgttttgccgcattgaggtaaccacttcgggataacccgcgcctaatccgcgggaggtaaactgcgcaatatcaatgacgtgtaagatcgtaatagttgcgtgccagtccttggcaagtgaaacggctgtgtttaaggcttcagcagcattgctggaaccatctaacggaacgagtagtcgattatacatggtcaagacctccttgtggaattcggtgggggatgagctattttttggcgttatctaaatgttctttggcactatcggcagcaccctttaaagactctttagcttgggcaaatttgtctttggccttaccggctaattggtcggctttgccttcggtttccttttgcttatcacctgtgactttacctgtgacctctttagctttaccttgtaatttatcctttgctgcgtcgcctttagttgaactcatagatatgacctcctcttaatttactaatcgtttggattagcttatgagtgtattatgacaaaattaattcgatgtttcaagaaatatgcatggcgaataattaacggtaagcagaatagcaaaaaaccgagtggatagggccactcggtttcaaaggagacagtccgttgaggaggacggaactgaaaaatggttacgttcatcaacgactagcaagtactttacaaaggggataatactggcaaactaattctaataattagtttgtagttatattatgcgacaagtagttttgcggcgcaattaatatgctcagtgttagaattaaaaaaggagagggatgataatcgtggactttattgatttaacgccgatacaactacggcataccccattagggacgcgtggacagctaccgatattgcataattggcagttggattggcacaaattggcggctttgattcaggataatcagtcggtgatggcagtcgtacaggcgggattagctgaagattggttgaatacgcaagggacaatctgggatgaacagattggttattaccgttaccccaatgataaccgtgaaccggatgatacggtcttttgggcggcttctacttgggctaccccggccatattggtcacctttcacaatgagctaacgcaggcctttgcgtgttattgtcaggggcgagaccctgactttcattatcttggaagtcggggaatagattagttcggggtcatgacttgaatgaaatcggagcggatggcgactttgattggcaacttaacactagggtcgccatcaatacgcgtgtgaagtggacgatgagataagttttcaatggtaagtgatgtacttttgaaataactaacaccgcgagcattcttgaattttccggcaatgaataatcggccgtagttcatgagcttacggggggtaaagcggcgaaggacgaaggtgtgcagtaaatcatcgtcaaagctggcttcttggttaaaggtaataaaaccaccaacggaattagtcgtggttatcaggataacctgtgcccgttggacgtgggtctgatcgttaacagttagccgaaatttgtaagagcgattagtaactaattgtttaaatcccttaaatagatagatcatgggtccccaacactttttctcagattgcttgacgttttgagcggtttcggctaatttaccgatggtgagactgctaacaattgcttgaccagtatcggggagataacctaggtcaactggtcgagcggtccctgttaggatggtatcaattgcggcatcggcttctagcggaagacccaaggctttagcaaagttattgacggtgccaccggggatgatgcctaaggtagtcccgacgttggcttttaaaagggccgtacaggtggtgtttagggtgccatcaccaccaatggtgacgagacaatcatagtctttggcgcgtttttgaatagcctggagggcttcttgacgtgattgtgtggctaatagatcggcatccccatgggcggtagcctggcgttgaaaatgatgggcaattttttcgttatcattgctacccgcactgccattgtaaatgacaagatatttggacatgaggttcactccttccttttaattgtgctggatagatgagttaattgtagggatttttgtgatagtggtcaatgaatatacataataggtgagcgaatgtatcgcttttaagtaaggcttgttatatggtttttataagaaatacatatgcttgttatggttttgacttttgataccgctacacttgtatcaagttaattaagaagggagtttggataatgagcgatttgtttattagctaccagtcggcagacccgttagcccaatcattccaggtccaactccatgaatgggctgcgcaaaattgggcgtttccaacagtgagctttcatgaacaggtgccaccagtcaagtttcagggacgaggggcagcagcaattcggcggcagctacgacgtgagattcgacagacccatcagttactagttgtggttagtcgtgaaacttggcaatcggaatggacggactgggagattgcgacggctcgtcaggaagataagcgcttattagcggcaaggatggatagtaccaacatttctccgctggggttagtggatgcccaagcggtgtggattgatccgtttgatccggccgtcttgattcagggaggaatttaaaatctaggcttgcatttatggtcattattggtaaaatatactagtagtgacttggagagttggcagagtggtaatgcaccggactcgaaatccggcgaaccggctaataccggcgcgcaggttcaaatcctgtactctccttcaattaagcgtgttaatcatcactgaaccccgtcaaacgttgatttgacggggtttttatttttgattaaacggtgaaaattggtgggaattgatataatggtgcacgttttggtacacactagctatttttacccttaaattagccgtttaggcgtgtacttacgtgcaccattgtttttttatagaggctctaatcgcttgatacaaaaggcgtacagcgttttgaagtgtgcacggctacctaaaattagataatgcttttagggtacgattttcttcctgatgttggtcttctttcatcagatgagcgtaaacgtttcgagtgattgtgctatttttgtggcctaatcgctttgaaatgtattccattttaacaccacaataaagtaggtaactggcatgagtatgacgcaatccatgaaaactgattcgcttaatacctaaagactcatgatattttttaagcagtaaatcacaggcgccaggggtaggaattcgaccacgattatttaggaagaccatgtggtcaggattatctaaaccagaagcaacttgtagagcatgcagatgttttaaatggtcgagtagttcatcggtgactgtgattgtacgaatactagattcggtctttgtccgcttaaacttcaggccgtaagcgtagtcccatgacttattcacgctgatagtttttgccttccaatcaatatcgggccaagtgagggccgagacttccgctacccgcattcccgtcatcaatccggtgtagatcattgactttgatgtagcggtaatcttaatatcatgattgacctcattaatcagctttttcatgtcgttagcgtccagatacttaagttgggcatctttaccccgatgaccgcctaactcggcatggagacaaaaatcagccctaataaggccatcggctacggcatcaatgatggcggcgtggatatggccgtgaagtttttctaccgaagccttgctgtggtaaggagaatccccggaaaggcttcgcttaccacgttgctcactatttccatgggtaaaatcatttaaaaatttttggtaacgagtgcgagtcatggcagaaagttgagtatcaccgagccactctttgatctggcgtagtgtataaaggtattcttgaacggtaataggggccaatttgtgcaatttataggtctcaagccagtttgagtaataatcgtaaaaggtgagactatcatcaactttgccaattgttttatcaaacttcttttgttctaattgattggcccattgttcagcatcttttttaagtttgaagccgcctttgtttttagaaaatctgttaccaaactcgtcataataacttacgcgagctgaccatttaccatttcgttttttaatacttgccattttgttttcctcctaagattaaatcacctagccgggtagatttaataaggattgtggcatcacctcctttcagtcataattgtgtatgcaaaagggtacactagtgcctttgaatgtcgttagtgcatctcattatcttggcgggtagggggatgcatttcatatatatatgtggtatcattcggacatagaagagggtgacgtaattgagattgattaaagagttcataaaacaaagaaaagagtttgatgaggttgataaaagaattacgaacgacctgaaaaatcaaaaattacgtcaccagtctatgattaaagagaatgagatatttaggtcaagtgtacagaaaagaattaatgctattcgaaataaatagcaattggcttaactaatcgatcgtccttttttaaaattttgtcacctaaaagatgaattaggtacatattaattcctgattcaagatcacttaaaaacgaaagaccggtattgtcatcgacctgaaagtctacgtccatgtcttcttcagaaaccactgactcgataattccaaggatggttatttttcggtttccatttgataagacttgcctttgtgaggcattcattcgaaagtttttggactctgcatagactaaagcgttgttagtagaaattaggtcaacacctttagtaatggttgagtagagattagtcagtttagaaatttgacggagaccttctatttgactatctatttcctcatggtctaagccttcttgctctgttagcatatctgcgagagcactattattcatgagacgattcatccgagaaaagttaagaatttcaaattttgattgtaatagaacgtaggtgcccactgcttgtttagaagttactttgagttgcttttcctcgtatagtctttttttgatgatatttacagcataatcactgtaaactgtttcaattgcttgttggctcatctgttgctcaatagagcggaactcacttttatcttttttgttagtgccagcttcggctaccacgacatccaatttcccatttttcccgatttcactgccagttatttctgtgtttccggatagtgcttcttgaacatctttaattacggtcggtagcccattgtctagttgagctaatattgaattcagttcgatttcatctacataaataaattcttttggttgaacagacattataattattctcctatcatttaattgtattatcttatattgcgcatcctacttcctaacgggaggggatgtttttttaattttcctggttacttgtaataccaattccctttagccactaagaagaaagtacgtttattgtggtagtatttatggcctgacttaataacccagccgccggtgctcattaagtatgaagaccgtttaacgctcgatcctttatgcaggtacccgtaaaaagtgaagtgattgtcggcctcatattttccggttgtaactttataaacacgaacagtctttctggcagttgcagatttgttagcttcggcagcataactattgccatttaaataactagcatttgctagtgatgagaacaaaaataaaccggaaagtagtgtggttccaaataatatttttttcaagataatcccccctgaaatatgtagacagcttttaacgccgatcagtctgttgggcgtaggcttaatctatttatttgaaatactatttcgaaacgcgctaactacgtcattttccaatcgatctggtatgcagaaagcttgcataaacggaaaaacactactactggtgtaatcaccgataatgtctaaatagattggtataagaatttctaatgctttaagattggcatttcgttcgtagcttgacttgttgctaaaactagaatagtacaagactccttcatcatgattgaccacatggccaatttcatgagccatttgaaaaataatctccgattgattgtaccagttaagattaatgagaattattttgttttttggctgagcagatgatggggtgtgttcgttcatcttatctgttaaaacacaagaaatgccattatcccatgcatactgcatcaatctcttgatgtaaatgttcaaagacgatcagtcctttccaccatttaggatacgtttgatatactccatatcctcctcgggaataggcttgccttgataggtcatgatgtaatcatcatctgcgaggtctacctgtttgggctcacttgggatggactcgtctgtagtattacctagtaagtattcaacagatacgtttagaacgtgggcaactgcctttaagttattaatacttggttctttagttttccaagaataaatagtgttttttcccaaaccagctttatcattaacttgaactaagctaaaaccgcgtttttttgaaatttttttaattctatctaatactgtcatatcggtaatttctcccaatcaatgacaaattaattagacttagactaaataaatgttgactatttttagactaaggcttatgattaattcatcaagtaatcaagcaacaaaaaacacacctatcaaaacaataactttggcgagggattgcggtggtagtaggttttatattgcttatttcgtatgcactcattttagactaagtctaaaaataagtcaacattgcttgataaattactttataaaaggagatgtttttattgttagatactgagccgggacgtaaagccgttaagaattatatggcagaaaaaagtattacttatagtatggctggaatactttttggtaaaacaccgcaatggattcaacaagtgattagcggaaaagcaaaaggtccgaaagctactacactaattatcagtatgattaacgaatttggcattaaggaggattgattatgaatgatttagtaatcatgaaagacaaacaagcagttaccagtagcttacaggtagcagaatcatttggtaagcagcataaggatgttttagaagcgatcaatacaaaaattagtacagcggaaaattccgctctactagaaaacatgtttgtagaagggcaatatacagcttcaaacggcaagtcgaatccaatgtactacatgaatcgtgatggatttgcatttatcgtaatgggtttcacgggacacaaagctgacggcttcaagctccaatacattaaggcgttcaacgagatggaagatcaagttaagtctcgtacctcagcactgtctcctgagctccaattcatgcagggtgttgtagataagctagcagctagtgaacgtatccaacaacgacttgagaccaaaattgatggcgttagtgagattgttgccacgtctaccatggactggcggaatgagacctcacacctcattagtaagattgcacgtcagcaaggtaacacaggtgaatcatacaagatgactcgcaacgatatctacgacgaagtagaccggcgaggtggggtatcacttaagacacggttaaccaacttgagacgtcgaatggctgaggaagggacttcaaaaactcagcgcaagaatacaacaaaggttgatgtgattgctcatgacaagaagctgattgagatttacacagcaatcgttaaagaatttgccatccggtatcaagcttggaacgaagaatactaaggagaaatgacatgattaaatcattgaagaaactgattaacgtcttatgggcaattgaaaaagacctccatgttatcgcaagtaacacggaagccctaaataataatgcactagaggtttcaataccaaaaaaggtttctaaaaataatatagcaaacccctattaattatctgggaatatattctctcgaataaatttccacgtttcttttgaagcaagaccttgatagttatgaaccagttcacagacaaataatgaatcatttttatccatcgtgtgttgcaattggttacacatatcatcgggtgacaagctggttcttactagccaaacagatttttgaattttgatatacgaaccaccaaatgacttaatggtttttttcacctgttcatatttttggccgggctcatctaaatcatatgaaataatgtatggtttactcattttatatcacctcgattaattggagtaactcaagtataccttaaaaattattgaaagaaggaaccaacatgaatccagaatattttgcacaagaagtaaaaggtgcagtgttacaagctaaggaacgtcatttctacgatgacattcgagcacagatcatagcagcggcttcattgggcaaagatgaggtcactgtcgaaacacaaagcgcaattccgaatgaagtgcttcttgagttgtgtcgaattggaattgatagttacgaaaatggtgaaacagaaaacgattgtcacattacctttaatttagccgaagtgggggaatgaatatgattgcactgcgtttagttggttgcctgattataggtattatcatcggtgtttaccgagaccatatgtttgagtaagggggcgatatatgtggatgaacttgtaaagagtctagcgggtcttttcaaacaagcatatgaactgggtgttgaagatgggcgtaagcagccatttgttacaacaaagatgttgaaacgtaaggatttgccagaacaatttggaatcaaagttgatgcgttcgatgaatattatcgtagaaaaggatttccgtactatcaagaaggcagtcaacgaaaatactatgcaccagccgttcacgaatggttaattaaccaccaaagttttaacaactaaatcctagccgggtagatggcggggcactaacgattttggaacatgaaaggtggaaatagaaacatgacaaataaggaattagctgcacattggcacgctaagttgatgcggacgccagcgagctatcagtcactagcaacttatcggtttcggaaatgggaacaattcgaggtgcttgcacgtgacgaagagtatatgaggcttcgtcgtgaaactaatgtagaaaagggtgtgattttatcatccacatacgcacattagctgacctagtttatcagtcaccgaaaaaacaatggctgtctaaactatggcggcgcaacaaaaaggccagctaccgcaaatagctgaccaagataaaacatatttcaagtggattataccacggaaaaagaaagggatcattaaacatgaaagaactcattttaaccaaaacaagtaatagtgcggtaaatggcactaaaccagtattcattgacattgaacttcacaaacaaattaaagagttgaaagaagagactggtttgccaattacaaccattgtaaacacgttcctccgatatggaattgacaacgttgagattaaggacggtgaataaacatgaatttatacgaactagaagggaatttactgcaagttatgcagttagcagagagcgctgacgaagacgaccaacaactgttcgctgatacgattgagagcctacaagatggtattgccgataaagctattggttatggcaaagtaatcaagcagctagtggccgatgagaaatcgcttggtgaaaagattaagcacgatcaagaacgtaagcatagcctgaccaataatattggccgattgaagttagccttacagcacggaatggagacagcaggaaaggacaaaatcaaagacactgacctgtcgatttggattcaaaataaccccgctaaggtcgcttatacagacgaacaacttattcccgatgaatttatcagggtagagaagaaacacgatggtgcggcgattaagcaggcattaaaaactggtgaaacagtccccggtgccaaattgatccaaacacgttcaattcggattagctaatgtttcaacttcgtaattatcagctagaagcggttaatgcggcacgggattccgcaaccacagggcataaatgcattgtgattcaatcgccaccgcgaactggcaagacagttattatggctgatattgctcgtgcggccactgcacagaataaccgagtgctatttatggttcatcgttccgaaatattggaacaagctaaggcgacctttacagccgatgatgtgaatatgaagctgtgcaagatgggaatggtgcaaactttgactagacacgtaggcgaacttaagccaccagccatcattattgttgatgaagctcaccacgtgttggctaagtcataccggcgcattatcgaccactttccaaatgcacttaaactattatttacggcgacaccttggcggatggatggtaagggcctgaatgtgatagcagatgacatcatattaggaaaaccaatcagttggctaattgagaatggctttttagccccagttgattactatgcaccatctgggattgatagcacgcagctaaaagttaaacgtaatggcgagttcgacgagaaaagtattgatgaggctatgaaacccaagatttatggggatgcagtgcgacactaccaacgtttagctagtggaaagcaggcaattgcttatgcgtataacgtggcaagtgctcaacggttggccgatgcctttaatgctgccgggataacagcacgggcggtttccggcaagaccaaaaaggatgatcgaaagcagattgttgccgactatcgagctgggaaaattcagatagtcactaatgccgagttattcacagagggtcttgatttgcctaatgttgattgcgtcatcatgctaagaccaactcaatcgttatcgttgtatttgcagttcgctatgcggtcaatgaacccacgcaaaggcaagcgagcaattattatcgatcatgttaacaatgttgaacggtttggtcttccaacggccgatcgtgagtggacgttaaccagccgaaacaaacagtctaaatccagtaatggcacgccaatcaagtcagttacagtctgtcctgaatgttttgcaacgttttatcgcaagggtgatacatgtcctttctgtggagctggattaaaagaggatgtacagattgcggttgatccgaatgctgaattgaaaaaggttgaagcgaacaggcggttggcaatggctaagaaagtgattgatgatcgtgctttagaaaaagtggccgataagagaccagcagaattgaagagttatgctgagctaaaagcatatgggaagctacatggctacaaaccgggttgggcctacttccaagcaaaaatgaaaggattgattagagcgtgagcattttaccaaaaaatgaaccccacaaaccgtcggggacaccacggaatttctttatctggggtgctacgatgtcgggcaagagttatctagcagaacattttcctaacacattagtgctgaatacggatgggaacagtgctatggggacagccccaagtattcagattcggaacacgcgtaaggcggatggcaaccttgaccagaattgtattaagcaacttgatgaaattattttggcacttggtacggaggccaacacatatgaaacggtaacgttggatgttatcgatgatatttgtggcctaattgaacaggcggtgtgtctaaaagcaggagtagaagcccttgctgatattccctatgggaaaggctatgccatgtttaatgcagcacttcaaggactagtaatggacttgaaagcattgccgctgaacgttgtatatatcagtcgtgagaacgatattacggatgacgctaataatacgatcaaagtaccatcgctcaaaacaaagtattacaacgtggttaatggcaattgtgatttagtgattcatacgcaacatgttggtaaaaactatctacggaacgttactgagattcgccgtcagtataaagcaagtgaagtcgatgatccgaagattttgtcaattttgaaggccattcctggtgcattgacgccagagacaacgaaagcaggtaagtaaatatgagtttattagatttagcagcaaacacacttgataattttgatgcaaagaaggatacggttgctaccagtcaaggattgccagatggtgattacaatgtggttgtggaagacatttctcacgccacttatgactctggatgggaaagcgtaaaactagtgtttacagtcctcgatggggaacacgccggggaaaaagaatttgataatctgtcatttgctgaaaagacaaaggctggtaaagcaatgcctgattttgttatttcacaaaatattcgattcattacaaagctgggtgcgttattgggtgtaaatattactccacaacattttgctggacctactgaaaccgaagtacacgaggcattggttaatgcgttagcgccagaaaagggtaagacggttatcttacacgttaagcactcaccaaacaaaaaggatccctccaacccatacacaaattatgaattagatgaggcgcaacaaccagaagtaccagtagttgatgatagccaattacccggtgcattaggtggacaggctccggcacctacagataatgacttgccaccggttgacgacactactactacggcaccgttctaaatatttaagcgcaatgacgttatccatcgaatgggtgagaggccctttaaaaaggaggccggtcatgcgtaacttagttaactacgcggttgcttacgctaaggctggtttcagtgtattaccaatggttggtaaacaaccattgattaagtttgctgaccagccaccgatgactgtggaagagattaaacgattttggcagacacacccatacgcgcaaatagccatgcggacaaccaatttctttgttgtagatattgatgaacatcccgatggtgcggacggttttgtgagctttaaaaattatgagcacccggaatactttcgtaatacattatcccagcacaccgcgggtggtggccgacagttgttctatctaaaacgagaagattgtcatatacaacaaaatattggttggctacccggaatagatattaaggcccatattaacaattacgtgatggtagctcccagtgagcataatgggggccaatatcgctgggagaataaaaataatatcgttacggcatcaccagaattggtaaatgcaatcaatgataaaccggagaccaatcttgatttaagcattgattacgatcagaaatcggcgaccgcagagttatttgaaacaatcacgagtgggctaggtgatacagggggcagaaacaacgccttagcgagttttgccggtggcctactattccgtggcgttgatccgaaaagcgtcttagacctagcgaaaatcgctaattctaggacaacggatagtttgagcgaacgcgaggttgtcagaacggttgaatccatggttaaaaaagaaattagaagaaggggggcacaagcgtgagttttgacgatgaagccgaaaagcttcgcgaaatacggcagaaagtagttccacttaatagccgaattaattttatggagacggccaagggtggtatcaaagccaacagcttagagaatgtatgtttgattttggaacatgatgagttgctgaaaggcaaattcgcttataacgaattcagctatgaaactgagtttatggctgattcacctgaattaatgcttgaacgcgggccgttgcaagatgagtttactccggcaatccaacggtacattgaacgaaaatacaaagtgatgttcacacctaaactaattgatgccgcagtagttgaagtgtctcgccggaatgtgtttaatccggttattaactacttgaagcagtgtctgagtgattgggacggcaccaaacgggtagccgattttcttccagtttacttaggtgttgagcgttcagaggttaccacattgcagacaaaactatttttcactggtgctgtagcgaaagcctttaaaccagaaacgaaatttgattttgttttagatttagttggtggccaaggcactggtaaaacaactttgttaaagcgaatggctagcggttggtataccgaccaattcactgactttgagaataaagataactacggcaacatgatgcgtgcttggattgtgaatgatgacgagatgacagctaccagaaatagcagttttgaaatactaaaaaagtttattagcgctgaacaagtcgaataccggccggcctacgggcgatatacagttcgacgatataagaattttgtcattgctcggacaaccaatgaggtgacctatttgaaggacaaaaccggagaacgccggtttatgccggtaatggttagtaaagcgctacagcaaaagtcgccagtcaacgatttaccacaagaaatggttaatcaactgtggggcgagtttacgcgatattacttgaatggattccgattcgggttaacggagcagcaagagcagatgttgtcagataatcgtgagcagtttatgtacgttgatgccgaagaagacgctattgaacaagcattagcacaggttacgagtgattttgttacgagttctgacttggcatttaagatgggtgttactgatttaatcaaaaaccgaaagcttgccaataagattaagtacgtcatggacaatcacaagggctggaaggcaactcatcgccgagttggcggtattcctaagcgtggttatgaacggctgtagtcactgtagtcactatgtagccactttagtgactacacctccgccctacggcgccagtgtatgtagagctatgtagtcactatatctatatctatatattatatatatattattttatataggtatagggtatggagactacggctacgccaaaggtttgaaaagttgaaaataagtcgctacgtgactacaccttagctaaaggcacgtgtgacaagggatttggcgtagtcactaattgataggtgtagtcactattagtgactacggaggtatatatgcgagaacaagaaattcaaaatcgaatccgcgtggcagtatcagcagccggatgcactatttttcgggcaaatgtaggcaaagtaaaaacggcggatggtcggtggtttgattctggattaccacaaggttttccagatctgtttggctttcggcatagtgatgggaagatattctttattgaatgtaaaaacgaaacaggtcggccacgtgaagatcagactaggtttcatgagtttttgactagtaagcatgtgattcatggtatcgcacgcagcccagaagacgcattgaagattatcaatgcgtcggtggtagggtatgggtttgagaattaaaacgaggtagatgaccgcaggcatgaattgcggcatgcaaaagcctatatttcatattgcaataagccatatgaaaaggaggagacaagattgacagttggacaaaaggtgtatcggcaatttgttcttcgtagttttgaagaacatcaatatgatttgggccgcacgttaacttggtgtgaacgacactatcacaagttatcggaacctgagcgtattgccatgaatcatttgagtgtcaaagagcgaaatgaagtattgttggaaatcatcaatatgggattagcaaaatattaaatcggttttagaacaaaaaacgtcccattactggcacgtcaactgatctaatttactggataactaattatatcatgaggtgacggtttttgggacgcaaggataaaagtagatatgagtggttgcaagaatatcttgacctagaagaacgttgccgttacttgcggtggcaaattcggaaggtgaaaagagaagaagtgcgatggacggaaggcgacttgcgcaatatccggcttaatgcgaagtcacgaggatcgcacgtgctagaccagcttccaccattggaaacagagctaaatgactgtgaaaatgacagacaggagcttttagaattggttgattcattccaagggtatgaacacgattttttgaagatgcattatatcgagggcatgacgctcgaagatattgctgacgatccagaatttccatacggtattgactggattcgacataagtccgctgaacttcatagaacactggatttcttagatcaatgggagggacgcaagcggacgtttgcaagaaggtttgatacagaaatcatggattatatcacaccaattccgggatagtgtattttatgtgtacacgtagattacatgggattctaggtttagtgggattatattggtaacataaataaattgcttaacagccgtcagctggtgttaacgtgagttcgattctcacgggcggtataaaattatatgcattttatagcgataaagtatttactttatacgtatacagtgatatactataaatatagaaaggagaaaggatatgccaatccgaccaaggaagttggaaaaggaaatcttgaaagccgggtttgtttacgttccgggacaaggtaaaggtggtcaccggagatacaagcacccagacggcaggacaaccgaaattccattccatcaaggggaattaaagaaaggaaccgagatggcaatacgcaaagaagcagggctgaaataagccttgcttccttggcatatccagggtgacaatatggacaaacgattagtatacccaatcatcgcgaccgaatataatgatgaagatggccattactttgtggcaacatcaccgagtgttcccggtatggtaacgcaaggtgattcattagcagatttagcatatcaagcagaagacgctattgcgactatgcttgatggtgagaagtatccagagccacaggatgtttcaatctggaagctggaagacaatcagcgtgttatctatgtatctattgatatgactaagtggttacagaaaaacacgaagacagttagacgaactattaccgtaccggagtatctcaataacttagcaaaggaacgcaagattaatgtgtcacgtgtggcaaccgatgcgttgaaagcagaattagatgtctaaagataaagcctagttagcactgggctttttattatgcaataaaggagatgactgatttgagagcaaatacacgaacgagtggcggagtaataaacgcttgttttaagagaggctgagtggtttgagaaaaacaacatttcattatattgaagatatattgcgcgattatcctcagacggagagctacattcgagatgaactcaagaaggaagatatgacaatcattcgagatagatcactacgtttgttgcgggaacatgaaaacgttgtggaatggacactgaaagaaagtgacaacgatacgaaatcgattattgaagaattatattttaaacataatccggtactcacaattacgggtgtggcgctacaattacatgttagccgaacagtggctagtcggaaaagaaaacgtttctttgaacaagtggctaagcgacttggcattcggtgaaagttgcacaaaaatcgcacgtgtacaatgtatgacttgggtaatattaacgtatggtaattcagtgatgaattaccggggtcatgtctatgccggtgcttccggttgtccccgttaggttcgactcctagcgaggacgtataaggacgaaactgttcttatttatgtttcacctcctaacatgctgtcgggttccaactttccttcctcgacagcaatacatattcaagacgtggcagttgctacgtcttttttaataattgaaagctggtgttgctatgatctggattctatttgttagttttatagttctattgtttggccagctcacgggtatgtggtcaatcgcactcaatattgtactggtaccgctatatctgattgcattattggtgctcgttgcttcgctgatggctgtatggcatgacctctggaacgaacataagcaccgaggtgataagtaatgccattggttcataggtgtggtcaaccggggtgtcgtgagatgataccgctcaagtatcgctactgcaccaagcattacaacgaacactatcaagcatacctgcaccgtcactcgactggcgttgccgctcgtgcctatgagtatcaccgacgccgagcaactaagcactatgacacgactcatcgattcgcttcaacggacgacgacagtgcggtcaaagatttagctcaaagttttggactaaaaagctcggccaaagaaccagccaaagatatggcgcaaagttcacgggcaaagttctaccgttcaaagcaatggctttcggtacgttcagccgtctactctcgcgaccttggctgctgtcaggtctgtggtaggtctgagaatcgcatgtacgttgaccacattgtcccgctgcggttgtgttctgacactgatcgcgtggcagataaaaacctgtggacgctctgcggcaaagaccacaataaaaaaactcgaatggaagcaaagaccaacgacaagaaactttctcgaatgacggcgattgactggaaacgtgctctgcaaaattaaggggggccgcccgggtctaagccgcctgtccgcataccaatggagttgtcttatagaaatttccaatttgaaaaacacttttagtaagggggtgtaagaatgacaatcaagaaaaagaataagccactgagcacgacgccacccgattacctgcaagggattgcccgggatatgtgggccgcaattgttccaattttgaataagcagcagctcgacgttaaccaactcgacagcagcattgtcgaggctttctgtattaactatcagtcaatgcgggatgcctacgagaatgttgccgagaacggccaagctcaaaaggcgtacaagacaactctcagcccggtaacgggtgagattgttgcgactgattttgttggctataagcgaaatcctgcaacccagattctcgactcggcaactagccggttgaagcagcttggcagtgagttgggtctcacacccactagccgccaagaactagtcaaggttgggccgggtggcggtgacgaaaatgttgccgctgacttagccaagttctttggaaattctaaaaagtaaagaggtgagcagcgttgttgacaaaaattgatatttccaagactcacgacgttgctcaggcgttctctgacgcagtgttcgacggtctacgtggtaaatacaccgacccgggcactgaatatgcgttcagagttatggacggaaaggaaaccacaggctacctaatcaagttagccgcttttcgacatttacgtgacttgcagcgccaaggtcaaccagacttcccgtttgagtacgataccgacgccgtagacaaggccctgctctttgcggcagtaaccccggacgttgacagcggcgacccggttcacttactgggctggcagcagtttattatggcgcagctctttggttggaaaaccacgacgggcggcgttcggttcaccaagtctcttatctcggttggccgggcgcagggtaagaccatgattgctgcaatcattatggcctacactttcctgctcgactcgttggggctatccaaccaagactatttagttgcctcgattaactggaaacagaccagcaagctgctcggctatctcaagaccatgctgcgcaaggtgacggaaattgaaccgtttaaaaccttggctaagcagtccggtctcatgctgcaaaacgaccagatcattatgaaaaagagtaacaacgttattcgtgccgtgtcgttcgagtccgggcagttcgatagtttccactttcgcaccgcgattgttgatgaagtcggggaactcaagaaccgggccaagacctcgaaaattctgtctggtcaaattaagattgctgaccggcgttatgttcaaatctcgacctcgtaccctgacccgaaagtgccgttctatgacgaccagagaatgctcaccaaggcaatggaagaggattacaagcgggacgccgacacttacctgtgtctggtttgggcgcaagacgacctcaaggaaactcaagaccccgagacgtgggctaagagtaacccgctgctgaactcacctgagcagaaacgagagcttttgggtggcctgattgacaagcgcgacagcgatatgctggccggcaccatcggtgattttcagaccaaaaacatgaatatgtggctgaacgagaaagagaaccgttacctcgacttgaaagacatcaacgcctcgattatcccgcgtgacggtttcgacatcgacaaccgcgacgtttatgtggggtttgacgcctcgcagtacagcgacgacaccagcctagcgttcgtgttcccctataccgacgaggacggcgatcataaatttcacgtttaccagcattcatttataccgacctcacgaactcagcaaagtattgctatcaaggaaaaccaagacggcattgcctaccgagaagaggaacggcgtgggttcgctaccatctcgcacacgcgaggcggcgacattgattactcggacgtgtacaactggttgctcgactttgtagaggttcacaacctgcacgtgcaatcgttcctgtatgacccgtggcgggataaggtctttatttacaagctcgaccaagaaaacaactggctaattgagccggttcggcagggtactaagtccctcgacgagccaacgtcattctttcggcatgaaatgcagaacggccatatcaccatgtttgacgaccgtgtaatgcaggccggtatgactaacgccgtgaccttggttgacaacaacggtatcaaaatcgacaagaaccttgcgactgacaaaattgattgcctcgacgcaatcattaactgtttctacgaggcaatgctgcactttgaaggcgtctcacgcgacgaccggggcagtgacgacccgtttgcaggttggaaacaagacgacatcaattcattttacaaaaatttcagtttttagggtgtgacgacatgaaacgagcattacaagggctgctcaaagcagccgaattaattagtgagtcgctaccaatgtggctttacatcacgggaattgccatcatttacgctggtgtttcagcatttagcgaggcagttggaaacattgtacttggtgtcatgttgatcgcgacagcatttctattcggtagtggcgacgactgaaagggggtgagattaattgaagtttactaatccattcaagcgccggttcaccaacaaggcgtggctgcctagctcagattatcaaccgttcttgatcgttaacggtcaagttgtgaagtctgccagttacgccactgccagcgccgccctcaaaaattcagacatatatagcgtggtcaacctaatctctgccgacgtatctagctgccggtttgagtcggacaatgactttttactgcataaactcaacgcacctaacccggttatcaattcttacaacttttggcaatcggtcacgggtgctctgctgctgaacggtaacgcatacgtggtcatgaacctagacgccagcggccggctgcaccactttgagcaggtcacgccgccacaagttcaaattatcgtagacgacggcgagcagaacgtgaattacaaagtcacgtactacgacaaccggggaacggtaaccgtcccggctggtcaaatgcttcatttcaaactgctgtccaacctgagcgacaacaagtttatcggcgttagcccgctgcaagctctggtcggtgacttgaatattcaagacaaggcaaacgacatggccttgaagtcattaaaccaagcaatccgaccgaacggggttttgagtctcgcagccggtgcggttgaccccgaggccaaagagaacgttcgtcaagagttcgagaaagccaattcgggtgctaacgctgggcgggtcatggttatggacgccacggccacgtattcaacgcctcagattgacagcaacattgccaacctgctgaactcggtcagctacacgcgaaaccaagttgctaaggcgttcggggttccgcaagacttcctcaataacgagtccgctcacagtaacatcgaccaagtacgttcgacctactcgcaagccctgaacaaatacatttacgcgattagctcagagctgactatgaagctcggtgttggtatcgacctcgacatgcagcccgccattgaccccgactatagccagtacgcaagcagcatttctgacttagcaaagaacgacgcactagagggcgtgcaagcgactcacattcttaaagctgtcggttttattccggccgacacaccagactttgacgtgcaaaacgacccaacgaaagggggtgagagtaaatgacaatcaaattgcgtggtgacgttgtggacaatgacactgctgccttttacaactggttcggcatggactcaattagccccgccgcagtcagcgacgccttagaagacgccggcggtggtgacgttgacgtttccattagttcctacggtggcgacgtgttcgctgcaagcgacatctacaccgagttgaagagttacgccggtaaggtcaatgtgacggtcacgggtattgcggccagcgccgcgagtgtaattactatggccggcgacaacgtttcaatgtccccgacggcacagctaatgatccacaatgccagttctgccattcaaggcgacacccgggcaatgaaccacgaggccggtgttctcgacaacatcaacaaatcaattgccacggcctacgtcgctaaaaccggcatggctaaggctgacctgctcgaccttatgaaccaagaaacgtggcttacggccgaccaagccaaagactacggttttgccgacaaggtactgtttgacgacgactcagcggacacgctgcaagccgttgcctctgcctcgtctatccccgccaagtcagcggttgctaaattccgcaatctacttgctgctgaaaagccagctaacaaggctactgctaagtcggtgaccacgaaaccagcccgcagcaatgtgctgcaacaaaaattagatattctgagaggtgcaaagtaatgaatttagaagcaatcaaaaacgcaatgacggactcacaaaacaagttgtccgccattgacgacaaaattaccaccggtttactggacgacaagtttagtgccgaaaatatggcgacgttaaagcaagaccgggataacgaacaagcccggttcgacgaattgaagactcaacgggacgccgcagaatcaaagcaagttgctgaccatatcgctggcaactctgccaagactaaggccggtgccaaggctgtacaagctgggccagaccgcaaggacgctgaaaagcacgccttgaacgacttcctgcactctaagggtgccgttaaggacgccgcagcattgcatgttacctcgacggaagcagaaccattgatccccgaggaaattatttacaaccccgaaagtgaagttaagacggttgccgacttaaagcaattcgtcaacattgtgcctgtaaccacggcctctggtacttatccggttctggaacgtgcaactgacacttttccaacggttgaggaactcaaagaaaaccctgctttggcagaacctaatttccgcgacgttgactggaaggtttcgactcgtcggggtgctttacctctgtccgctgaggctattgctgatactcaggttgacctcgtttctatggttgtcaagaatatgggtgaaaagtctatcaacacgactaacgccgatatttctaaggtattcccaacgttcaccgcagttgcagccagcgacaccaaccttgttgacaccatcaagggcgttttgaatgtgtccctcgaccctgcatacaacccaaccattgtggcaacacaatctctgtacaacacgttggacaccttaaaggacaacaacggccagtacattttccaccaagacgttactacgccaagcactggtactctgttgggtgttcgcgttgctcgtatctctgacacgttgcttggcaaggccggcgaccaattagcattcattggtgacttgagtcgtgctatcacgctgtttgaccggcaacaggtttccttgagctgggctgacgacaaggtttggggccaataccttatgggcgctctacggtacgacgttgaagttacggacgctaacgccgggtatttcctgactaacacaccggtcaaatcctcgactgccgcaaccgcaccatctacggacactgctaagtagttaagggggtagttaaaattgaccgtaacggttagtgaaatgcaagaagagctgcaccttgatggtgaagagggtattttgcaatccctaatcaccgagggcaccgactacgtgcgctcagcggtcaattatgacctgcccgttgaagagtacgaaaagtacccgctttttgatcgtgccgtaaagacctacgtttcgagttattactacgaccggtctaccggcgtagggacgaacaagggtctttccatgatgattattcatttacgtggccgaatgtggggtgcagctaatggtaaagattagaccgcaccaactcaaccaccgggcacattttggtactgtcaaacaggccacgaaccccaacacgggtgcaccccgcaaggcgttcgttgaatctttctctctctgggcagagtttcgtacccgttcgactagtcagctctttgcagctcgacaggccggcatggacgaaactcgaaccattgccgttcgtcgtagccctgaccttgatgagcaattgcgggtcacgctcgacagtggaaaagatatgtaccggattgtgaatatcagtcatgacgacacgaacaactatttagcgttcgactttgtaacgctagaaaagaccgacgcggtaaagggggcctgacctatggaactagacaaagcattgacaatctggctagacaacgtagagaatacggctcacctttcaccctcggaaatgtcacaagttacggacgccggcgctgcggtgctggctgaccacttgaaagaggtcacgaaacagaaacactatcgaacccgcgtcaaggggcaagacagcacccaccttgccaataaggtgacccaccaagcaactgacattgacggtgaaaagaccggtgccagcactgtgggctttaccgacgaggcatatattgctcggtttctgaatgacggaaccaagtacatcaggggcgaccatttcgttgataactcacggcaagaagttaagaacaaagttattgcagccgaggcggttaagtatcaagagcttatccgtagaaagtggggtgagcagaaatgactctacccactatcgaggttagcaaaattcttgaaactgttgactggatcactggcgtttacaccggactactgcccgaggacgccagcgcgaacaccagcgacacacttgcactggtaactgaggcaacgcctgagtttcaggactggggaaacgatacctttaacgccgtctcgtacagcgttgaagttcaggttttctatagtctcgattttgaccaagacgtgcaagccgttgagcttgctctgttgaagcagcttgaacttgacgggtggcgcattgcgacggtgcggccacactcgattgaccctgaaacgggccaattgaccgaaacaatttacgttgcaaacaataaatttatttagaggtgttttaaatggcaactgttggtatcaagggtctgcgaatggccttaattaatcccgacaccatgcaagttatcgctggtgccgacgacgggttttctgaaactggtatttttgacgcacgaggccgggttgcaaaaggtctgagcgaagcaaacattacgggtattgcacccgctattgccaaggtttggggtaacgaccaattacaagaccaatctgttggtaagtctcagcctagtgttgcgacgaacttcaacgacttaccttatgaaattctggaaaaggcgttgggtgaagaatccgacggcaagggtgggttcttagataacgcctctggtgttctgcctcacatcgctatggacatcatcagttctgacttggcaggtaacccggttcactactgcttctacgacggtaacatgacgcaaggtgacaagactattcaaacgtctaccgaaaaccaaacgcgtgcaaccgacgccttgacctacagccctctggctggttctaacggtcacatgatgaagactttctacgcagcggacaagggctttaccgacgacgctcttattgctgaaattttccccggcgctaaggtttctggtgctaccaccccaactacgagtggttctggcgctggtgataccggtgacgcgggtaagactaaatagattcaaagcttatagctagtaaattggcagccgcattgacgcggttgccttttttctggtgtaagcacaaaaaattaaaagtgaggtcattagattatgacagttaaagtaaatgctaaatttttaggtttcaaggaacccgtagaaattaaagaatccaaccgcaattttcaaaagacactcttaattcaaaagaaaatgctcaaggttgaagctatgcccgacgacgcaagcgacatggatatgctcgacgctgctattgagactaatgacgcaattagtgattttatcaccgacgtactgggcttaaaggctaagcaaaagaccgctttagaggacgccagcacccaagaaactggtaacttggttcgtgacatcattgctgctattcagcaccaagacgttgaggaaattacggacgaccaagtcaaagacgctgctgccgacgacgagctgagcgaaaacgaaaaaaaataaaggcgcgtaagcaagtcaacgagctttccaaccagattgaagagtttgattacaacgcgcagcaagcacttgttcaaatgcacatgaccccggcagaatttgacgaacaagacttctaccgcttcaacgacgttctactggctcggcctgagaaagaccggcccgttgttgatcccgctgcgttcctgaaacagttacgcagtatgggttactagtccgaccgtcaagaaaggggtgtaccacagtggttaaaaaaatcgacgcgcaaatgagtaccgaggtctaccttgatagcctgcaaacgtctaaatcacttaaaaatctgcgtagcgttgtgtcgtctgtaacgacttcatggaaagctcaaagcgcagctctacggtctactggtgagtacgtcaaggcggccgaaactaagtacactggcttgggtcgtgccatcaaggctaaccgggacgttatcagttctttgagagacaagcaaaaaggtctcgaccagaccactcaagagggtgctcggcagtatgctaaataccaagctcagattaaccggacagaaacgcgtatcgcgtcactgactcggcaacaggaaaagtcgaaagagtccctcaacggctacaagtccggcattatctcgttacagcaaagtatcaaaagcagtaacgacctaaccaagtcgagcgttgcccggctgcgggctgagggccaagagtacaaggctctgtcggctgaggccaagggctaccagtctactctcgaaaagtcgagtaccttgcagagtaaacaggctgctgaactcaagacttaccagaaccgggttgacgacttacgcgcttcatacgaaaaggccaagactaccctcaaggggttagacgaggccggaaaacagaacaccgacgagtacaagacagccgcccgcgcggttgaaaagtacaagactgctctcagcggggccaatagtgacctgaaccggcaaaaaatccgggtcaacgaaacggccaccagtacggccaaactacgcactgaactgacccgcgtgcagtcaagccaagagaaaattcggcccaccggcttgaaccggttgcggtcgtctatttctaaggtcaacgaaagcaccgaaaagactagccacttgtttggcaaaatatttgggggcaccattgcggctaacgctgctgttggtgcttggaacatgattactacccacattaacgacgcgatccacgcgggtgccgagtacgacaagactcagcagaaaatgctcgcgacgtggacaactcttgctggctctgctaaggcggggcaggcaatggttgataccaccaacaggcttagcgtcgcaatggggcaggacgttgacgttaccgacgaactgaaccaacagttctatcacgttttggacaagcagaaacctactgagcgccttaccaagtcagtgctcactatgtccgacgccgtaggtctgacctctgagaataccaagaacttagggctgaactttacccacatgatgagtagttcaaaaatgcaggttggtgacttcaaccacattacggacgccctaccaatgtacgggaaagccctacttgaatacgagcaaaaggttcaaaagaactctaagctcaccatgtcagcgctgcgcaaacaaatgtctgcgggtaagatttctgccaaggacgccgaaaacgtcatgaacgaacttggcaagaagtacagtgacgcgtccgaaaaccttatgaagacgctgcccggtatggaacgtgtaatcaaggcgcgggtgccggctctactcggtgacatcgaaaagccattcatgaaagctgagaaccctattctgggggccgtttccaagtgggtttccgacaagcgtaccgaaaaagagttcaccaaggttgggactgcggcaacccgtggttttaatacgatcaccaaggcttttgctcaggctttcaacatcaagtccgtaccacgcgcaatggacggctttatgaatggactagccaagacaatcaccaaggtatctaactcgatcgcggcccacgccaaagacatcaagggcttttttaagattttttcacagattagctctgatagtctcaaggtctttgttgccacgctcaaggccctgctgcccgttctgcaagtagtcggtgactttgctgccaagcaccctaaactgtttggtgacatgattgcctcgaccattctcatgaacggtgcgttcaaggccctgacccttgtactgcggccggttgccggcctgtttaaaggtgtcggcaagtcaatgacttggggtaaaaagttgctcggtcttggcaaagacgccgatggtgctgcccgaaaactcacaccattaggcaaagctctaaagggtctgcgtgacattttcaaacgtgggtttaagaaaattaattttaagggtctatttagcgggctcaaagacggcaaggggctgctcggtggtctcaagtctggcaagggtatgttcagcggtattgctaacctcgcgaaagatggtggtggcggtgccaagggattactgaaaactggggccaagagtgcgctcaaagcctcacccctgagccttgcgctttctgcgactgaccttatcggtatcaacaagaaaaatgctggcaagaaagtcggccaaactgctggctcagttgccggcggtggtgttggtggaatccttggttctctcattttgcccggtgtcggtactgcggttggtgccgctgccggtagctggctcggtgaaaagggcggcgggaaaattggtaagttgatccaatccaatgctaagagctggaaaaagactctcagcaatgcgttttctgggaaactcggttgggaaaagtcaatcgggaaagccgtttctaacgtcggcaagtctattggcaaaggtgtcaagggctggaaaaccgcgttcggtaaggtgttcaagaacgttggcaatttctttaagccgctagtcaagggtgcctcaaaggcaatcaagagcgttgccaacatctttaagggtgcaggcaagtttattttgaccgctcttaaaatggcaattattgtgccaatcgcgttggtagttggtcttgcagttattgcattcaagaaaattaagaaaccaattattgacgttgctaaggcagtaggcaagggcgtttcagcagcatggaacggcattaagtctgtcacatctaaggtgtttggcactgttgcaaagattgcggccaagctctggaaaccaattggtaaaaccatttcccgcgtgtctaaggctgctggtaaagccgtccgttctgcatggaacggcattaagtccgttacctctaaggtattcggggcagtcggcaaaatcaccagcaaggtatggggcggtatctctaagactgtcggccatatcgccaagggcatttccaaggtcgttcactctgcttggtcaggtattaagcacgccacctcgtccgcatggaaagccgttgaaaagtacgttattaacccggtcaaaagggttcgtacagcggttaacaagtacattgttcgcttggtcgttcacgcggtaaagggtgcttggtcaaccatcaagcgggctacttctgctgcatggaaattgattgaaaagtacgttggtaaaccagtgaaggcaatttacaacaccgttcacaagtggctcggcaacattcaaagttactggaagaaaatttggaacgcggttgttaagtttactgagaatatctggacatcaattaagaaaaaggttggtgctggtctcggtgcagtagctaaagttatcaacacgggtatcaaggcgattaactgggttatttctaagtttggtggtaagaagaccactatcggcctactttccacgcactatgctcaaggtactggtgccggcgcgggacgccgtaaccctatcaccaagccaacgcttgcaaccctgaacgatggtaacgactcgccaagcacgggaaaccgtgagcttgccgttctgccaaacggcagcagcttcatgccaactcaacgcaactggacgggtgttgtccctgctgggactgaggttttcaccgcctctgaaaccaagggactcatgaaccgcgccggcgttcgccactttgctaacggtactggtatttttgctggtatcggggacgctctcggctctgccggtagctggttaggtagcaaggtcggcggcgcagttgactgggcaaagaatgcacttggttcctttaaatctatggtttcaactgtagctaaaatcgttgcccaccctgtcgcaagtctcaagtcgttcttcacggacaagctcaattttaaaggcattgccggtgacgttgagcagggacttgctggcatgttcaagggcaacgtggtcaaccaagccaagtcttggtggtctgctgcttgggacatgattaattcagcaatcaacgctggtgacgacgacgcgggcggccctatcacccacagccccggtgctggttggtctgttacctctggttttggtaaccgtggcgcggtaagcggcgggtactcgcaacatgatggggtagacttctcgggtggtaagactgttcacgctatgaacaccggtactgttttgcgtgagggtggcgcacccgcaggctggggcggtgcctctggtatcggtcaaaaccttgttattggtggcggtggtcttaactacatctaccaagaattaaacggcaagtacaactctggtgccaagttcttagtcggcaaaggcgatcacgtcaaggccggtcaagctatcgcggttctggggcctagcggtactcacgttcacgttggtgctaccaagcacgcaatgtttagtatcggtggttcgtctactgccggctggcttgaccctaccaaaattaagagtagctcagtgaagagtgacgacagcagcaagagcaagacaccaaaggtaagcggcgctctgcaaaagctggtcaagagtcaactcggtagtggtgtgtttgacttcattgcaaagcaccttgccccactggttgcacccgactttggttctgcaagtggtggttattcaaccagcatgattaagaaagccgctgaggctatgcatgttaacttgacagctagtgagttggcaaacatcaaaaatgttattcagcacgaatcaggaggcaatgcgtcggtcgttaacaattgggattccaatgccaaagcaggtcacccgtcaaagggacttctacaatttatcgactctacgttcaagcactacgctgtatcgggacacaaaaacattttgtcggcctacgaccagctactagccatgttcaatgactctaactggaaacgtgacgtgcacacaggaggttgggggccaactggacaccgccggtacgaaaacggtgggattgttagccgtcaccaaatgattgaagttgccgaacataaccaccccgaggctattgtgccactcgacacaaccaagcgctctcgtggctgggaaattatcggcaaagttgctgctcagttcgcaggtcaagaccctgccctgaacaatactggaaaacaaaacgttgtggcagatacaaccacaaccgacaataaacttgataagttgatcgggttgttgtccgactttatgacaatgttcgcgcaaaagccaaccgggattagtacccgggcggtctacgacgcctacaacacggaaaagggccggcactaccaactcgacgctaacaagcgaggatagggggttttatttatcaaaggtaacggtttttcatataagggattgaccaacaacgaccttggcttagttatgggtaaggtgctgcttccggtcactccggctattactgaaagttcgcagattatccctgcccgttacggccctgtgtatcaggggtcgtcttacggggcgttgaccatcaacgtgccaatttactacctcacgccgtactcgcagttgtaccacgttggtggtggtcaactggcagagcagaaaattcgtgagctttccgctgcattaatcgacccgcaagaggaacgtggtactgagtacccgttgacgttcgacgacctgccgggctacacattctatgcgcacattacacagattagtgaccccgagccgctaaacgacggggtttctgactggtcatcaactatcacctttgtttgctcagacccgcgcgggttccttgagcaacaagactgggacgttgccgacgcctcgaccacggcggtgctgcccgttaaaggtaacacgcccgttggtgcgatcatcgttgctactttcaataaggacgtgaagacgttcaccgtgcttaaagacacgggcgagcaatccactgagtttatccaacttggtggtgacgccgacgttgattctggcagcgacggaacgagcagcgacgacaagacccgaatgctagttcacgacccctgcaccacgctctcgacgtggacagcaattaaagagaacgcgaacccggtcagcaccattaatctcgacattgacggggcaatggcctcgaccgacgcctctctgcgggtagccaagaactcggacggtacgtacaactttggtaaggccaacacccacgaacaatggtacggccccggtgagcttcaccaagccttgccgtactcaccaaagaactggaaactgtcagtccgactgcaccacagcaagtacagcggcgcgcacaactaccgggctatggctaaggtcgaggtttatattctcgataccaagcagcgtacctgcggccgtatcggtatcaaggacgttaaaggtgggggttaccctcaagcctatgttcaaattggcagtaactttgccaatggtactgagggcaaggactacaagaacttgtactatggctcagctatgagtcttacccacagcaaaagccccgaaaaagttaaggtgaaatataagaaagctactaagtacctcgacaatgcgcaaatggttgacgcgttctctgactttttcggtcaattcaccctgattaagcagtacgtcaaacagtccgacggaactaccgcaatcaactggggttattcaattgaccagtgggacgctaaaaaagccgtttatatgtctaccggggttcacttcggtaagaacaaagtggcttacgttgacactagttgtgcgttcgactttgaccttggaacggtggcgttctttactgctaagcacgacatcaccgaggacaaggccaaggttgcttacaaaaacgtgttccagactatgagtaactatcaggtcgaggaactactcgacgcgccggcaccagctaagactaccggttcaactacgaccggcggctcaggaaccgcaagcactggcggtacaccaccggcacccggctctacccctgaggggtacagcattgacgccaaagggtcgttcaagttcaacgcggctgttaatgtccgcaatagccccgacacaacggggacggtagccgcaacctacgcctcgggacagtcggttgcctacgaccgcaaggtgtacaagaacggctactattggctgagttatatcagttactctggcggccgacggtatgcggcttactacgacactgccggcaaagcaatttacggcaccgactctaacccggttaacccggtcaagcctgacactgctgcaagtgccggggacagcaccaccgttcctgaccaaagctctggcagcaatagtgatctatccgactttgaccaacaggttttccatgccggcgacgagctgcacattaactgcgataccgggcacgtgttcctgaacaacgaaccggccgactacctaattacaccagactcaacatttttcatgctagacggcggcaaagacaacacgcttgcctttgacccatcaagccccgacgttgatatttccgtaagcgtgcggccggcaattcaatagaaaggttgcgagattatgcgcgacgacgaatacattattcttgataatcaattgcggcgtatcgggttactgagtaaccgggtacgagcaggcaccccgttctggggcgataccatcgaccaaagcattgccgaggacgacagcgcctttgcttgggaagacctcaaagacacgttcaacaccattaacttggctgcgaacaaaaagacctacgaccacaccattactggtatcaccgtgccaagtaatgccccggacgctcataacatcgtacccggcaaccacttgctgtactacgattctgaaaaccaaaagtattacgttatgcgcatgatgaatattgaccagagcagcaaggaaactgaccagtcgtttagctttgacgctcagaacctctgtgagtggaaactgacccgaactatcccgacagcgttcagcagtgactcggtaaatgctgaaacggcgttcaccaacctgctggctaaatccgggtggcggcttgagtacaattccaagtcaattatgactctcaaggaagagtacgacggcagcagctcggctcagtcttacttgcagcaactcgctgcggactatgacctagacgttgactgctacgtgaagctcgacagcgtgggcgacgttaccgaccagattgttgaagtgtctgaccatatcggcagcactaaacgaacccggttggactaccgcaacgacttggtgggtgttgaccgcaaactggttgacgacgctcttgttactaagctgtacgttctggggaacgacggggccaccatcgaggacgccaacaacggcgttgcattcttgattgaccccgacgccaacgccaagtacaaccacgacatcaaggggcgggggtcaacatggctagagggaaccataacctctgacaccattaagaactcagccggcctgctggcatggggtaagaagcagctcaaaatgtacaaccacccccggtacaattacaccgttcaaattcgttcggatatttcagggggtatcggtgacgactttcgggttgtggactttgatttaaacccggctatgatcgtagacgctcgcgttatcaaagtctcaaaatctaagtccgacccctcagtgcacgagctgactctgggtgaatactcaaccatcactcctaaaaaagtgagtggcgacgttgacctgacacagctcaaaaaagacgttgcacaggcgcattctgacgcaatttcagcaagtaagacagccgactctgcacataccgcagcagagaacgccaccaaaaacgcgaccgacgctagtaaaaaagcggactcggccaccactgctgctggggctgccaagactgctgccgacactgctcagactactgcgaacggtgcagagagcacagcaaccgatgccaaaactgcggccggttctgctcaagcaactgccgactctgccaatactactgcaacgagtgccaagaccgcagcggacaacgccggcaagactgccagtgccgcccaaactaccgcaaccggtgctcagaacaccgccaatactgccaacaccactgccacggccgcgcaaaagaccgcgaacaccgccaacacgaacgccacggctgcacagaacacggccaatactgccaacaccactgccaacgccgccaagaccgctgccaataatgcacagagcaccgcaaacaccgcgcacgacgaggcgaccaaagccagcaccgaagtgggtaacgtttcaaagacctactttgccgacaatgtttactttcaacctgaccagccaacgggggccgacgacggcgctctgtggttcaaggtcaacgacactgcgcaatatctgaactaccacgacgacagtgccaacggtgggacgggcagcacaaccaagaccgttactgttcaggtctcaaacgacggcacaaaagttgccgcctctggtcggttcacttggtcggggcagcaccctattaagcaatcaccgtcaatgactgcggcaacccgggcctacacatatagtgggctgtctgccacctacaacgggaaagtcattgagtccggtattttgtgggtctactacacggcctacaacggggacgtggcctacgttcctattaaagacctgactagtggcactcgatacggtactgataccaatgccggcagtgaccccgccgcttaccataatgaaacgcaaacgatcaccgtgcccggctcgaccggtaacgcggtcaatgactcacagattacgttaaaggccgaaaacgtggacgacgttcagcaatacctctcaaataagtggtcgtctatcccgttccaaaaacaattagttggtgccaacatttccggggcctcgattgacgcgccacttatctctcttggtgacggcggtgtcgtatggtcgtcttactcaattacacaagacccacgtttttaccagccaattgctgcacaaggtactgtcgcaatggcgcagggtgagcttgtcgtaagcggccaaacgcaatactacgacctgaataccaattcttggtctagctacaacacggcgggcaacgcagtagacggcaccggaaccaactacaccacgactattattaatgctggcgggatcaagaatgaaatgcaggacagttcccgcagcaatctggtgggccgcacctacatgaacgggttgaaaatcgcgcttggtaactctgatggaaccgacgtgtttacagttgaccgtaacggattaagccacgctgttggactaacggcgcctgacatctatgcgaacactcggctacatgccaagctaattcaaccagacggccctaacgacgcactaaagttagagtcaggtacaggcgatagccgggtgcaatcacagtcaatttacaatgtcacaaactctcatggtgccaacgtttatattacagcatctggctcacttgtacggacggcctcggcgtccaagtacaaacaggatattcacgacatgtacgacgttgccacactatcggctgcgcttctaaaagcaaaacccaagtattggttcgacaaaccttcaattgaaaatgttgtgagtgctgcaaagaatgacaaggttccaagccttgacgctactacagcggagcaacccgggctgattgcggaagacctagaagagctaggactgtctaagtttttgtattacggggtagacggtgaacttgagggtgttgactactcaaagctgtgggttttgcttattccagttttgagcaagttacgtgacgacgtggctaccctaaagggggtgaaaaccaatgacgaaaccaactaaggaacaacaaccggccccagacatgattaaagccgaccctaccgaggtcgttaccatcttagttaaccgcattgctgagctggaaaaggacaaggccgttctgaccgcagcacttcacgcccaacaaaagtagtgtcggcaccgacatgacccactaaatttgaaagggtgttatttatgattaaaggtacttttgatattgcctctgttttaactttcgtgctgaccgtagtgccggccgtttacgcgctgctgcggccactggttcaagccaaaatcgccacgcaaaaggacgaacgcaccaagcacgaccttgaaattgccgacaactacgctgcggcgatcgttgcagaaatgtcagtcatggccccgctgtccaacagtgaccgcaaggctgaggccgttaagtatgtggtcaacgcaatgcagaacctcggcaagagcatttccactgaaacggccggggccaaggtagaagcagcttaccaaagttacaagagcaacggcggtgacgttcacaaggacgttgccagcacaccagcagcggccgaccctgacccggacgaccaaactcaattatagaaaggggtattagaaaatggcttataaagaagttgcagatatttcagcttggcagggtgatagcctagcctacatgaagcagttacggcaatacgcggtatcggttctggtaaagctcactgaggggtcagaaagcggaagcgcctactttaatcccaaagcagccactcagatttccaacgcatttaaggtgttcccaacggtgggcgtttaccattactttttgggtaactcccaaaagtatggcgacaatgacccactaaacgaggccaagtggttttacaagaaaattctttccctcggtttggacaagtcaacggttgccgtgattgacattgaggacaaggcactgcaaacttacgtcacctacgacatcaacattgtactcaagtacctgtacggcaagggcttcactaacttagttgtgtacgcctcaaagagctggttcaacggtggccgtatcaacaaggacgcgctgtacaacaatacgcctatctgggtagcctcttacggcaccagcgagccgggtgttgataacgcgggcgcatggcagtacaccaacaatgggcatggcctcagcacagacttttcctatgactttaccggtgttctgaccgggacgactgaaccagccaaaacggaaacgactacgccggctgaaactactgatacaaagacggacacggaaactacaaccacacctatcgaagacgaggtaggtaagttcgttcaggaaagcggccgctacaccatcattgctgactcggtgccggtttacactgatccaactcttacgagcacggccggtgaaaccttggcaaagggcagctcgttggtctgtgttcctgccgacgcgaaagcccacagtctcatgattagccgtgacatgtacattacagccgacgtgaagcaagttgaatacgaaaaggggtgacttattttgaaagtcctcggcctgacaatcgaggacattgccagtttactgggggtcgttggtggcgtttctagcgtcattttctatctgttccgagtgattatcgtcaagcctatgcgagacgagcagcacaaccttagcaatgcccttaatgccctaacccatgagttccacgccatgcgggaaagtgaagaccgggagcaccgaaacatagacgctaaactccatgaacatgatattaagattgctcgccatgatgaagaactaaaaaccttgttccgaggagaacggagagaatagaaaaagaccgggcatattttgctcggccttttttggtttaaaagcacaaaagttgcacgtatcaaagttttatccaagatatatttaatgtatgttgttgcgcaacgacaaattaaatttatggagtgtgtctaacttatggcatctattatcccttatttattgtctgactttggaactgctggtgcaaacttaacgccacataacgctatgcaaaagtttgtagtatctaagcaccaatccggtgttggctatggtatttttggccccggtcaaggtgaccaccagatcattaccaagtacacctacgacgtatcaagtgccaccgccactaataaccatatcacgcctgtatcatctctgcggattaatgcaggggtagacccaaagggccacactattattcccgggcactgtgaatctctcgaattgtactacgccaacgggcaagaatacctgttattggctactaagagcagcaacggtacaaagggttatggtactcagttaacccgagttcccgtttcggctattgagaataacgctacgtcttcttatactgacttcccacgtgttggctctatgaaccacgttggtggtgggaacttaggaacgccataccggttagaattagccgtatctacggacagcaagttgattgctttgtgggcctttaatgaagcaacctacagccgaatgggactctacaaaatgtccgacattgacgctctgttaaataacgctgctcaaacgtctactaatgaagtttctattactggcgcgtccgcaacggctgtcagcgatttcagttcagtaactaaggccgacttgtttgttgttgaagacatcaagggccgtgctcgcaagggttgcagcctgcaagggtttgctattactaccgcgggttctgcttatgttacttgtgaaactgccattggtgaccctagttccctcgttaattacggtggttctaaggatatctggaagtttaagattggtgctggcgacagcggaacccctaagtcaattaccaacggtcattggactacttacttcaaagatcaaggcagtgttgccaacttgggtgttgaacttgagggtatgcaagtcgttggtggtgacttatatgtaactgttgcctaccacaacgcagcaggtacggaaaagaaccgcttgtaccactttgacaagactctagtttaatttgactattcatacaaaaaaagggctatcaatgatagccctttttgcttacataattattattgcaggttttggatgtatgctttggccgctgactcgttaacctctgagtcggacgttccctttagcttacttatataccccgcagcaatatttcctaaatcaacataaaaactcttggtgccaaccttaacggtcattctgtaactaccgccgtctaggttatgattgtcgtacgatctaaatacgtgccctaacgatactacaagtttgtactggtatgacttaccaacacgaacccgcttggtgccaaagccggccaacggctttgctaaataataggtgtagtttttgctaccccgggtaagttttttaatttttatggactgagaatacttactgtaattaatattatttccactctggtaattggtgtaataattcaaatagttgtcagctgtaaccgtgataaatgggttatttttgcgatcactaatataatacgattgcaagttcttgctgtttaagttcggtaaattttgaatccccgaatatgaaaatggcgtgctcttagtgtatgaagtcattgcttttccagtagaggccaacgaaaaattaacaatctgttctttattaccgaacgccttaaaaacatacccctgatttttcttgcttagattttcaacattgattgcgaatcggctaggaaactttgggttcaatgtgtacgtgtttcctctaacaacggaaccctttggcagggtaaccgtcgtcttgcccccaactgaaaccttagtggccttagatagcttataggtgcttagcgccgggttcaaagtatcggaaattttattgccattgctattctgcataagtgcgttcagatttttaacgccgaccttatcaagttcactatcaattttcttactagtcttagttgatttattttccttggtctgtaaactagtcaacgttttcttggtgcttttactcattgctgacgcgtttgtgattgcgagaccgcccgcaactaccccgagcagcaagagacttacggcacttttaccatttaagtttaacaatcgtgttaccccctaatatgtgttgcttgcaagtattataacccaaacgagggaagaagtggagctcctattatatttgtaacaatttagatgaaattttataagttatgttgtatagtaatcttattctgtgcaagcaggaaataaaaaaacatttgtttaaccttccccagggctattagcttttgatttcagagaccactcacctcattaaaactgtgttgagtggcttttgttaacattatgttgttaatggtcgtgaaacgtatgtatttacccggctaggcgatggtacacatttggtgcacgtttaattattagacactgtagaaaccgatacgtagcagtttctagcagctactctaaatcctgtactctcctttttaaaccgcgtaagaagtataataaaaataggaatcccgttaaatcaacgtttagcgaggttcctattttttataactcgttaaaaagtaggagaaaatatatgaattgagaacgtttttagaacactcttaacttggtcacttaatagctcctaaaaattatccattagcggtaataaatggatacacgagataataatcgtccagaagattactgttctttaacgtagcctacatcctacgctcatcagatatgaacgacattgttgcatcgtcaaggactgattattgcaaatgttatatccaatatctgggaaatcattgacaacaaaatctattttaggtaagttttaaatagtaaatctgtatacagggagataaggatgaataagattacgaagactattgtgttggttttaacaactgctctggcattttgcatggtgacgggttatgctgctgaggccagtagtacggttcctaagtcacttaggcatgagtggtatcagccgctaaaaaacgttaaggatccaatgttcataaaattaaagagccatgcgatggactctggtagcaaagcctttcatcacaaaatttctgggaaagatttgcaagttattaagaaatccaagggatggtatcagatcggttatacagggaacaataaccctaattacaaagtaactaagcggaaggtttctggaaagaaacgaacagttctgctaaagaaaaatagtagccactctcattatgcagatgtctttctcattggtaagaaaaccaaaatgagtttaggggagtcgtcagtatatcttggttaagcagtacagctatatttggaaatgaaagaaagtaaagtctaatttgagtgtcaggctagtcaattaaatgttcgaaaaacactggaaataggtattcaggcaagcagcatcaccaaactgcattgtttcaacccagtatcactaaatccagataactaaaaccggtcgtcagcatcaactagcaaccggttttagttatttaacgggtgttgcgtataagatattggttggattaataacaactgccgtcccattccaagtagttcctaacacaacgtcagttcgttcagccgccacacttcgtaacgtcaaatgcttctcagtattggcgaggtaaaccgcaatcttatcattttctgttgctaatcgataaagctcagttaccagtggatttttttccattatatcaggcctccgtttttaataagtatacacttttggcgtattaaaaaacggccaaagatggccgttgatgtttgaatttattttttagaaggagaggcttgttggtgcgcttccactgctaattcagggaaccagattgcaatttcgtggtgcgcgttttcacgactgtctgatgtatgcacaatgtttcttaaaataccatcaggataggcatgagcaaagtcgccccgaatcgtgcctggctgggcatcgttcggccgcgtttttccagcgagattatgcacagttttgaccacatcagttcccgttacaatgatagcaaccaggggaccttcttgcatataggtctgaatttcatgaaaataaggcttttcaacttgctcacgataatgtcgtttgagttgatcagttgttgctgtgaccacctttaatgccgctatttgatagcgcttactttctagccgtgaaataatctgaccgatatgaccttcagcgacaccatctggttttaccaagactaacgttttttctgaatttgccataatgacgacctccttgtaattgggcaagtgttgattcattgctcatggtataacaagttgctatcttgaattgtaggagattctgtgatgaacgtcaactagatcattaaaaaagcgctcggaaaaaccaagcgcttcaaaattaagccgggtcgcccattaccatccacaagattaaataagcgataactgctggaaatggggttaacgctaaaataacaaacaggacgcgagtagcggttacattccaattgaattcggctgccaatccgccaaggacaccggcaaatacacgatccgttgctgaacgatgaatttttttcatgtagattacctcctaagattgaaaatcaattttattgaagaagtcaacgtgaatattatcgtcggtaatttctaatctggtgatgctaccattaattgttgcaacaccttcgtctagttctggtgcgtaccgatcaatgattgaacgaatggtcataccatgggagacaaccaaaaattggtcaccatcttttgaattagcccgtagcttgtcgaatcctcgatctaatcgttgccaaaacatctcattgctttcagcttcaccgtataggtcagcttggtggattaaatcccgtgctttttctaagccataagttcccagcacagcggattcagaagttaactgtacctgagcacctacgaactgccacatctggtttagatcattaccttcaaaatacccatgacactgctcccgaaattcaggatattggtaagagacgatattcatattttctgggttttgttgtagggcgatatgcgcagtttcaattgcacgacccgaatcgctactataggctgcagcaaaggggatattctttagctgctcaccggcccgcttggcatcagcccgtcccttctcagttaatggggaatcaatccaaccttggaccttattataatgattcaacatggtttgcccgtggcggacaaagtatgctgtaattttcttcatgacgtggcactcctttataaacgacgtaagtggttacaccttcagtatagcaatgctgataggctaacgcgaccattttgtcgcggagatttaacccgcaagtatttttttctgcgagaagggggtaaacatgctattgtatgggaaggaggcgagggtcatgagtactgaaagtcgttatcgttatacgggtgaaccgcttgaaaatctaaataagtgggcaacgcgggcagctcgggttcccgaacaggccgttattgatgatgcgttagctgctaatgtggcaacgctaagtgatttgcaaagccggctatacgcgcaaaaggaaacaggtgttattgttatcttacaaggcatggacacggcaggaaaggacgggctgattcgccacgtgctgagtgggcttaatccggcagggacgagcgtggttagctttaaacagccaactaatcgccaattgagtcatgactttctgtggcgggttaatcgcgaattacccgaacgaggtgaaattcgaatttttaaccggtctcaatacgaagatgttttaatcagtcgggtgcacccagagatgctgctaacgcaacatattcctggtgtgacaaccctagcagatgtgggtgatgctttttttgaccgccgctatcgtgacttgcgtcattttgaaacgtatttacggcatcaaggttttgtgacaatcaagtttttcctacacctttcacgtgatgagcaaacgcggcgctttgaacgacggattgagattccaagtaaaaattggaaattttctcccagtgatatgcaggagcgtgctttttggaatgattatcaagttgcctataccaagatgctgacaaatacagccaccaaaaaagatccatggtatattattcccgcagatgataagggggtcgctcggttaatcgtctcaaacattttggtcaaacgtcttcaggatttacgaccgacctatccccaggtgacaccagaaacgcaagcccagttacggcagacattagtaaaattaaaaaacaacgaattgtaactaacaaaaagccttaaatgtggctctaagtcgaaatctaaatacttaaaattgtataatacaatcttgaaaaagttgtcgaccgagctcaaaaaatgctacagtaagacgagtaactttgaacgttcgaggaggcagtcgcatcatgaccgtgaaggtaggcattgacaaaattggattttacacaccgaatctgtatctggatatggtggacttggcgcatgctagaggagcagacccggcaaagtatcaagtaggaatcggtcaatcaaaacaggcggtgattccgccaacccaggatgtcgtcaccatggcggccaatgcggctgctcaaattttgacaccaacaatcaaaacacagattgctatggtcttgtttggaacagaatctgggattgataactccaaggcgactgccgtttatttggcccacctactagaactttcaccacaaacgcgagcggtcgaacttaagcaagcttgttatggtgctactgctgggttgcagctagcagctgactacgttcgagttcatccgcaagcgaaggtgttggtcattggtgcagacattgcgcgatacgggttgcggaccgccggtgaggtgacccaaggcggtggtgccgtggcaatgttggtggcggctaaccctcagattttagagttggaggccacgagcagttatcatacggctgacgtcatggatttctggcggccaacttatcgtaccgaagctttggtggatggtaagtattcaacgaatgtctatcttgatttttttgcggccgtttgggcagattatcaacgacagaccaaattaacaatcgccgactttgcggcatttacattccatttaccatttaccaaaatgggtcgtaagggattacgacaaattttgccaacggccacacctgagcatcaagcccagttaacagccgcctttgaagctagtcaagcggataatcgggatgtgggtaacctgtatacgggttcgttatacttaagctttttatcactattacggcatggccatttacaagcaggacaacgcattggtttctttagttatgggtcaggggccgagggagaattctttagtggccttatccaacctaattatcgtcaagggtttgacgatgctggattgacggatctgttggctaatcggcgagccgtttcagtagccgagtatgaacaactttataatcagcaattgagttctgatggccaagacatgcaattggcagtaggacaagaacaagcgccttattatttagctggtcgtcaacacgagcagcgggtatatcgacgccaataacaccaaaaaaggccagaatgtattctggcctttttttatgactcaaatttatttttagtgacaaatccatctttgtaaaccagtaccggagattggtgaccaacgcgaatgacaaaggtatatccacgacccaaagcctgtttaagtgattgactggtcttagcaaaattgttggtgaacttaggccatttggctgccttggcttggctgggatcctgattgagtgcggcaattgttttcttaagactttgattggtgaccgtcagggtgtaagtcttactttgagtatcaaatgagaccgatccaagttttgtcagtgatttaataagttgttgcttaacattctgctcattagttttttggattgttgctttagttgtacttgaactggtcgaaaatgtctgtgagctggacgtgagtgacacttttttagctgcttcagttgtttgatggctggggtgggaccagtaaggcaagttccagattgctaatactgtcccacacagggcaagaagtaaaatgaggcttgatccaatcttcgagtcgccgcgttgagcagctgtcaataaagaaaatagggcgatgagactaatcagtgccccaaatatagcaaagccaagaatcatatttggcacctctccgtatgtaagatgagcttagtatagcatgaaacaattatagaataaaaggcaattctagtacgcttgtttatttatagcgacatttttaacgatattgagcggagaaaaggaccctaagtgaattataaccgaatattaattgaattggtgtcgccaagagttcacttttaaggtataatatcaattattccagagaaatgaggagattagtgtgaccaacgtttacttagcaggacctttttttgatgatgagcaaatttctcgaattgagcgtgccgagaaggctttagccgccaacccacaggttaatcgtgtctttagtccacgattaagtgagatcgctggattgaccatggggacgccagaatgggccacgcagactttccaaatggatgttcaccagattgatgaagctgatgttgtggtggcattggttgattttgtggatgaccaagtagattcgggtacggcctttgaaattggctatgcttttcatagtgacaaaccaatcattgtgttacatgagaaagacaccatcttgaatttgatgttagcggaagggttacatgcctatctgcagaaagcagaaagtttggccgcatacgactttacgaacctccccgagagtcattatcacggaaaagtcttttagacgacaaaaaagcatttggccaactgccaaatgctttttttaatgaacatcatcgcggaacagcccgaccactttgccgagaatactaacttgatttaaaataatgggtgccatcgtatcattttcgggttgtaatcgaaaatggtcagcttctttgaagaatcgtttgcaagttgcttcattttcttccgtcatggcaatgacgatatcaccattgtcggcggactgttgtcggcgaacaatcacctgatcgccattcaagataccaatgttgatcatactttcgccacgaattgtcaacatgaacaattgatcatcgtcattttcaaattcagggggaactgggaaatagtcggtggcctcctgcacagccaagatcggttcaccggctgtgacagttcctaggacagggattttagtttgttcttcatgaacacccaattcttcaagaccagcggaagtgacttctaatgcccgtggcttggttggatctttggtgataaatccctttttttctagacgggcgatatgaccgtgaaccgttgaggttgaggagagcgccacggcttcaccgatttcccgaacagtcggcggataccctttctcgttaacgcgttcccaaatgaagcgaagaacggcgatttgtttactttcagaagctttgctcatcgttactgccacctcgttcgtcatttgtagtatagtttaagttgattgtagcatagccatcgtcgtttttcaaacagatgttcgtcttaattggttgaattttcggggtgaccctgatatgatggggcatggctaaatttgaagtattgaaatataaaaagatgaagttagggggactgttcatggcagaaccaacaatggatagtttattagcacgaattaatgaactggcacataaaaataaaacggatggcttaacggatgaagaaacggctgagcgtgaccatttacgtaagcaatatctcaaactctttcgagagagcttccggagccaagttgagatgatgcaggtttacgacaaggctgggaaagaagtcaccccagaaaaagttcgtcaaatccaacgtgataaagggttacgagacgattaacctgatgagcgagtcgcttttctaggattcgctcttttattttgctttaagtttgtgtaaaattaagcttgaatgtttttaacaaaggaggggaacaaattggcaacttggatttggattctaattgtgattgtcgtaggcttagcttgtgcagctggtggcttctacggcgctcggaagtacatggaaaactatttgaaagataatccgccgattaatgaagatcaattacgtgcgatgatgttacagatggggcaaaaaccatcccaacggaaattacaccaaatgatggccgcaatgcagcaaaatgcgcggaaaaaataacggttaatctcgactcgtttcccatttgtgggagacgagtctttttatttgtattttaaaaatagttcggtagaatggtaaagtctgtgctatattttaatcatattttaatttttaaggagggttgttcgtgagtatttttcgaaaactagcttggtactttcgcttggaatggcgacggtatctgatcggtattattggattgctgttaacggcaattgtggccattattccgccacggattattgggaatatggtagacggcattcacgggcagaccatgacaggtcgactgttggcactggatctgatgtgggtgacggttgcggcggtagtccagtacggaacgcgttatatttggcgcaatgccatttggggtggtgcggctcacttggaacaactgttgagaaatcagctgtttagccactttatgcagatggatcgggtcttttatcagaagtatcgaaccggtgatttgatggcacatgcgaccaatgatctggaagccattcaacgggtagctggcggtggaattttacaatttgccgatgccatcattacgggtgggaccaccttgattgcgatgatggcactggtcaactggcgtttgaccctcctggctattttgccatttccgcttttggcgcttgtttcttggtacctcgggcaaaagattcatcgggcctttggcgaatctcaagcggccttttcacggctaaataataaggcacaagaaagtattagtgggattaaagtcatcaaagcactaggccaagatgacgcggatgtggctgattttgaccagcaagttgctcatacaattgatattaatcggcgggtcaatcggttggactctttgtttgatccggcaatcaccttgattatctcaatctcttacgtggcaacaatcgtattaggtggactctttgtgacccatcaggtgattaccattggtaatttggtgtcatttattagttatttggcgatgatggtgtggccaatgtttgcggtcggcatgctctttaacacgatggaacgtgggaatgcaagctacgatcgggtaatggagttgttggctcagaaaactcatattatcgatcaaacaaatgggcttcaacagcggcctaagggaactttagcgtatcacgttgcccaatttgactatccggacgatgcgggtgctagtctacagcaggttgatttcacgttaccagcaggtcacacgttgggaattgttggccgggttggggctggtaagtcgacgataatgaaattgattttacgcgagtttgacaattatcaaggtcagatcatgtttggcggtcatgatattaaggactatgcgttagatagttatttacctgcgattgggtatgtcccgcaagaaagttttttattttcgaccaacatttttgaaaatattcgctttgcccgaccaaccgcaacgaaagctgaagttgaagccgctgctgccaaaagcgatttagctggacagattgctaagcttccggcgggctatgcgacggaagttggcgaagagggtatttcgctatctggcggacagcgtcagcgattggcgattgcccgagcgttactgattaatccagaattgctgattttggatgatgccttatctgccgtggatgcagaaacggaagctgaaatcttggctaacttgaagcaagagcgggcgaacaaaacgacaattatctctgctcatcggttaagttcggtgatgaatgccgatgaaattctagtgctgggccacggtcaagtgattgaacggggcacccatgatgaattaatggggacacatggttggtaccagcaaatgttcgaacggcagcagttagaaacacaagtgcaaggaggggtgacaaatggccgataaaccacatgaatcagcgtgggcacgtagtatgtctactaaagaacagctaggcgttattaaacggttatttaagtttgctgtgccttacaagtggttctttattgggtcaatcattctatcagctgcgatcagtgccgttaacgtctttttgccatggttattacaaatttacatggaccgttatttgcggacgagtcaggcatcgttggccattatgtggatgtttgcgggactctaccttttagggatgatcacgaaagctatctttcagttttggcaaaattataccagcaccatgggagctgagtatatgttggaaaatgtccggcgtcggttatttaataatctccatgctaaaggtatgcgatactttgatcaaacgccggggggctcaattttgtcacggctcatgaatgacacgatgacctttgccaatttttgggcgctgttcaatacccttgttttggcgctatttgcggtcatttcatcatttattgctatgtacgtgacggacgtcacggtggcgttgtggacgctagtcttggtgccatttttggccttcaccatttggtattatcagcgctttagttcacgggtttaccggcgaatgcgggaacgcctcagtgaattaaatacgaaactggctgaagcaattacaggaatcacggtcattcaagaatttcgacaggaacgacggacagcaacaaacttcgagaagaccaacgctgcctattatggtacgcggcgggcaatgattcggacaaattccttattattgagcccaattattaatctcttttatgctttggggacggttattgtcctgagtctctttgggattcgcggcttacatgaggttgtagcggctggtgttatttacgccttcattacgtatttaaataacttttacagtcccatgagtaacatgatggacaatcttagtgattttcaaaatgggatggtggctggctcccgggtgttacgaatcttagatgatcagacgctagcaccacagcaacacccagtagcggatgctaagattactcggggtaagatagaatttcggcacgtgacgtttgcttacgatgccgagcatcccgttttacgagacgtgtcgtttgtggctgagccaggtcaaacggtggctctggtcgggcaaaccggttctggtaaaacatcaacgattaatgttttgatgcgcttctatgaatttcaaggtggccaggtcttaattgatgaccgtgacattcgggactacccagccgctgagttacgtgccaaaatgggattagttttacaagaaccgcagttgttctatggtgacattcaaactaatattcggatgtttaatccggcgatctctgatgagcaagtgcaacgcgccgctcagtttgttcaagcagatgagttcattgaacagctaccacaaggttacgcaacgccagtgctggaacggggaacggaatattcggctggccaacgccagttaattacgtttgcgcgaacagtggtgacggaccctaaaattctgattttggatgaagccacggctaatgtggataccgaaactgaaacaatgattcagactggcttggatcggattcaagaaaatcgaacgaccattgcgattgcgcatcggttatcgaccattcaaaatgccgatcttattttggttttgaagcaaggaaaaattgttgaacggggcactaatgacgacttgatgcagcagcatggttattactatgatatgattcagctacaaaattccgctcacgttgagtaagcgtactattaaaaaaatcgccctattcggaaataacttctgaacagggcaatttttagttaattcgtgtgcgcgtcttttttctcagtgacgtcaacgtaatggaaagttgggtcaatttcacgatctaattggtcaaaggcagcttgcatttgttgttcaatctgtgcttggccttcttcgttaagcttcagtttgcgatcaatctcaattggtttgccaaatgcgatagtcacgggcttacgggtaaataattgcttgaacgtgagggggccctggtacacagcgggaaccaggggaacgccggccatcttagcaataacggccgcgccaccctttaattcatttgagtgacgagatcccgaaggaaacataattaaggatagatcaccttggcgcagaatgcgcacaggtgttttgatggcagaaggccccggatggtcacgatttactggaaaaccattgacatgtttcaacaaccatcggaaaatggggttttgaaataattcttctttagccataaagctaaatttacggggataggccgccatggcaaagtagactggatcaaaccaagtccggtgaggaccaacgagaacgtaaggcccttcaggtaggttatcttgattaacgtagcgtgcgcgcccgttaacgaggtacaagatggtacagacgaccccgcgtaaaaaacgataaaacatgtggtgcactcctctcacatggtactattttatctagtatgcaaaaaaaaacggctagttgcaagtgatcttattgggaaaaggatgtggtggggatgcaattaaaccccgatgaacgaatcgatcaactctatagtcaagatattaaaatcattcaaagcccggaggtatttgccttctcactggatgcggttttgctcgcggactttgcgagattaccggccagagccactagtcaaacggttgatttatgcgctggtaatggggcagtcggcttattcatgagtcaccaaacgcacggccagattgctgaagttgaaattcaaccacggttagcagatatggcacggcggagcattgaattgaatcaactgggcgatcgtttgagcgtctatgaaggggatttagcggacgttacgcaatggattcccaaggattcagttgatgttgtgacgtgtaatccaccatactttgcggatttgccagatagtcaaaagaacccgaatcagtatttggccatcgcccgccacgagattgcgactgatttagcaaccgttgttgcgacgacgagtggattgttaaaaatgactggcaaggcctactttgtgcatcggccggatcggttgggtcagttgtttcaattgttttctgaaaatcggttggcgccgaaaaaagttcggttagtttatcctaaaccgcataaggaagccaatatggtattggttgaagccattaaggacggtaagacaggcggcttacggtttatggaaccactaacggtttatgatgcacagggacactacacacctgaagtggaggtattgctgtatggacgagcctaagcagtattatttttatgttctactatgtgcagatcagtccttatatggtggttttaccacggatgtggtgaagcgttttgccacgcatctagcgggtaaaggggctaaatacacccgggttcatcgcccgttgaaagttctgtatagtgaagccttcgataataaacatgatgccctacacgctgagtgggcgtttaaacatcaaagtcgacaaaagaaggtcaccttcctagccaatcatggcgtaagcatttaacacgtcatatggtattgacttatgttaaactaacgggtagaacttggaacatgttcaaagattaatttgaggaggaacttactgtgaaaattattgcttatggcattcgtgacgacgaacaaccttacttagaacaatggtctaaggaccaaggcatcgaagtcaaagcggttgcggaactgttagatgaacagaccgtcgacttggctaaaggctatgacggggcagtagtctaccaacaaaagccttatacagcggccgtgttggatcaattggcagctaacggtgtgacgaacctatccctacgcaacgttggggtggataatgtgaatgctgatgcggtcaaacgaaatgggttcaaggtgaccaacgtgccagcctattcgccggcggccattgctgaattaacggtgactcagttgatgcggctgttgcgacggacacctacatttgaccgtaaacaggcgcaaggagatttgacttgggcaccagatatcgccgatgaattaaatcagatgacggttggtattgtagctacaggtcgaattggacgtgcggccatgcgtatttaccaaggctttggtgcaaaagtcattgcttacgatgttttccacaatccagaattagaaaagcaaggcatttatgtcgataccttggatgaattgtatgcccaagccgatgtcatctccttacatgcccctgcaactaaggataatgaccatatgctagatgatgcggcctttgctaaaatgaaggatggcgtgtggattttgaaccccgcccgcggtgccttaattgataccgatgcgttaattctggccttggatagtggcaaggttgcgggtgcggcccttgatgtttatgaggacgaagtgggaatctttaacgccgactttaaaaactttgatgccatcccagatgaacggctcaagaatttgatgaagcgtgaaaatgttttagtgacgccgcacattgctttttataccaagacggcggttaagaacatggtgcaatttgctttaaataacaataaacaattgattgaaacgggtcgggctgaaaacgaagtctcgttcaactaaattacaacaaaaaaatcggtaccttcagcgtttactgcaactgaaggtaccgatttttttatttttatgattagatgttgtggcatagacgattaagccatgttctgacacatccatcagttctatgagcattcagccacggcggtaagcgccagtagaagatcttgaagctcaagcgaatcgccaaccgtttgatcgggaatccaatcgccgtctggcgtttctaaattacggtggttaaaccaaaaggcatgccaaccagcttgcttagcacccttgacatccatcccgtaacaatcgccaacgtaggccacttcactggctcgtaagttgagccgatgattcatgagggtaaaaatctgtggatcaggtttcgccagacccacttcctcagatgtgataattgcctcgcggtcaatccatcgatgcatctgtaactgcatcaccttgtctaactggtgttgcgttttaccattggtaatgattcccaattggaattgatctttaagctgatctaaggcagttggtaagccagggaataattggatgcgctgcaggccagttgcgtaggctcgttcaaaatcaaccgctgtttctgtactgacaggggctaatccttgctggtgtaacgcgtgattgagccgtttaacggccatttcttcatgagaccagtgaccagcagctactttggcgtagacgctagcactctggcaacgataagcttggaaaagttgattaatatcagcgtcaaccgttggcataagtgactttaaggctgccacaaacggcgcccgttgatcatagagcgtgtcatcgacatcaaagacgaccgcttttatcattgcgtttcctcctcggttaaatccatagcagtttaccacattatcaggaaaaagccaatttaatgcaaaaaagtgcggatttagcttgtgttcgctcctggcattttgtataataactttcggtgcgtatgcgccaattcacacctcgagtgatgattgaaggggtgctcgcttgcgagttcttcgatcgtgcgatctcgggggaggaaatcaaaaactatttggaggcattttatcatggctgttatttcaatgaaacaactgctcgaagccggtgtccactttggtcaccaaacccgtcgttggaaccctaagatgaagcaatacatctttacggaacgtaacggtatctacatcatcgacttacaaaagacggtgaagttaatcgatgctgcttacaactacatgaaggacgaagctgctaagggcgccgttgttctgtttgttgggacaaagaagcaagcacaagactctatcgaagaagaagccactcgtgcaggtcaatactacgttaaccaccgttggttaggtgggactttgactaactgggaaaccatccaaactcggatcaagcgtctgaagagcttgaagaagatggcaactgatggcacgtttgatgttcttcctaagaaggaagtttccttgctgaagaagtctcaagacaagttggaacgcttcttgggcggtatcgaagatatgcctaagttacctgacgttatgtttatcgttgaccctcgtaaggaacaaatcgctgttcacgaagcacaaaaattgaacattccgatcgttgcgatggttgatacgaacactgacccagacgaaattgacgtggttatcccatctaacgatgacgctatccgtgccgttcgtttgatcacttcaaagatggctgatgcgatcgttgaaggccgtcagggtgaagaccaagttgacgaaaagacctttgaaggtcaaaagtctgaagccgctgaaggcgacaagaagaccgctgacaactcaatggaagatatcgttaacgcggttgaaggcgacaacaagtaattaaatgcaaggtgtcagtactgacactttccaaatataagatttaaagcaccttaggctggcttaatgtttaggaccgataatggcctgagattgagtcagtcttttttgatgttttagacgaatcaataaaaggaggccattacactatggcaagcaaaatcacggcagcacaagttaaggaattacgtgacaaaactcaagttgggatgatggacgcaaagaaggctttggttgcttctgaaggcgacatggacaaagcaattgatttcttgcgtgaaaaaggaattgctaaggccaagaagaagagtggcaacgttgcggctaacggtttggctcgagttaaagaagacggtaacacagcagctattatcgaagtgaactcagaaacagacttcgtggcaactaacgatacgttcaacgccttagttgatacgattgctgacacgattgctgaaaagcaacctgctgacttagatgctgcattggccttgacgacggctgatgggtcaactatcaacgatgctattgtgaagacgacgcaagttactagtgaaaacgtgcaattacgtcgttttgctgttgttaagaagaccgatggccaagtatttggttcatacttgcaccaaggtggtcaaatcgccgctgttgttgtcttagatggcgctgatgaagcgacggctaaggacgttgccatgcacgttgcagctatcaacccagaatttgtttctcgcgatgacattccggctgaacggttggatcacgaacgtgaagtattgaagcaagaagctttgaatgaaggcaaacctgaaaagatcgtcgaaaagatggtcgaaggtcgcctacacaagttcttgtcagaaatcagcttagctgaccaaccattcgttaaggatggcgatcagacagtgagccaatttgttgctagcaagggtggtaagttagtgacctttgttcgttacgaagttggtgaaggtatcgaaaagccagttgctgacttggcaaaagaagttcaagaccaaatcaacggctaatttgtcagaaaagcgtaggtttccgttgggaaactacgcttttttgttagcaatttgacaaaataggcggttttcctaacccctgactatcactagcccggggtttatgatagaattattgtcagaatacaataggaggaaacacaatggcggacgtaaagtataaacggattatgctaaaactcagtggtgaggctttggccggtgacaaagggtttggcattaatccgccagtcatcaagaccgtcgcagaagaagtcaaggatgtttataacctgggcattcagattgcgattgtggttggtggtggcaacatgtggcgcggtgaagctggtgcccaaatgggtatggaacgtgcccaggctgattacatcgggatgttggcaaccattatgaatgcgttggccttacaggacaatttggagtcaattggtgtaccaacgcgggtgcaaacttctattgaaatgcggcaaattgcagagccttacattcgacgcaaagcgattcggcacttagaaaaagaacgcgtggttatttttgccggaggaacgggttccccgtacttctctacggatacgactgctgcgttacgggcagctgaaatcaatgctgatgcgatcttaatggcgaaaaatggtgttgatggcatttactctgctgatcctaagaaagatccagcagcagtgaaatttgatcaactaacgcaacttgatatcatcaataagggcttgaacgtcatggatacaacggcaagttcactttctatggataatgacattccgtttgtcgttttcaatttaaatgagagcgggaatatccggaaagtcgttgaaggcgaaaatattggaacgacagttaggggtaaataataatggctgatcagattattgaaacagcacaagcaaaaatgacaaaggcagaagaggccttaaagcgcgaattgggaacgattcgggctggtcgggctaacgccagcatcttaaatcgggtgatggttgagtactacggtgtacaaacaccattgaaccaagtggcctcaattacgattccggaaccacggattttaatggtgacgccttatgacaagtcagcactagaagacattgaaaagggtattttggaatccgatgtggggattacaccagctaacgatgggacggccatccgactcgttgtcccacaactgactgaggaacggcgtaaggaaattgctaagcaagttaaagctaaggcagaagaaggcaaggttgccgttcgaaacgttcgtcgagaagccatggataacatcaaaaagggtcacaagaatggtgactatacggatgatgacctgcataacttagaagaccaagttcaaaaagtgacggataaggccattaaaggtgtagatgctatcgcggccgagaaggaacaagaagtgttgactgactaagctcaactagacaaggagtgctgaaaatggcagaagacaagcaaaacaaccaagataatattgaaattacccccggttctaaagaatttggcaagatggtttttcgattgaataatccagttaacgctgaaaatgtctcaatcttgaactataatggcgctgaattggaagaaattcaagaaggcgtttatgcgcagccagcgttcgttagcgatgatttcaacctcttcttcgtggtgacacaattgatcggtgatgactggatcgtggcgttctcaaaggccacgattgaaaatggtaatgagattaccgatttgtcggacccactgccaacgggtgaaggcttgaacctgttgggtcaagtaagtgcagatgatgccaacaacttgttgagctacttcggcaccttggctgatgcgaaacgcggcgaatggcggttaattgagtagccgttcaaaaactaaagttttcgctcaatttgggggccgggatagtttcccggtcctttttttgttatgatgaatggttgtaaagaccaatggaggtgcgccgtgttttcattttttagtaaagatcaaacgactggcgaagtcgcggaacatcaattagacgaagccaacattcccgcccacattgccatcatcatggatggcaatggtcggtgggctcagcaagggcatttgccccggattgccggacacaaacaggggatgaatactgtgaagacggtggcgaaggctgccagccacctgggcgttaaggtattaacactctatgcgttttcaaccgaaaattggaagcgacccaatgcagaagttaattacctcatgaaattaccagtagatttctttgggacatttgtgcctgatttgattaaaaataatattcgcgtgaaggttatgggctatacggatcagttgccggctgcgacacaaaaggcagtggctgatgctattgcagatacgcggcattgtacggggatggttctgaactttgcgctaaattatggtgggcgagctgaattggtgacggcggttcaacacgttgctcagcaagtccaaagtggccaactagatccagcagaaattgatgagacaatgctcgatcgacaattgatgacggcggatttaggtgaacttcgcgacccggatttgttgatccgaacgagtggggagaaacgtttgtctaatttcatgctctggcaggtcgcctacagcgaatttgtctttatgcaggagcactggcctgattttgatcaaacggccctagaaacggcaatttatgagtatcaacagcgacaccggcgatacggtggactgactcctgacacggagaaataattttattgaggagtttttgacatgagacaacgggttattacggcagttgtggcgttaattatctttatcccgattatcgttgcggggcatatctggatagatattgcggcatttgccttaggattagtggcattatcagaagtcttgattatgcgtaagaagttattggtaagcccggaagccatcatttccggcattggtattttggcagtgattgcgcctcagagttggtggggtgaattgctaccaagttacttgaagccttggtacattgtttatttatttatcttattgcttctgatgcgaacggtggtatcgcgaaatcgcttctcctttgatgatgctggtgtgattacattaagtatgctttacattggggtcggttttcatttctttattgccgcccggacgattagcttggcagctctgttatacgcgctgttcatcgtgtggacgacggattctggtgcttacatgattggtcggaagttaggtaaacatagattagcgccgcacattagtcctaataagacgtgggaaggttccattggtggatcattagtggccacgattgtggggagtgtgttttggtatttcttcccaattgggcactttagcctagggattatgattattttgacgctgatcttttccgtggttggtcaatttggcgacttggttgaatcagcacttaaacggtactatggtgtgaaagattctggtaagattttgcccggtcacggtggtattttagatcggtttgatagcctcttgctggtattaccggttatccatttgtttggattgatttagcgcggctgctgacttgcgtcgtctggggtcctagggtatgctagggagcagataaaaagcgcaggctactcacgactgaagaagggacgacatctgtgattacaacgattattacctttatcattgtctttgggattttggtcattgtccatgaattcgggcatttttactttgccaagcgaggcggcattctcgtccgtgaattctcgattggaatggggccaaaattggtttaccaccgtggcaaagatggcacgacttacacactgcggttattaccagtgggcggttacgtccggatggcgggtgctgaagatgacgaagaagagctgaaaccgggaacgccagttagcctgtacgtgggcgctgacgaaaaggttgaacgaatcaataccagcaaaaaatccacgttatttaacggtattccgttagaagttaccgcaacggatctagaggatgagttgtggattgaaggctatgaaaatggtgacgaaagtgccattaagcgctatgcggttgctcacgatgccacggtgattgaaagcgacgggacggagctacaaattgccccgaaggacgttcaatttcagtcggcatcattaggccgacgattgatgacgaacttcgctggaccgatgaacaatatcttattagcgattgttacctttatgctgatgtcctttgctcagggtggcgtttcaatgggcacgaatcaggttcaagtagctgattcaccggtatcagtggcgaaacaggctggcgtgaagaccaacgataagattacggcagtcaacggtcgaaagaccaccagctggaccgatcttagtaccgcgattcagccattggccaacaaaaaaacaacgctgacgattcaaagaggatcggcgaccaaacacattacagtgacacctaaaggtgaaacttccaacggtaaaacggtggggatgattgggatcacgcaagcccaagataagagcattggggccatcttagcttctggatttacacagacgtggacgatgaccaaagcgttgtttggggctttgtggcacatggtttctggtcactttagtttgaacgatttaggcggaccagtcgccatttttgccacaacctcacaggccaccaagtttggcttggttggcgtgttaaatttcttagcctttttatcaattaatttggcaattgtgaacttactgccgattccagccttggatggtggtaaaatattattaaactttattgaagctattcggcgtaagccgctttcagaaaatgtggaagctgccgttacgttgattggcgtggggttcttagttctgcttatgttactggtgacgtggaatgatattgaacgctactttattcattaaggaattcggttattacgagaagggactatttgactatgaaacaatcacaactactcattccgacgttaaaggaagtaccgaatgacgccgaagctctgagccatcagatgatgctacgagccgggtacattcgtcaggttaccgccggcatgtacgcctacctaccgctggcgtttcgggtgttgacgaacattgaaacgatcattcgtgaggaaatggaaaaaatcaatgccgttgaaatgctgatgccggctgtattgccagcatcactatggcaggagtccggtcggtatgaaacgtacggtcccaacttgtttaaatttaagaatcggcatgatagtgattttattttggcaccgactcatgaagagacgtttaccatgttggtgcgtgacgcgattaagtcgtacaagcgactaccactggtgatgtaccaaatccagcctaagtatcgggatgaagatcgcccccgttatgggttgttacgcggccgcgaattcattatgaaagatgcttattcattttctttgagtgatgaagatcttgatcggatttataaccagatggagcaggcttatgaaaacatctttgatcggattggcttaaactatcgggccattgtcggtgatggtggcgccatgggtggtaaggattctaaggaattctctgcaattgcccctgttggtgaagataccatcgtttattctgattcttcagactacgcggctaacttggagatggctaagagcctctttgtcagcaaaaagtcacatgcccaactggcggatctcgaaaagatcgccacaccgggggttcacagcattgccgaattggctgaattcttagacgttaagccagcagctttggtcaagagtatgctttacatcgcggatgaccaaccagtaatggtcttggttcgtggcgatcatgaagttaatgaaacgaaactaaagaactatttgaatgctgatttcttgaatccagcaacaccagaagacgcacagaagtatttaggcgcaaacttcggttcattggggccggttggtgtcagtgaagatgttaaaattttggctgaccaatacgtgggtgacatggttaacgtggctgttggtgctgacgaagatgagcaccactaccttaatgccaacctcgaccgtgacttccgggtagacgcgtttgctgatctccgtgaagttcagccaggtgatttatcgccagacggttccggtgtcttgaagtttactaaggggattgaaattggccatatctttaagctggggacccggtattccgatgccttgggtgcgacagtgcttgatgaaggcggtcgtcaaaagcccgttgtgatggggtcgtatggtattggagttagtcgactcttatcagccattgctgaacaacaagctgatgacaagggcttggtttggccccggaatattgcgccatttgatattcatttagttccggtcaacttgaagaaggatgatcaggcacaactgaccagtgagttagaagaacaattaacggctaagggttaccgcatcttaacggatgatcgaaaggaacgacctggcgttaagttcgctgattctgatttgatggggattccagttcgaatcactatcggtaaaaaagctggtgaagggattgtcgaaattaaaattcggaaaaccggtgaaaccgtcgaagtgattaaagacgaagttgctagcaccgttgaaattctcttcaaagacattgactagctgttaatgtcgttagcaattatgagttttggatatgagaggtcgggacaaacgtcctggcctcttttagccagacgaaaggagtttacttgtggacgaagatcgccatgctttatttgaaaagctactacaacaattagatttgactagtgaagccgatcagccttacttccaaacggccacggtggatcgcttaaccgtacatgaacaatcgcgtcgctggcaatttttactgaaattaccaagcatgttgccttttacggcgtttgtagatttccacaatcatttacaggtcgctttccgggaaattgcgacggttgaggcgaccattgaagtggaccagccggagttaaccaaccggctactgggcgactattgggagtggatcgttaagaatagtggactgaccagtaatttgattcaggagctttgtcagtcgcaagtaccagagttggatgagaacaatcgggtcttactctatgcccaaaatgaagtggttaaagacttcttgagcaatcaggcactagggccgattgaatcggcttaccgtcgtgcaggatttccgaagttcaatattcatgtgatgattgatgaatctaaatctcaggccaaaattgatgaattcaaagcgcggcaagaaaagacggatgcgcaactggcgcaacaggccgctgcggcgattgaaaaggccaaccaaaaacgccaatcacaaggggacacgccagctgctgaagggccaacccagattggtaaggccattaagggggatcagccagtcactaagatgattgacatcacccaagaagaacggtcagttgttgtggaaggctatgtttttgaaaaagaagttcggaagctacgctcgggacgccagctgttgacactaaaaattactgactacacctcgtcttttgcggtgaaaaagttctcgcgcggggctgaggatgaggcgcaatttgccggtgttgaagaaggtagctgggtcaaagtccggggtaacgttcaggaagacacgtatatgcatgacttagcgttaaatgcctatgatattaatcaggtgaaacatgctagtcggcaagacacggcacccgagggagaaaaacgggtggagttgcatttgcataccagcatgagccaaatggatgcgacgaactccattggcgattacgtcaagcaagctaaaaagtggggaatgccggcactggcaattacggaccatgccgatgttcaagggttcccagcggcgtttaattcggcggctaaggccggtattaaaatgctttatggggtcgaagccaacttggtggatgacggtgtacctatcgggtataacagtgcgcacgttcccttagatggagcgacctatgtggtctttgacgtggaaacgaccgggttatctgctatttatgacaaagtgattgaattatcggcggtcaaaatggagcatcaaaacgtggttgatcagttcgaagaattcattgacccgggcttcccactgtcggaacagacgaccaacttaacaagtatcaccgatgatatggtggccgggtccaaatctgaagaagaggtcttcaaacttttccgtgagttctgtggtgatgcaattatcgttgggcataatgtcacgtttgacgtggggttcatgaataccgggtaccaacgtcacggaatggcagagattagcaacccaatcattgataccttaacgttggcacgtttcttgtacccaacgttaaagagttatcgactaaatacattggctaaacgtttccatgtcagcttggagcaccatcaccgggccgtatatgatgcggaatccactggacatttgaattatctattcttaaaggatgccgaggaccgttatgacattcaatatcatgaccagttaaacgatcatatgactgataatgatgcttataagcatgcccgaccgaatcacgcgattctgttagctaagacccaagcgggacttaaaaacatgtttaaattggtgtcggcttctaacgttgactactattatcgggtgccacgggtccctcgcagtgttctagaggagtatcgagagggaatcatcgttggttccgcctgttcgtcgggagaagtctttacggcgatgatgcaaaaaggtcaagtagaagcggccgctaaagctaaattctacgattaccttgaagttcagccctcagctgcctaccagccgttgatcgattcgggacttatcgccgatcgagaaaatatggaagaaattgtgcgtaacatggtgaaacttggtcacgatttaaacaaaccggtggttgcgacgggggatgttcacttcttaaatcccgatgattatatttaccgtaaaattctgattcattcgcaaggtggcgccaatccattgaatcggcaagagttgccagacgttcattttatgacgactgacgagatgttaaccgattttgcttacttgggcgaagagacggctaaagaaattgtcgtaaccaatacgcaaaagattgctgatgacatcgatgaagttcatccgttaaaagataagctgtacacaccgcgaatggaaggcgccgaagacgaaatccggcaacggacgatggatacggcacatgcgatgtatggcgatcctttacccgaactggttcagcatcgagtggaccgtgaacttaagtcaattattggtaacgggttctctgttatttacctgattgcgcaacggctggtagccaagtccaataaggatggttacttagttgggtcacgggggtctgtggggtccagtctggttgcgacgctaaccggaattactgaggtcaatcctttaccgccacattatcggtgtccaaagtgccagtattcgcatttttataccaaaggggaatatagctcagggtatgatttgcccgaaaaagattgtcctgaatgtggcacactgatgattggcgatggccataacattccgtttgaaacgttcttaggttttaaggggaataaggttccggatattgatttgaacttctccggggactatcaaccgattgcccataactatacgaaagtattgtttggcgagaagaatgtgtaccgggccggaacgattggcaccgtggctgacaagacggcttacggctatgtgaaggcctacgagcgagataccgagcaaaccttccgcggcgctgagattgatcggttagccaaaggggccactggggtcaaacgaacgactgggcaacatccagcggggattattgttgtgccagattatatggacatttttgatttcacgccgattcagtacccggctgacgatcaatcggcagcttggcaaacgacccactttgatttccattcgatccatgataacattttgaaaatcgatattttagggcatgatgatccaaccatgattcggaccctacaagatctttcaggtgttgatccaacgacaattcccatggatgatcccggtgtgatggggttattctccgggacagattcgctgggggtgacgccggaacaaattcaatcgaagaccggaacgttaggtgttcctgaatttgggacgcggttcgtgcgggggatgttagaggaaacgcatccccaaaattattcgcagctactgcaaatttccggactttctcacggaactgatgtgtggttaggtaatgctgaagaactcatcaagaatggaacggcaacgattgctaacgtgattggttgtcgggataacattatgaccgacttgattaacttcgggttggattctgaaacgtcattccaagtgatggaacacgtgcggaagggccggggaatccccgacgagtggcaagaaaaaatgaaagccaccgactgtccggactggtacattgattcttgtttgaagatcaagtatatgttcccccgggcccatgcggctgcttatgttttgatggcgttgcgggtggcgtactttaaggtctatttcccaattatctattacgcggcttacttctctgtgcgggccgatgattttgatgttgtggcgatgtcacaaggaaagacagctgtcaaagcagccatgaaagcgatcaacgatcaagggatggacgcgtccgccaaagataaaaacctgttgacagtactggaattggctaatgaaatgcttgagcggggctttaagttcaagatgattgatttggaaaagtccgacgctgctgattggattatcgatggggatacgttaattgcaccattcaaagcagcacccggtttagggttaaacgtggcgaagcaaattgtggcggcgcgtaacgatcggccatttatctctaaagaagacttggccaagcggggtaaggtctccaaaacattgattgattttatgacagaaaacggtgtattagccggtttgccagacgaaaatcaactcagcttgtttgatgacttaatgtaaattaatgttaaagaagagtcatggttaagtagccatgattcttcttttgaatttaatagtaagcgcttacaaacctgttaaaatatggtatacttaagctgtggaaatgagaaccagaaataaactctagcgaaagcgggtgttcaccatgttacggcggttcgtacggttaccagatgggtggatttttctagcaggttattgtttgattggtctgggctacattttgtttgggacactggccacggtcgtatcagcaccgtttttggcattagtcattgcgtactttctggcggcctttgtgttaaccgtaattaaggcgattagtttgcgaaatatggcaacgacccggctgaattttctggtttttgaatttatcacaattgttggttttattttactcttagtgactgccgagtcataagtggtcaaacagttgcaatcgcggtgaaactgtagtagagtggtgtttgtagttaaactcgtttttaaatgagtgagcagtcattgctcactctttttaatggaaaaatgtaggaggcggaattctttgagtactgtcgtcgagaccgtgacggccttagcccagccgattgtggcgcagcatcagtttgaattagttgacgttgaatttgtcaaggaaggcaagagttggtacctgcggctctacattgataaacccggaggcattaatatcgaggaatgtgcgttggttagtgatgaagtgtctgagaagatggacgctttagatcctgatcccattcctcaagcttatttcttagaggtttcttcacccggcgcagaacgtcctttgaagaagccagccgactttgaaaaggccgtgggtgattatattcacgtgtcgttgtaccaaaagattggtaacagtaaagtttatgaaggtacgttgttgtcattaacagcggatagcctggatttagaagtgaatctcaaagggcgcatcaagaccttaacgattcctcgcgatgccgttgcccaagctcggttagccatcaagttctaactaaataaggagcgaaacagaacatgagtaaagaattattgggtgccttagatgtactcgaaacggaaaaaggtatcgacaagcaagttgtgatcgatgctttggaagccgcattagtttctgcttacaagcgtaactatgaccaggcccaaaatgttgaggtcgaattcgatcaacgtaagggtgatattcacgtttatgcggtcaaaaaagtggtcgatcaagtatatgactcacgtttggaagttggtttagacgaagctttgacgatcaacaagggctatgaattgggcgatgacattaagtttgaagtcactcccaagaattttggccgaattgccgctcagacggctaagcaagtgattttacaacgggtacgagaagccgaacgtaatatcatttacaatcaatacagccaatacgaaaatgaaatcgtcactggtgaggttgaacgtcaagattctcggtttgtctatgtgagtttaggcaaggttgaggccgttatgggtcgtcaggatcaaatgcctaacgaaacctatcggattcatgaccgggttaaagtatacgtaacgcgggtggaaaatgcgacgaagggtccccaagtctttgttagtcgaactcacgcagacttgttaaagcggttgtttgaacaagaagttccggaaatttatgacgggaccgttgaaattatggcgattgcgcgtgaagctggcgacagagccaaggtggcagttcgttctaataatccagatattgacccagtgggaacaagtgttggtccacgggggcaacgggttcaaacgattgttaatgaactaggcggcgaaaacatggacattgtcgaatggactgatgatgaagccaagttcattgccaatgcgttgaatccagcggaagttttggatgtgatctttgacccgaacaacgagcgtgcttgtgaagtcatcgtgccagattaccagttgtcattggcgattggtaaacggggacaaaatgcccgcttggctgctaagttaaccggttataagatcgatattaaatcagaatccgaagcatctgctataatggaagctgaccaggctgctgatgaagcaacaactggtgctactgttagcgaggatgatgccactgaaccagccgcagaaacggttgctgacgataccactagcgaagaaacgccagtcaatgatgcaacgacggatgtggcgagtgacgaatcagctgagtagcgaacagtccaaggagggttaagcccatgaaacagcgaaaaatcccgatgcgtaaagacatcgtaacgggtgaaatggcacccaaaaagcaattggttcgggttgttcggaaccaagatcaagaagtcagcattgatccgactgggaagcaatctggccggggagcttacattagcctcgatgttgaaatcgctaaacgggctaaaaaggagcggacttttgaccacgcttttagtcttaaaatcgatgatcaattctacgatgatttaatagcgtacgttgatcatcagcaagcacggcgggaattatttgaccatgactaattctgaacgtgctttacaattattaggacttgtccgtcgagctggtaagttagtgacgggtgaatcctttgtgttagccgctgtgcgggatggctcggcgaagctggtcttactggctagtgacgcgggtcaaagtaatcaaaaacagttccgcgataaaacaacgagctatcacgttgaattgaatgaatcgttttctaaggaccagttgagcacggcaattggtgctgcgcgcacggtcattgccattaccgacgcgggatttgcccggaagttacaacagttactcgcgtagccgcctgacgttctcgcgctcggtgaaagataaaggagtgtgaagatatggggaaaaagcgaatttatgaactcgccaaagaaattaatgtctccagtaaacaaatcatcgcaaaggctgaagaaaaaggctttccggtgaaaaatcacatgtcaacgctcggcgagaacgaagaacgtcagttacgggaggcttttaagccacaggctaagaccagtcatgaacaatcggctgcgtcagcacaaccgcaacgcaaggtgcaacagccccggcgagaaaaatcgcaagggactgcgcggacacaaacaacagcacaaaaaccagcaggaaaacctgctaatcaaacacaacgtaacaacaataataaaaataacggccaaaccgggaatcgtcagcatgagcaacaacattccggtactggcagatttggtggaagcttgaataataatacgaataatagcaacggccggcgtaatagcaacaattcaaacagtcgtggtggccgtaatagccgcaataaccgcaacaatcgccgccgtaataataacaataataaccgatacaagaagaaccaacggattaaagacacgaaccagcataagggtgcgccagaacggaagaataaggcattaccagaagtcttagtttatactgacgggatgaatgcccaagacttagccaagattttacaccgttcttcggctgaaattgttaagaagctctttatgcttggcgtgatggttaatcaaaaccaatccctggataaggacacgattgaaatcttagccgatgactatggcattcaggcgcaagaaaaggttgaagttgacgtgaccgacatcgataagttcttcgatgcggaaatggctaataaagactttgaagcaccacgagcaccggttgtgaccatcatgggacacgttgaccatgggaagacaacgttgttggatcacctccggcactcacacatcacggatggtgaagctggtgggattacccaggctattggggcctatcaagtgcactataatgataaggtcattaccttcttggatacgccaggacatgcggcctttactgaaatgcgggcacgtggggctgaaattaccgatattacggtcttggttgtcgctgccgatgatggtgtgatgccacagactatcgaagccattcaccatgcgaaagccgcaggcacgccaattattgtggcggtcaacaagattgataagccaggggctaacccgaaccatgtgatggaacaattaacggaatacgaattgattccagaagactggggtggcgataccatctttgttgaaatctcagcgaagtttggtaagaacatcgacgaattattagatatgattctgttgcagtctgacgtgttggaattaaaggctaaccctaagcaaaatggggttgggtctgtgatcgaagcccggttggatcaaggtaaggggtctgttgccactctgttggttcaacaaggaacccttcatgttggtgaccccattgttgtcgggaatacctttggccgtgtacggactatggttaacgaacggggtcgtcggattaaggatgctacgccgtcaacacccgttgaaattaccggtttgaatgacgtcccagaagctggggatcgctttgtcgtctttgatgatgaaaagacggctcgggcggctggtgaagaacgggccaaggaagccttagtcaaagaacgtcggaacacgagccacgtcacgttggataacctctttgattcccttaaggaaggtgaaatgaaagaagttgacgtgattattaaggcggatgttcaaggttccgttgaagccttggctgggagcttgaaaaagattgatgtatccggtgttcgggttaacatcattcattcggccgttggggcaatcaatgaaagtgatgtcactttggcagaagcttctgatgccatcattattggttttaacgtgcggccaacaccacaagcccgggcacaagctgatagtgacaaagtggatattcgcttacacaacgtgatctacaacgccattgatgaaattgaaacggcgatgaaagggttacttgaaccaacttacgaagaagaaattatcggagaagttgaagttaaggatatcttccatgcgtctaaggttggtaccattgtcggtgggatggtaacggaaggttacgtgacctctgaaagtgatgtacgcttgattcgtgatggcgttgtcatttatgaaggtaagttgggtagcctgaagcgtttcaaagatgatgttaagcaagtgaagatgggttatgaattaggtttgacgatcgagaactataacgatgtcaaggtgggcgacgttatcgaagcctacgtgatgaaggaagttccggttaaataaagttcggaggcaaccagcaatggcacaatatcgagttggccggttggaacaagaaatccaacgggaagttacggatattttactaaagcgcgtccgcgatccacgggtcgaaggcgtgaccgttaccggtgtggaagtcacaggtgacttgcaacaggcaacgatttactacagcattttatcggacaaagcctcttctgctgaaaaaacagcggcagggttaaagaaggccaccggattgattcgttctgagttgggctcacggttaagtatctacaagacgcctgagttgacgtttgaacaggatggatctgttcggtatggtagccggatcgatgaattgttgaatgatcttcatcaccaagactaattggtaatgggaacatgaagacgctgatctagctggatcagcgtctttttataacggtaaaggtttaggaggcgtcaaaaatgaacgggattattccgttgtacaaagagcgaggacttaccagcttcgattgtgtcgcaaaattgcgtcacatcttgcagactaaaaaggttggtcatagtgggaccctcgatccaagtgtggatggggtgttgcccatttgcattggttcggcaacgaaagtggtgccgtatttgatggcgtccggtaaggtgtatcgcgggtcagtcacactaggattggccacgacaactgaggacttggatggtgacgtggtcgagcgacagccacttgaacggccgttcactgctgatcaggtggctgcggctgcccaagcactgacgggaacaattcaacaaacaccgcccatgtattctgcagtgaaagtgaatggacgtaaattgtacgagtatgcgcgtgctggtgaaacggtcgagcgaccaacccgtacgattacggtggatcgattcgacctgcaaggcgccggaaccttcgatgcaacagcggggacccaaacgattgattttgaaatcgcctgttctaaggggacctatgtccggacactagcggtggaccttggccagcaattaggcgtgccagccgtcatggctactttgacgcgtctaaaaagtggtggctttacgttgtcacagacggtcacgttggccgacgttgaagccgcaatggctgatgaccagattgaacgtactttgcggccgattgactacgccttgcaagactatccccatgttgcccttgatgagcacttgtgggcactcgtgaaaaatggggtctttttatcggcggcggagttaaatcaggccacggaaccagaattggccttaacttatcaaggtgaaaccaagtgtttgtaccgttggtcagatgagaaaaagcagtatcgaccattaaaaatgtttgcggtgaattaaactgaggagagaaattctttatggacgttattcgtatacaccatcccttagatgcccggcagattccagatgaacctgtcgtattggcgatgggcttctttgatggggttcaccgggggcatcaagcggtgattgcgcgagccaaggcgttggcgcaagaaaaacaggctaaactggcagtgttaacttacgatcatcatccagccttggtctatcggccattggaagcagatgatcgaaaatatttaagtatcccaaccagaaagctccaacagttggagcgattaggggtcgaacgggtctttttagtgaactatacgggtgaatttgcgtcgcagtcgccacaagagttcgttgatcattatttagtggccttccatacggtggttgctgtcgctggttttgatcacacctatggcaagaaagatgtggcgacgatggaccgcttagctgattatgctaagggccgtttcacggtcgaaacggtggctcaagaagcccaagatcagcaaaaaataagttcaacgcggatcaggcaggcaatgaagcaaggcgacattgatctggccaatcagttactgggttatccttatcgttcaacgggcgtggtcgttcatggcgaggcgcgtggcaggacgattggctatcccacggctaatattttaacgccagagaatcaatggctaccgggaattggaatttataccgcacggctaaaggtgggcgctatttggtacccagggatggtctcaattggtcgcaacgtgacctttggggatggtcggccgattacggtagagatgaatctgctagactttcaaggaaacctatatggcgaaccagtggaagttgagtggcagcatcgcttacgcggcgaaataaagttcgctgatgccgacgggctagttgatcaattacagcaagacgaacgagaaacgcgtgcgtattttcagcggttaacgcaataagcttaggtgggtctgggacaaaagtctcaggcccttttgcgtttttaaatagctggtggtgaaccagctaagcgccttttgtcctacgcgcatttgttgttgaataacggttttaacgaaaaaattagcacttaattacgttgattgctaaaaattctgttagatttcttgacttcaaaacgcggttttgctacattatatatgtgtcttagcacttgtgttgtttgagtgctaaaaaaggggtgattgtgatgctttcagatagacagatgatgattctgcgagcggttgtccgcgactttacgaacacgggagtgccagttgggtcaaaggcattagctaagcagttacccatccacgtaagctcagcaacgattcgcaacgagatggcggccctagaagagcaaggcctcataaaaaagacccattcgtcttccggacggattccgtcggttgaggggtatcgctattacgttgatcatttagttaagccagatcctttgcgacccaacgatattgatgtgattcagtcatcgttaggcggcgattttcataaaattgatgagatcatttcgcagtccgcgacaatcctgtcgaacttgacgagctatacggcgttcacgttgaagccggagctaaaggatagccgtttgagtggctttcggttagtgccattgggcaagcggcaagtgatggctatcttggttaccgatagtggtgatgttgagaaccagacatttgacgtgagcgaagcggtatcgggtgatcagcttgaagccgttgtacgtttaatcaatgaccagttggtcggattgacgttaccggaagtcttacaaaagctgcgaacggatatcccgatgaaaattactaactatatgcaaagccccgctggttttctcgatattttcggggatgtcttgacccgggccgcgcaagagcgattttatgttggtggtcgactgaatttattgaatttctcgcaggatagtgacgttgattcactaaaatcgttgtattcactgatcgacaagaccgatgatattgcaaacgtgttgggtcaaccaagtgataatatttccgtacagattggtaacgagatgacgaatgatgcgctacgcaatttcagtttgattaccgccacctatgacgttgatcaacatggtaagggcatgattgccattctcgggccaacgcgaatgccatattcgcggatgttgggaattgttggtgcgtttcgtgaagaactcgcgaaaaaattactggattattaccggtactatgacgagtaaagaaagggagggtttttatcgtggctgaagaacaacaaccatccacagatgatgaaactgcggcaaagtccgccacaacaaagcaagcgtcacctaaagctgagacagatcaatcggcaactcagccggttgaagaccagccaaccgcaacgcctgaagaagtcgctgctttagagaaaaaggcagctgactttgaggataagtacctgcgggcggaagcagaggttcaaaatatgcaagcacgcttccaaaaggaacaggcgacgttgatcaagtatgatggtcagcaactggctaaggacgtgctccccgtcattgataatttggaacgggcgttagctgttgaggcgagcgatgacgttgccgcacagatcaagaagggggttcagatgacttatgatcatctggaagatgccctgaagcgtaaccatgtgacggaaattgcggcgttaggtcagacctttgatccaacgttacatcaagccgttcaatccgttccagcagaggatggtcagactgctgaaacagtggtgaatgtcttacaaaaaggctatcaactaaaggatcgggttttacggccagccatggtggttgtcgcacaataacttattcaaaccaaaaactaaaaaaagagggaatttttgatggcaagtaacaagattatcggaattgacttaggaacgactaactcagccgttgccgttcttgaaggtagtaccccaaagattattgcaaataaggaaggcgctcggacgacgccatccgttgtcgcttttaaagacggcgaaacacaagttggtgaagttgctaagcggcaagctattaccaacccgaacacgatttcatccatcaagagtcacatgggtgaagctggctacaaggtgagtgttgatggcaaggattacacgccacaacaagtatcagccatgatcttacaacacttgaaggcatttgctgaagattatattggggatacggttgaaaaggccgttatcacggtacccgcttactttaacgatgcgcaacgtcaagcaactaaagatgctggtaaaattgccggtttaagtgttgaacggatcattaacgaaccaacggctgctgctttggcttatggcctggacaagcaagacaaggacgaaaaagtcttagtttatgaccttggtggtgggacctttgacgtttctgtgttggaattaggtgatggggtctttgatgttctctcaaccaatggtgatacgcacttaggtggggatgactttgaccaaaagatcatggactggttagtcgctggtttcaaagaagaaaatggcgttgacttatctaaggataagatggcattacaacggttgaaggatgctgctgaaaaggctaagaaggatctctctggagttactgaagcacaaatcagcttgccatttatttctgccggtgaaaatggaccactgcatttggaaaagagcttgagtcgggcaaagttcaacgaattgacggctgacctggttgaaaagacccggattcctgttcaaaatgcgttgaaggatgctgacttacaagctagtgatattgatgttgtaatcttaaacggtggttctactcggattccagccgttcaagaagctgttaagagctggacaggtaaggaacctaaccattctatcaaccctgatgaagccgttgccttaggtgctgccgttcaaggtggggtgatcactggtgatgtgaaggacgttgtcctattggatgtgacgccattgtccttggggattgaaaccatgggtggtgtctttactaagttaatcgatcgcaacacgacgattccaactagcaagtcacaagtcttcagtacggctgctgataaccaaccagctgttgatattcacgtcttacaaggtgaacggccaatggctgctgacaacaagacgttaggtaacttccagttgactgacattccagctgctcctcgtggtgttcctcaaatccaagtgacgtttgacatcgataaaaacgggatcgtaaatgtttctgctaaggacatggggacgaacaaggaacaaaagattaccatcaagagttccgacggcctatccgatgaagaaattgaaaagatgatgaacgaagctaaggaaaacgaagaagccgataagaagcgtaaggaagaagtcgataccaagaacgaagtcgaccaattgctcttccagaccgacaagacgttgaaggacgttaagggtaaggtttctgatgacgaaatcaagaaggctgaagatgcacgtgatgccttgaagaaggcccaagaagctaacaacttggacgacatgaaggctaagaaggatgatttgacgaagattatccaagacctttccgtcaagctttaccaacaagcccaaagcgaagccggtgacggtaacgctgctggtgccgatggggcgacagcggacgctgataagaaagatgataataccgttgatggtgacttccacgaagttaacgacgacgataagaagtaaaagccgataagatgcggcttggcaaaaagtcagagtccgtggggctttggctttttgtttcgagtatgctattcttatgagtagcaaaaacagcggtatggattgggaggaaaaagatggcgcaaagtgacttatatggcgtattaggtgtcgcaaaagatgccagccaagatgaaatcaaaaaagcctatcggaaattgtcaaagaagtatcatccggacttaaacaaagcccccgatgcggcagaaaagttcaaagaagttcaggacgcctatgacgtcttgggcgatgaacaaaaacgagccaactatgaccaatacggatcagctgatggtgcgcaaggcggttttggcggtttcggtggtggtcaacaaggtggcttcggtggctttggtggtggcggtggcttcgacgacatcttcaaccaattctttggaggtggcggtggtcaacgtaatccgaatgcgccacgacctggtcgtgacttacaatatcagatggatttgacctttgaagaagccattttcggtaaaaagactaaaattaagtataaccgggaagcccagtgtcacacgtgtggtggcaatggcgctaaaccagggacatcaccagtgacatgtcaccaatgtggtgggtcaggttatgtgacgaccgaaaccaacaccccgttaggacggatgcgtagccaacagccatgtcctgtttgtcatggaacgggtcaagagattaaagaaaagtgcccaacctgcggcggctccggacatgaagaagaacggcatgaagttgaagtcacgattccagctggagtggatgatggtcaacaaatgcggctgcaaggtcaaggtgaggctggccaaaatggcggtggttacggtgatctattcattatcttcaaagttcagccaagcaaggatttccggcgtgatggcacagaaatttactttgaccaagacatttcgtttgtccaagcaaccttgggtgacgatgtgacagtcaagacggttcatggtgacgttaagctaaaggtccccgctgggactcaaggcgggacaaccttccgtcttcgcggtaaaggggcaccacggttgcgcggtaacggcaatggtgatgaacacgtgacaattaaggttgtgacccctaagaaccttaacaaaggtcaacgcgatgccttacgtgactttgcgaaggctagtggcgaaagtgtcacaggtagtggcaaaggaaatttatttaacaaaatgcgcgacaaatttaatgaaaactaggattcaagttttagtggttcgtagttgatatatcaaggctgctgagtagtttcggcagccttttttgtggctaataattaaggggataacttaagaatgaaaagaaagcgttaaggttgagtgacgttgtttgcaatcatgttttgtcaatgataacctcaacttatagggaatgtggcgggggccacaattctccacttgactaaaacgattcgtcggggaataattagttctagtcgggtttggacggacgtcggtttcggggacgaatgaaccggcaaactttgggggtgaattttcatgaaaacaaagtggctggcgatttggcatcaaccggtcgtcgcatttgttggctggaccatcttctattttgttatcttgatggcgctggtttatttatacggttatagtggcttaaataattcgacgtttatttacaccgaattttaggatagcaatgaccgtgatacttttttggggggatagacaatgattgataatatgattcaagcaatggatcactgggccgtaacggaaccaaatcgattagcttatgatgatttgggacacacgaatacgtacggagagttaaaacaacgttctgacgcgttagcagcgcatctggatcacatgcagttaccagctgggtcaccgattatggtttttggtggtcagacctttgatatgatggtgaccttcctaggcgttgttaagagcggtcacgcttatgtaccaatcgatacacactcgccactagagcgggtaaccacgattaacgagattgcccaaccggcagccgcaattggggttgccgacttgcccacgactttaggggatacaccgattattacggcggcagatctgcaacggatttgggcaacaccagtagcttatgacgtgacccatgccgttcagggagatgagacgtattacatcattttcacgtcgggaactaccggaaaacctaagggcgttcaaatttcgcataataacttattgagttacgttaattggatgctgagtgatgatttcgcgttgcccacagctgctcgaattttatcacaagcaccatattcttttgacctgtctgtgatggcctggggaccaacgttggcttctggtggtacgttagtggccctacctaagacggtgacggataatttcaaacagttgtttgaaacactacctactatggatttaaatgtttgggtctcgacaccatcctttatggatatttgcctacttgaaccaacatttgatggggaacattatccagaactgacgcgcttcttattctgtggtgaagaactgactcatgcaacggcttcggcattgcatcagcggttcccagcagcacgaattttcaatacctatggcccaactgaaactacggttgcggttactcaggttgaaattacggctcagctgttacaggattatccacgattaccaattggctatgtcaaagcagacacaaccattcaggttgtggatgagcaattacaacctgttccagcggggagtgaaggcgaattgttgattagtgggccgtcaatgtccaagggttacctgaacaatccagaaaagacggctaaggcttttgtcacgctgaatggtcatcaggtgtatcggtcaggtgacttaggggtgcaattgcctaatggcttgatcatgtaccgtggccggacagattttcaaattaaacttcacggttaccgcatcgagttagaggaagttaaccactacctgtcacaagaggaccacattcaagtaggggttgccgttccacggtatgatcgcaaccacaaggtcagccaactgattgcttgggtggtgccaaatgcgcaaacgtttagcagtgaattggctttaaccaaggcgattaaggacaatttacagggcggcgatatgatggaatatatgattccacaacgctttgtttacaaggatagcttaccgatgacccccaacggcaaggttgatattaaatctattattgcagaggttaatcagtaatgctgtcatttgaaccatacggcaacccaacttatttcgccttgttgggtgtggcactattgccgttgatgattggtctcttgtacggtaagcggtcgcggctatatgagacactcatttcgatcttcttcttagtcctgacctttggtggtccgaagtggacccaaggagttgccctgattgtttacgtcttatatgaagtggctttgacctgggggtacgccgtttatcgtaaacagaagaactctggaccggttttctacctgttggtcattttggctattatcccgttgacgctggtaaaagttacgccggcggttgagaatggtcagggatcattgattggatttatggggattagctacctgacatttcgggcagttcaaacgattatggagactcgcgatggtagcttaaagaactaccaggttatgaccttcctacagtttatgctgttctttccaacaatttcttctgggccgattgatcgttatcgacggtttgaacacgattatcgaactgtaccagatcgagaaaagtatttgggcatggtccaaaagggaattcgttacattttcgtgggcttcttgtataagtttattatcgcgtattacttgggaaccctgttgatgcccaaactgttactcatggcaatgcattcacgaggcggcttcttggatttatcgtggccagtcttgggatacatgtacgcgtggagtgcggatctatactttgattttgccggatactcactgtttgctgtcggtacctcgtatatcatggggattgaaacaccgatgaacttcaaacagccatggcgttcgccaaacatcaaggatttctggaatcggtggcacattacgctatcattttggttccgagactttatctacatgcgcttagtcttttggttcatgaagcataaggtgttcaagagtccaacgacgacggcaaatgttacgtatattattaacatgttggtcatgggtttttggcacggtgtaacgtggtactacattgcctacgggctgttccatgggtgtgccttagttattaacgatgcctggttacggtacaagaagaaacatcgggagagtatcccgcataattggttgacgcaaggatttgccatctttttgacggctaacctggtctgctttagtttcttactcttttccgggttatttaacacattgtggtttaagtaaaaattagagaaacatatttcagagggggatatatattatggatatcaaagcaagtgttttagcaattttaaacgatttaacggggaacgatgttagtggtgctatggatgacaatttatttgacagtgggctattagactcaatggggtccgtgcaactgttgttgcaattacaaagcgaattagggattgatgtgccagtttctgaatttgagcggtcagagtgggacacgcccaacaagattatcgcgaaagtcgaaagtctggcctagccgatgaccaagcgactactacggatctttggtccgttaattctcgcggcgattttagtttttgcggtgttggcaatgccgatgaagttaggttttagccatgtgagtgctgagcgtgaacgtcaagcagcagtttcattgtcgccaaacgtcttgcgtggtaagcatattaagcaggaagccttaaaagacggttatgtgccgttctttggctcatcagaatggtctcgaattgacccgatgcatccgtctgtgttggccaagaagtatcatcgatcttaccgaccgttcttgttaggggctcgtggttcgcagtcattaacccaatactttgtgatgcaaaacattcaaaacgaactacgaaataaaaaggcggtctttgtgatctcgccacaatggttcgtcaaggatgggacgcgaaaggatgcctttgggttctactattcacagttgcagacgactgaatggttgacgcatttccgacgggatgccattgaccggtacgcggctaagcgcttgttacaaatgccagtggctaagtcagatcactttatctatgcagccttgcaacgggttgcggctggtaaaaagctgacggacttccaacgcttctatttgcaaacccgtaaaaatatgttgacgcaagaggatcaattcttctctggcatcgatttaccgtcgcagaatctaaatcgggtgaaccaacaagccaagcagttacccactcattattcatactcggcgttggattcacttggtggacgattaggaaaagcggctactaatgataatcacttccagattagtaataagttctatcatcagggactggaaaaggaactgaagacggggcacttgaagaacttccagaaacatttgtcctatacagaatcacctgaatttgcggattttcaattatgtttggatcagtttgcccgactcaatacaaacgtgttatttatcattccaccagtcaatgcgcggtggcaaaagtacacgggcttgtcggcgacgatgctcaaacaatttgaccaaaagattcattaccagttacagtcacaagggttcaacaatattgttgacttgagtgataaggggaacgtcccgtactttatgacggatacaattcacctaggctggcgtgggtggttagcagtcgatcagcgggttaacccgttcttatcgaaacagcaaccacaaccgcattacacgatgaatgacaagttttattcaacaacctggcaacagttaccaccaagtcagttagcacaatatcaacaaacgaataagtaactaactagccgctacgccaccactatctgatgacgtagcggttttgcgtatggtcaaatggacgccagattttaggtaaatggcgctagtcaaaggattagggacacacatgggtatcaaaaaaatagaaatcttggtataattgtcgagacatggcgtttaagaaagtaggaaatcaacatggatcttgaaaaattaaaaaaccaccaaaaatacatccggaatttttccatcgtggcgcatattgaccatgggaaatcgacattagcggatcggattttggaattaacagatacaatctccaaacgcgatatgcaagatcaagtgttggacgatatggacctcgaacgtgaacgcggaatcacgattaagctcaatgcggttgagttgacgtatcacgctaaggatggacatgattacgaatttcatttaatcgacacaccggggcacgtggacttttcttatgaagtgtcacggagcctagcagcttgtgagggtgcggtattagtcgttgatgcagcgcaaggggttgaagcccaaacgttggctaacgtctatttagcgcttgacgatgacttggaaattgtgccggttatcaacaaaattgatttacccgcggccgatccggataaggtgaagaatgaaattgaagaggtgatcggcttagatgcctccgatgcagttttagcgagtgccaaacagggaattgggattccagaacttttggaacagattgtgacgaagattccagcacctgcgggcgatttagcggcaccattgaaggcgttagtatttgattctgtttatgatgattatcgaggagtagtgttaagcatccggctgtttgaaggaacggtcaaacccggagataagattcggctaatgaatagtggtagtgagtatgaagtcacagaggtgggcgttaactcacctaagccaattgcgcgagactacctaattgccggggatgttggttatatcacggctagtatcaaggacattacggatacacgagttggggatacggtgacgagtgcggatcagcccgcggataaggcactccctgggtaccgggaaatgagtcccatggtatatgctggtctgtatcctactgacaatgcgaagctcaatgatttgcgtgaagcattggaaaagttacagttaaatgatgcagcattagagtttgagcctgagtcatcacaggcgttaggttttggcttccggtgtgggttcttggggatgctccatatggacgttatccaagaacgactggaacgggaatttaatttagacctgattaccacggcaccgtcggtaacataccatgcctacctaaccgatgggacgatgaaagaggttgaaaaccccgctgaaatgccagaggcgtccgcgattaaacgaattgaagagccaatcgtcaaggcgacaatcatggcaccgaatgactatgttggtgcggtgatggatctgtgccaacaccgacggggacaattcttgacgatggagtacctggatgattatcgggtgaatattatctataacatgccactgtcggaaatcatttttgatttctttgataaactgaaatccaatacgcgggggtatgcgtcattggattatgaaatgaacgggtatcaaggcgctgatttggtcaagatcgatatcctgttgaatggtgacaaggtggacgcattgagcttcattgcgcaccggacgttcgcaccagcacggggccgagagattgcttcacggttaaagaagatcattcctcgacaaaactttgaaattccagttcaagcagccattggggctaagattattgcccggacgacgattaaggcttatcgtaaggacgtaacggctcatctgtatggtggggatcgtacgcggcgaatgaagctgctggaaaaacaaaaagctggtaagaaacgaatgaaggcagtcgggaaagtggatattccgcaagaagcgttcatggccgttttacaaactgacgaagacgaaactaagtaataccggcgtttctggggcgttaggatttacaaaaatgtgcaattgtctacgatttgtcggcgcaatttttatgatgtcgacaaatgccctaatatcggggttcgtgatgtcgacaaattaggattgtttttcatcactagatttctgcttgacgtcggccatcacgccttcaaaaatgtcgactgattttttattcatctcatcggtaacgtgggcataggtatctagtgtcgtcgatattctagcgtgacctaaacgtttttgaatcgatttgatattgtctccattttgcaaaagcatagttgcgtgagtgtgacgcaacgaatgaaagtcaaacgggaaacctaactctttttgaattttatcagcgtggtatttgatagaattcggggtgacaggtttcccgttttctttcgtacatacaaaatcagaatcatagtagtatttcccatagcgcgcccgctgaacttcttggtcggcgcgttttttctttagcagctcggtaacagaaggcccaatcgaaatttttcgatagcttgcggatgttttaagtggacctaaatcccagggagcgttggaagaccgttcatgatctggctttattgtcggatcggagtattttactttcgtcttgtattcagcatcggcctttcgttttttcttggtcttttgaagcatagcttggtggatgtcgatggttccattctctagatcaaccgcactccattctagcccgctaacctcaccgcggcgcatgcccgtgccaaaggctagttgaagtggaacgttaaaggggttggaaaatggggtgattgcgagtatctggcgatactgttcgagtgtgataattcgcaaatctgaccgtgttttaccatgggattcggggaaacggggcatgccaatgtagttgcccgggttttctttaatcagctggtaagggaagactgccatctttagtcccttgcgaagaacggtcaaaataatttcaactgaatgttttgacaatcctgttttccctaaatcatccatcatcttttgcaatttggcgggactaattgattttaacttgtatctgccaattgccggatcgatgtacttatcaatcacattccgataattgctctgtgtatttgggcgaagctctttcattacatagctatcaaaccagtagtcgaagtagtcatgaatggtataattattccttcttattttgactcctccattttcgtactcctgcattgccgcacgaagggcagccgatgcttctgctttggtgcgaccaccgggatgttcgatacgttttcgcgatccatcgatactaccagcctcaaaagaatagtaccatttatctccacgtttccttagtgatccttctgacataataattcctccttgtatatcaataattgaaatacacaaacgtatgttctttcgacgacaaaaaagaaaatccctttagggacttcttgtattgctatggaccttgttggactcgaaccaacgaccgcacggctagccgtctgctctaaccaactgagctaaaggtccaatgaaccctgcgagaattgaactcgcaacctacagtttaggaaactgttgctctatcctgttgagctaaaggtccagcaagctcgtattttagcacaagtttgcaattgtaattctggtttcaaattaattgaaagataaaaatgttttttaagaattattcgttcaattgagaaagctttaccttatcaaatgaattaatttttgttattggactagcaaacatatattctaaggacttaccacgacgtttattgtttgcggaataattcaaataatattcaaagcgttttgtggctgttttataattttcatttatttgcgatgctgtatcataggttgtgatccatttataattagttaacgctaagatttcttttgctaagtttacatgaccactctcattgaatgaagaatagtaaagattttttccttgtgcaaaatagggaggatcaaagaaaatgaaactatcttggggatccacggtttcccttatctttggaatcatatcgagcgcattaagacgagtcaactttatacggtgatgaacagaatgtataaaattaattttatcaataagagttttcttattgaacctgacgtatatctgtgttttatttttctgatggattcctcccaatggaccagcggttattattccgctagtatttgttcggttaagaaacaaagtagaaaatgctaatttgattgaatgttgatggtttttattctccaaatacacttgtttctgccttttccaaaaagaaatgctgaaatccgcacttatttcatggcccgaatagtagtcaaaggggacagattgtattagcgaaataagctcatcggggttgtttaaaatgttgtcccaaacagaatagattgctttatcataatcattaatccatacttgatttatctgatcatttacaagtagcttgattggaattcccgcacctccagcaaatggttctatataaatgttatgaatagaattagacaataatagatttaaaataaaatcatatagttgagttttaccgccagggtatctaaaaggagaatttgtttttggcattatacagcctccttatgtgtttacataataacatctgaaaatctatttggtcaccactaaagcaatttagaatttaagtattgactagttttcttgtaagctaattttaattcattagagaatctgtttagttcctttttttcattatgatgtgcaaaccaaaaactcattacctttgttttctcgacaaaggtaaacatttcttctagagtatccgaaaacttccgatcctttaataccttattgtctatggtaccatttagtaaccattctctttgtatatattgacgacttatgctacttattttatcggcctgacgccaaaataaacgagtctcctgattactgacatttacataataatatataagataataaatataagcttccggcgcaaatggtgttggtaagcgaactatattagcataatcttttctattaccaggttctggaagaggtgagttgcccttaatatatttatcttcattaaaggttgtattgtcgtcatacaaagcatcaccatccagaactaatatggagtgctgaaaattatcatcaacttgtggtagccatcttaaaattgattttcctaaatgcccagcaatttcgttaacttgattttctggataatcggtaggatctgtggtatttaaaattatagcggcatcgagtataattttgaaaaatcttaaagtgatttcgtcttcaaagtagaccttaactttaggagttataacagaattttcaagatacatgtcggccttgacggaataataatcattgtgctcagtaataatggggtgaactcggtctttcaagtatatgatcttatagtcgttaggatttccttttttttggagattcgttagctctttaattgcagtaagcgaatgggttgttaaaaatatttgaatatttaaatcactagataattcatctagtagattcaataattctatttgtgcagcggggtgtaatgaaatgtcaaattcgtctatacaaagaataccaccttggtaggcatcttgttttttgataaaatcgaagccaatcaatgacgtaataatatgggtcaatgagtcttgaccgacactaatagagtctggactggtattggagatatgttcatctattgatccagtatttgaattttttgtatattctttgtcaatattagtcattttaggggtatcctcaaggatagactcattcaaaacactgttataccagttcttataatttatgttttcatctccttttatgagtaaagaacgattagaaatagatttttttttcaaggttagttcaccccgtggtactaatctagatatacttaagtactgtgtcgctaatttaattctggcctcatatgtaatatcaaagtgcgttttggcgaattcatttgcttcatctttagatgggaaaatatttttgagatttgcatcaattggtgatgtggtcgggattacgcgaacaccacgattttgattagtatcgtttttaaaacgaagcgcttttgttattctattgtgagaagtggtttcttcgtatgtagaaaggacctcataagtgttgaatgactcgtcggaatttatatggaaataattataaaattcgggttggaaattaatatttacattttgtagtccagaaaatgtgctttttgaaattccagtggcagaagctataagagacaatatattagattttcctgcaccattttggcctgaaataagattaatcttgtcaccaaaatctaaagtagcttcttcaatatttctaaattttttaatgtacattttttttaatttaaagcccatttgaatacctcctaatgtaattaaaacattttaaaatatattaacaaacaaacaatcaccacatgcgttaatattagagaataattattcggattggatcttcatacttttataagtgaacaaaatccccggaatcgaaccgaggggagtcaccagacagaagctgttaatatcgtgtaaaccatttagaactgttcgttcgtgcataatatagttttgatccgtggccgtttactttcaagaaatagccgtcctttcccatatgatagaagggcgcaacatggatagtttttccataatgtaattttagatgatgacccaggtgactagttgcatagctatcacctcggatgaatttatatacggtaatgttgcgagtgacatacgcacgtttatagtgactggcatttgctgaggtactgataaacatggttaaagcaattgctgaaacgagggtgatccagatttttttcataatttcctcccgatagatgtatttgattaatctaaactagtagctcgtgaaccatcctttaaaacggttactaccagtttcataatgcttgttgtttacgtatttgcgaccatatactttccaattcgtataggttccattttttatgtggataatttggccacggtgaagcttaaaactacgaacgcgatgagatggcgtatacatggtacccttagtgtactgatagattcggatagattttgtaacaatggcacggtgcttatgcagccagtatccgatgtcagtagggccgtgttctccgtaagtattggctgatgcagtctggggaacatatacagcagtcgctagtaatagtgtcgcgacttcaagcgagatgcatttgatgattttcatgttttcctcctgaaatatgtacagcttttaacgtcaacgggtgtggacaataggataattgaatagatacttgataaggctttaaaatctatttctgaaagggtgagcctcaggagaatcttgtggattagcatgtttccaatgtccgccaaattttttaccaataggcgcattttctttaaggcaggtgaagcgttcgccctgttcattttcaataataaaaatgcggttgaactcattccgagtctctacaattttgcagttctcatgtttaacattgaagacatcaacgaaatccatattaagacctcccatatcagttggacataaattatacccatacgaattggacgaaaataatagaccagtgataataattgtcgacattgactacaacattttttgaaattatgcttattcctgaaatctaatcgaagggagttaccaggcagaagctacgtcttaggcatataacaatccagttacacaaatttatcatgaaaaggatgtgcatcaggagagtcactaggcttggcatgtttccaatgatcgtgaattttggaagagcgaggtgcatcatctttcaaacaggtaaaacgtactccctgttcgttttcaataataaacacacgtttgaagtcgttctgagtttgaatgatcttgcagtcgtcatgcataacattaaatacatcagtaaaaaacatttaattacctccataatgcaaaagttagtgttttgaccgtatgtgaaaaacgtaaaaggacacaattatgataactaatacaatcagagcaataactggtaagtggtcgattagatcatttatcaattgaaaaacatctttctttaacgttaaagccatctcctcagatagttacctaaatagaccttgttggactcgaaccaacgaccgcacggctagccgtctgctctaaccaactgagctaaaggtccaaatgcttctcctcggaatcgaaccgaggggagtcaccagacagaagctgattattttgttagtaacaccagtgacacttcttatagccatgtttttttgcccagtgcagtgtaacgtgtttcttatgtttagctgcatttaagccgcggcaatgtttcgaatgatgccatttagtgccataatttggagcaatccaaacgtatgtagtttttgcgtgagcaacagtagtattgggaataactggcgctgcaccacccataaacagggtgaaagtcaaagcaattatcgtaatgcctctcttaatagttttcatgatatcctcctgtaaaaatatttgatcagctttttaggtcttcgggtgtggaccaatcaagcctattatctattggacaaagtcttcgataatatctgactcaagtgttttgccgtttaatttgacggttttagtaagtccaccgcctaaaatagtgatattactgccctctgaaatatggtgagagtgcatgtcttcaacttcaacttcggcgacggtagcatctgtgttgtcactattacttagaacgatatagtccatggtattattgtcagaatttcgctgaatatatgtgacggttccggttaccttaatcagtttttgatcatatttatctgggttatcagtgaaactttcaagacttacacgtttatatttagacctatagctcgatttagttgacgaattttcattttgttttttcactgattcatcaagtgaagcagatactgaactatcaatgcttgcggatattgaagatgattttgagtcgctgtcagtgtcagcagttttagagctaggggtattgtgtgtcgtaagatagctcataaccctcaactggtgtttattactttttatcccgtcttttttggcatatacgacatatcttcccggaacaagtgcatcttcatagaaagtgccatcgctgccagctttgatcttctcaacatcattatgcttgttttctggaacaaaaatgacactggctccttttacagtcttaccctcagcgtggtttatatcataaattctattttttttgagccgcaagctaacgtttgtgacctttttattgtcctttatgttattgccgcttttagcagaactttgacatccagatagtaaaattgatcctatcacaaagggtccaattattttaattattcccatgctttcctcccggtatatgtacagcttttagcgtcatcagttttggacacattatattttttccagatttgtaagtatatcaggcaggcttacctaatcaaaatcgtagggtaggccatattggcgtgctaagtctttgtacgaagacggcatacgatcgttatcttcaataaatagtaaacccatcaatgcggccgaaaactcgtctgcctcagtttcaagctgaccgtgtgccttgttgctacttgtatagtagccgaccagaccttcctgaagaatggcatgacccagttcgtggcccataacaaagtattgggtaggggtatgtctaattgttgtattgagcataacaacaggctggtcaccatcatagacagttttgcctagtggataatggccaaacaagcaccattcgacttgaatattaagtctttctgcaattgtaaagggattggcggtgtggtatcgattcattactgttttcgcaacgttacttatcttttccaaacaatcagcccctagtcgtgcttatggcgcttccagaaaatcgttgtcatcgccacacgtacttgttctttttcttcttctgtgaggtcctcaccgccataagtcatggacccctcgttatcagttaggaatttttctaagtcatttgtatcctttttattagcccacacaggagtactatttttaccgaggagataatccgtggtgacttcaaaaatgtctgcgaacttagcaagttcagaattggttatgtttcgattcccatgttctatcttgttcattgttaccttgttgaaccccatcttatctgcgaggtctttttgggtccaattgtgcgattctcgtaagtcaataattctagaaattaattctttatccatgattggcctcactttcgttactgtattgacaactatatgatagcacggttacttttttggaaacaaaaagtttctaaaaaagtaacgattcttcttgacattactaaattagtaacttaatatatagtcatagttaatacatcagtaaccgaaagggggatgaagaatgattgagcttgatttgcgtctaataaaaagtcgtcgaattgaattgaaattgacccagcaagatatggctgattacctagacatgggaagtaaggctaactactctcgatacgaaagcggaaagtatgcgttcgatgctaatacaattccgatgcttcataaagtgttgggaattccgatcacaaagctatttactcaaaaagttactgattcagaaactattgcttctactgaggaggtgagctgatgaagaataaaaaatccccaaggactggtgcaaacagtacccggggaaaatatacaaaccgtcttaagcgactaacgaagatgtaccacaaagcaagcagtgttcaagaacgattgctgatactttctctgattacttactatcaggatcaattagattatcagtaactgcattctctaggtacttctcaaagtcgcttagcagttgtccctgcttggacttttcggtaatgtgatgatctttgaagtaccgaacacttgcttttaacatcacgagacggaactgaacttcttctttagatgcaattttcccagccatagtttcacccctttagtgataattatctcactagaggagtgattaaggttgaatttttcaaagaacaggaggtgtcaaaatgacacgacaagaaaaatcgacactatcaaggacacgctaggtcttactgatggtcagctaaaagctatgcttgctgctgacgaattgccgggggagcaagacaaaagattaaatcgtctgttcaaagacgctggcaaggttctcaatcaacaggcaggtttgaatgaagaagatttagaattttcattctaattaaattatgtactacaagtgcttgtagtacatcagtcgaaacacaaggaggcagttgtaatggatgtgataaaaacatctcgtgacatccgtacatttttcgataatgcaatgaagcgtaataacgtttcagccaagcttatggcagaagataccggacaaacggcccaaggcattgccaataatcgtcacacggtagatacgacggcagctaatgcggttaaggacgcgacttacttacaagactaccggtttagtaatcagctagccgcagcctactttgaagccattcagatgtttgatacggaagattggtcgcctaagttcagagatgcaccgtttgcgacgttggacgccatcgacgatcaacgtgcgacggttatagagctgcggcggcaagtcaaaatatttatgcgagaccgaccacgtgaaaaatggactcatgatcaatgcaagaaggcggagcagtatagctacgagcgaatcaagctgatcagtatggagttactttttaatggtcaatttgaagacgtgtcccgtcaggacatgctaaagattgtccatgaaaccaacaagcataacaagttagggggattcaaatggttaaaacagtagtgctcaagcgcacggttgatgcagatgtttacacaattccacaggcggccaagaaactaaagatttctccgaacaaggtccgggcactgattggattggggaagctgaattgcttacagctgggacagttatcaatcccgaagtttgaggttgatcgattcatgcatgacaacttgtcagtcgatcttcgaccagcaattgatgagtggattgaagaaaaccgtaatcgaaagagtgtaacggtataggaggcaatcaaaatggatttgttttattactatgtcggcgagtgtgtgtcatggttcggattgatttctggggcaatgtttctaggattcaagcttgcagagagcgtccacgacatgggcggttggaaagcatgggcaatggatttcttcggattggaggacaaaaaatgacattttggcataaaaaaagagctctgagtagcagctcagaactcaaagataaattacatttatcctatttctataaccttaattctactccagatgggcggtggttgcaatggcgatgaacgtgccagatcatgcaacattcgattttgtccggtacatgaatcggctggaatcacagcctgaaacgggattcatgaccaaagataccaatggcaaccccatgatttctggtgaaacttattgggaagcagaaggccgatatgtgccgaccgatgaagcttcaatgcacgactttttagatgctgagggcgaggattacggagcccagattgattgggactatgaccatctggcagctatcttggaagattttaaaggcgcggaggcgatctcatggacgtagtcaaggtacacacaagtagtcgtttccagcctaaagcagtggttgctactaatttagctgaactagatgacattaaatctgatctgttcaaggaagttcaattgttggccgagaatgatcgacttagcaatgatgagattgatcggctatacagcatcagcgacgagcttgttgcttggtcacccaatttggaggaggaagaataaatggctacaaacgaagttgcagaaacccaacgttcactagacgcgggtgttcagaaccaaattaatcaaatgatgaatcaggagaatggcttgaagctgccagccaactatgctgttggaaatgccctcaagtccgcattcttcgcgctaaagggaaataacgatggggacttgattcaagtggctactcacatgcctgaaatgaagacttcaatcgccaatgccctcatggatatggtggttcagggattaacaccggccaagacccaagtgtacttcatcagatatggcaatcaggttaaaatgcaacgttcctactttggaacgcaggcggcgctaaagcgactatctgaggtacacgactgctgggcaaatgtggttcatgaaggtgacgggctggaaatcggtgcccaaaatgatcgtttggtcgtaagggattggaagccgacgttggagggactcgataaggaaattaagtacgtttatgccgtcattgagatggctgacggaactcaccagcatactatcatgaccttcaagcaaatcaaaaatagctggtcacagacacggtctaaaggggctgtgcagaacaagttcagtgacgagatggctaaacgaacggttcttaaccgggccgctaagaacattttaaatacttctgatgattcagatttggtcgttggagccatcaataacactacttccaacgagtatgacgaggatcaaacagccaaagatgtgacgcctaagaaggttactgatttgatcggtaatgcggacacagaggaaccaacgcctcctgaacccgttgaacaagcagaaacagatgaaccagcagaacaagaagaaccggttgatacaaatacggacgaaagtagctctgacgatattcgctccattgaaaatatgaagccgggtgataagcaagacaaggacactgtcaacaatattttggatggccttgaagaatctgaaaatcataagggggatggtgacgatgcaagcagcaccgaagaaggacagggtgaactcttcccaccagacgttcattctaaattctgacaattattacagccaggaagccaataaaaacttcatgagtccaacttggtttaagaagttcgttgcctgtgaggcagaggcattagctgaattgagaggtgagtgggcacccgatgaggataagaccgctttattagttggtaatgacctgcacagctatttcgagtcgtcggaggcccacgaacggttcttagatgccaacaaggaagtgatgttatccagtcgtggtaagactaaaggccagctaaagagtgagtacaagcaggccgacatcatgattgactcgctcaaaaacgacaagacgttcacgcagttatatcaaggtgaaaaggaatcaatcgttactggcgtaatttctggcgttaaatggatgggcaaattggactgtttgaacttagatcgtgggtatttcatcgatctaaagacaacacaggaactgtctaagcggttttgggatagccgtacccgtcagtgggtaccattcgttctgaaatatgactaccagcttcaaatggctgtctatcgcgagctagtcaagcagcaatacggaatcgagtgtgaaccctacattgttgcagtaacaaagcaaagtccgccggataaggcggttatcacgattcctcatgagtatatggaggatgccttgcaacgaatagacgagcaactgccccattttgaggatgtcattgctggtgtacaggcccctgttccatgtggtagctgtgcttattgccgtgaacataagcagttgaaaaacatcatcagcgttgatgacttactagatagttagggggtgctggtttgaatttgtttgttgagctaaaagcgttccgcaattttctcgaaactaatcccttgaaacccaatgctcaagttttgtggttccatcttatgatgatcgctaacgagagcggttggaaaaaggaattgtccatacctaattcggtactaatggctcgaacgggcatagcgtccaaaaacacccttatcagtaatcgcaacattttgattcaggccaagcgaatttcttataaatcacgaggccgtactagggcaggaatttatgtcatcacaccttttgatgaaacttctagtcctaaaggtgaaccagtttcttcaccaagtaatacctctagtcctataaatgaactagaaacaggactaagttcttcaccagtttcttcaccaagttcttcaccagaaacttcaccttatctagacatagactcagacgtagacaaagacaagactagttcattaggttctagtagggatggacttaatcaatttaagtcaacgcgcacgtacgtgagtcattggccgaccccgaacaaggatatgacctctcagcttaaactctaccggcaagaagtgggagatgatctattgacccacagccttgaatatcttgctaagaataacgttagcccggctggtgtgcctaaatatcttgaaaaagtgattaattgctgggtgaaaaacgatattacgacagtctctgatgccttgaactatgagaaaaacagaaccaccgttccatcaggagacggtgacgttcctgatataccgatttttaaactaacagattaggaggctacaacatgaaaaatttacaagaattaattatgggcagtgatagcgatagcgttgcagttgatgctcgaggattgcatgactttttggaggttgggaaagacttctcaacttggtttaaaggcatgactgattacgggtttgtcgaaggtaaggacttttccccactttcggggaaaagccgtggtggtcggcctcgcattgaatatgcaatggctttggacatggcgaaagaggtgtcaatgattcagagaacaccaaagggcaagcaggcccgcgagtactttatttcgatggagaagcgagccaagcaagccgaactggtcatgacgccagaacagaaaattgacttgttgattgagactgggagccgtgccaatcatcggctagaccacgttgaggaacgcatggacgacttcgaggagaatcgccgactagagactggcgactatacgacagtcagccgtggcgtatctagggcagtcaatttctacgttcgtgaccgtcatctgcagttgaccaaggagcaacggtcggcactgtataaagatatcaatggcggactaaatcaagtttgtggcgtccgtgcacgaatccagattaaggccaaggacttcgacaaagctatgaagtacatcgatgactggcggccaagcactgctaccaaaatgttgattcagcagacagaattgccattggcaggtgtcgccggtgattgagttagtcgtatatggtgaaccagtaccagcagcgcggccacgttttaatcgtagcggacatgcgtatgatccgttgaaaagtcgggcgtataagcagtatgtgtcattggaagctagtaaacagtatcaaggtgatctaattggcaaaaaaccattgtcggtacacatcgccatttatcggccaatacaggacagtgtcagtaacattgaacatgctagacgggcccagaacgttcatcggccaatagttaaaccagacacgtccaattacgtcaagctcattgaagacgcgctcacaggcgttatctggaaagatgacaactgcattgttgatttaacagccagcaagtactactcagacgatccacgtatcgaagtcacagttacggaggcgtgaacaaagaggccaaataattgaaaatagcctcattattaatactttattggccccagattctcgtgcgatgagccaattacgagctaaagctgatagaaaggtttagggtcgaaggtacactcttaggtgaataatggaaagaggattgactaaaatggcgagaaattcaaaactaatggacttaattaacgacgctgaagataattatggaaagccaagtaattggcctgaaaaggttactgagaagattaatacgaaggctaatcgaattaatgattacgaacatacaccagcaaatgaggtattacgtcatttgatttgtcatgggtatacaaatactcaaattacgttagataaacaaaaatcttctggatacattcaaagtttacgcaaacagatgaaaaataatggtgaactgcactttcaagccacaccagatgaattgacacagctgaaatacaccgtcaaacacataaataggcctaacaaccaaggaattgctagggttatgggtcgtgacaaggattgggttcgctgcatgcgaaagaagctacgagagacagccagtgaaacgcggcgatgaacgtgtcacaagcgttgagcagtacgtgcagaaggcaaaatcggtagatgtggcactcaaccatgttgtttatgagcatggacgggaattagaaaaacaggtggatgaagagtgaaatggggggagttggttctcgcggtcattggcatattggagtttgtggatagagctgatgactcatggatagatcaccgaattgcctcatttatcttggacatgctggtagtgattttattgcttgcatggatcgtgataattctggtgattaaattcttttagacaacaaaaaagcactgaggaggaatcccccagtgcaaccaagtttaatttatttgcttgataaattacttcttggtttgtgccaatgcactggccgctaccgctttggtagctttaccgtaacgcccgtctctcaaaatgcgtgatgccttgctagctacagattttgaggtttgacggctgttagaacgaccctttgccatgcatttcaccacctttaaagtggattacagcatgtatgcattgaacataagttcccacaacatgttgtgtatcatataataccataagttttttgaatacacaatacattgtggattaattttagggggttacaagtttgtggaagaaagtagaaccaattttgaaaaaacgcggtatcactccacaccggctttcgttgatgatgggggacaaaaatgattccaacgtatacgcattgaaaaatggaaaaattaagcgtccgagcttcgatttgattcttcgaattgccaaagcgttggatgttagcttagatgtttttaggtaaacaaaaaagggccgcccggcagcagcccttacccaaattatgcttactcaatggtcaacaactaattatagcataaccaaggggtggctcgctttgattaacggaatttttaaaaagtatgatgaggaagcaacattagaaaatgtactggcagaattgaaggaatatcgagggctgcttatagagcggcaacgcttgcgattagtctctttatcggcccaatcgtatgacggaatatcgagtggcccgactaacgttaaccacgaagagaataagatgattaaacgattgaccaagttagaagaggttgaaatgcatatcaatttggtcaagaagtctatcgagttgatggcagaagtagacgatgattctgagcggttagccgcgattcttgattttcgatatctgaaaggatatggagtcactaaaacctgttacaaatacgctgataaatttggattacctgatttcccacggcagacatttaacgatcacctacgagaagccttgctgacttttgccgagatttatccgcgagaattgcgcgtagaaaaaaatccgtcataatccgtcacttttcgtacaatatccgtcgttttccgtacagaatccgtcgcaatccgtacttttaagcgtaaaaaggggtgtaaattagtagtatcgaaagatgtagggaggccaccccgcctcatctaacacgtatagcttagctggaaaagcagtggccttctaaaccaccgacgaccaccgacgcgggttcgaatcccgctgcgtgcattggcgagcatcgcaaaatgggaggcgattacctccatttttaaacgcacgttctaactcgccaaattttcttcctagcatggtctacggtgactgtggccatgcaatatggacctttaactcagctggttagagtagacggctcataaccgttcggtcgtaggttcgaatcctacaaggtccatcgggcgcaataacttaaaggagatgagctctcccgttcatccaaggctatagcgtccatcacgtgcttgtggcggaataggtagacgcacgggcgatagataaaggattggaataaggtagcggtaaatggcgacacataaatggatccgagtagctaccatccttcaaaagcaaacggatagtaattcgtcctgtggagttagtacgatatgtgaccatatccgtgtctaagctgtttgcaacaaatcatgtagggtgcgaatccctaccaagcacattggtcagcaaccaaggtattgcgcaataccaaaatgcgagttctatatgctaaactaaaagtgtaagtcgacgggtgattgaaacatggctagaaagaattccccatcagtggggaaaagtccatgtcaggaggctcattaccgcgtgtggttcgattccacaccaatcacattggccctaaacaaatcttgcttaacgctgggccaaaaaactaatcgaaaagaggtgaagactcctctcggttgagaagtctagcctgcatcgattgggtgatttcgtagagactcagtttggacgactgagtcttttttgtacataaatttggtggttaggcttatgtctagccgttttggagatctgtcagatggtttgtgtggatttatgtgaggaccagaagtggttattgaaataaattaaaaaatggttgtccttattacataggagtgactactcccacgaattaatacttttaatagcgttttcaccaagatgcatggtgaaaatgtaattttcattacgagtatctgtaaaaagaatacttaaaaagcaatcagtataattatgagagctttttttagctattttggaatatagatcagaaaacgaaattgaaatctcaggagttatttcgtgtggttgaagaaaataatattgtttaaagttattggcatacaccaatcgagatcttcttgcttaatttacgtcattaaattcgttcaagttatttcttgcaatctgccgaaattaaaaaaatcaaacaaatcttccaaaatttataagggtaatgcaacatcattagcgaaacttagctgggctgaattacggtaactccggtgaagcactctccaaaatctgaaattggttcaatttcttcatttactttatcagtagtagtattgtctaaatcttccaaagagattacgaattcaatcttagggccatcagcgttaagttcagatacatgatccatggtcagttcgttgttactcataagaattcctcctcaaataaaagatagttgaattaaccagaagtttgttctgattgacgtgtatgataaacacagagtattctcttgtcaacaaaaaagttaaaatatttcagctaatctctttatcattgacctcgaggtgaagcataatgtcattggaattatatggttttactgtacgaaagttggctaagaaattttccgaattaggctaccgtattgactacgacaataactggattttctttattaaagaatctacttttaatttgagcaaccagggatggaaaattcacgtttcttcgacggcaactgaatttttggaatctttagatgccgttacatctgttgtccgaaaatacgacgcttcgtttaaaatccctcgtacatggcatgctatgctttctttgacaactggagcagttcccctagtaactactggaaaaatgattactatttatcctaagcaaaaatcggacatagaattggagacaattgtaaacgaactgtatagaacacagaataataaattatttccgccaatatttacagactatcagtacaaagatagcaatatttttctgcgatatggatcatttatcgaacagtatgtgctagatgataaacaggaaccacttttagcattgtttgatgaatcaaatgttttaattccagacaagcgtgtctttggtgctcatacaccgagttttgtaaaggttccacgtttcataatacatgatacgaattactttccaaaaaggactacaatgcagtttccgttaacgcaaccacgtttgttacaaagatcagcgaagggaaacatatataaagttctaactccaaaaggtcctgcactattgaaacaaggatacaatggtagcttggctgtacgtgggaatgatacagctgccaatcgagttttaaatgagacaaatattcttcataacattcctgattatgttcataagcccagagtactgggaatctccacaaccagtgactctgtatttatgttagaaagctttatgccaggagtatcattggagaatatatttactagttcagtattaattaaaacaatgttggatactatgattataaagattgccaaaaacttgatgaatcaaatattggaggttcatcgcgccggcgttgttatcagagatttgtcgcctagtaacgtcttagtaaatgaatatggccaagttttcttagttgattttgaaataggatcttttatcacaagtcctatatcttttatgggatctaccccaggttttttcccatcatttcttccattaacgacctcaagaaattccttttgctttgattggtattcttttggcgcaattttattttacctaggcacaagtatcaaacctatctttcccgaatcccgatccaaacttacaaaaaaagccttctttgataagctgtatagtattaatgagcttactctgaatggtcataattgttactctatagcttgcttaggaataagtataatggaaaatttctatgaggttaatgataatacgatcacaacattttttagagaggcccttcaatcttcaaacgaggaaagaagcacgaaaatttccccagctattttcaaaatatcagaaattgtttctagaaccttatcgaagaaaaatactttttcttctgaagatattcgaagggggcctaaagaagaattactactgttatccttagataaggggatgctgggaacacttttactaaaggcactttatttagataaaaatgataatacaaacattctaagtgattttagaagggatatagcattcattaatcgaaatattgacgacagtaattcgatcaatcttgtcaatggtataagttctctagtatacattttgtctatttcaaaagaatttgacaaggctcagtgtcatatgtactttaacctgcagataaagatcttaaatataattaggagaaaagtaagtcatgtagtctataacggggttttgtacggactagcaggtattgggctatcattatttcttgcttgggataaagattgtgatctcttcattaaggaacagataaaagaaataaatgagttaatctccgatctattactgagaaggatgattacacgcgataaaagaatgcatattggaattaaaggagtgacacgtgaagattcgaaggttgtaagtgactttggatttggagaaataggagttgcaagttttttagccttgataaactcttcgcacaatcaagagttacgaacaaaagcaattaagagtagtcttgagaatctttatgagaatcgaattgttgagggatctagtggcattaaagttgctcagacaacaggttcgttgaagtactatccctttctgttttccggaatcagtggcattcttatatttttggaacttgttagaagtcatgggtgtggtgtagaagttgatgaaagctttagagaacgagtatttcagtccgttattaaaaacacctaccataattcgccctttcttttaaatggcgatgctggggtactgatttctttaatgattgcaaaaaaggattcagtaattgaacagaaaaggcttgtagccttgttactgtcagaatccaatctaacaagtacagggaaaaggtattggtcgttaccaggcaagtttacgctcactaagaattttttctagagggaaatattggcatattgtgcgtgcttcagttatttgaaaatatgtcgatttccagccggaaggagaaattaaaatgattacatggagatacggcaataaagcagcctttatgcttctagtaagtctagatttattagtttctatccagaatgtctttttagcctttgtcactagttcgttcattaagtcagcaactgataagaatatgactctcttttttagagtagcgtatctctctgttattggattcatcattatttccatcataaattggtttcacatttccttaaagaacaagataatccggcaaacgaatttaagaataaagcacatctttaccaaaaacatcattgatggaattaatagagttgattctgctaatgggatagcgactatgacgggtgatttaaaaatgctagaaacaaacggcatttccaatgaactactgatgatcgagcaggcatttacagttgtcgctgctgttattggcggaatatattttaatttcttaacgacttttatattcgtgctgggaagtttaattccggttctaatatccaggttttcccaatctggtatacagaggtcttctcaaaactggtcaaggaataacacaacgtacacacagtttttgaaagatatattctctggaagtgataccattagactgtatttagccaagcgcgaggcgcttaacagagcggataaatctgccgaaagtttggaatatgcgctaaatagaatgaataacacaacaggccatgctaacgtctatacaactctagcagctttgatttttggagtaacaattccctttgggtttgggatatatcagacgattacaggcgtgctaaccttagccgcatttatgggcattgtccaaatttccaatagcattagcaatccacttataagcatgatttcagaaggaaacgtcattcaaacaacacgtagcatcaaaaatagattggatgaattacccatcactgaatcagggcgggtagtcttaattaatgacaaacgcaaagcttttaaatcattagcgctcaaagaggttagcatacagattaatcaaaaaacaatattgaatgatatttcattggacctaacttcaggtgaaaagatactaataaaggcaccatctggatttgggaaaacaacgctattaagagcactaattggcgatgtatcggtacattcaggagaataccgattgaatgatctttctgttagtcaaataagcaaagtcgaattgaaacaatattttggattcgttcaccagaacccctttatttttaacgatacgattatttttaatattacactcggacagcgtttctcgcaggaattgattgaagaagtcgtacacgaagctaaactgacgacgcttgtaacacaaaagggtcttgactacattgtcggagaaaatggcgccaatatttccggtggtcaagcccagcgaatagaaattgctagggcactgataaggaaacgtcccgttttgctagctgacgaagtaactagtgccttagatgaaaagacaagtttaagtattcacgatttattacttgggggggcctattctctcattgaagtcgcccatcatattgatagcgatacagcgaaaagatttgataaatgtatcgacttgagtcagatttagttaaagattttaaaggctaaagactcaatgtaagtcgccacggatcagaatttaacgtatttgcaaatatcggctgagatctctgtattgttatgtgtgatgaggaagcgtaaaacacgtaaataatcgtttaatcaaggtcagaatctggaagttatccgccttaccggttagctctaaagtggcttagtggttcacatgggatgccgttgtgcgttggtgaatcatgttttgttgtttaagtgggataatgctggctaaaataggccgccatcgtttgtaaatgatgaacgagacttagacgtttaacgacgccgagacccggaaaatgttgttgttcgtgataagctgctagttgctttgccgccggtgtttgaacggctgttggctgttgcggtagccaagcggcgagtttcgcaacagcctgaaagaatttttccttggggtggctaaaatcagtgcggtcgtcagacacaaaccgatggatacgtagttgttcaccggcaaagtaagtgagatgtaaggtgacggctttagcgggatagccatgttcactataatagtgaccgccaatggtgtagtcactgaccccttgataggccaaaagatccgcgagaacccagtcatcactgaagaagccatcaacgaggttcgcgtaggtttggtcatgatcgggtaaccacgcatgatcgaagaggctgatactcgaccgggatactaactgacgtacgcgagcctcgggcggaaccagcagataggtgggggattccagccacccagcatgttgcacggcgactagttcatcatagtggtgtgcgataagcaaggttggttgatcaggactaggcgtgacatcgtcaggaagggttgtgggcgtgagaatatgtccgacaatcaagtggggatcattggcccactcatgccagtcgtggagcttttgttgggttaaggcatagtcgctaacggtcgggttggcgatgacaacgagcggatggttagctgccatgaaagccgcaacggtttgcggcaatgcccgaatatctcggacaggctcaatgatgggaataatattaggcggtaggcagcgttgttcagcaatgtctttgagggcgagtaaatcgtactgacggccgcgaaaataaggaaaatacatcatgagcgctgactccttaactgttcaagtaactggtggtgttctagattaagggcgtctaattcgtcttgcagggcggttactgctgttgtttgggtgtccgcaataaactggtcataaaaattggcttctggatcatagacgtcatagtgttgatggcgttttttgagttcctgatacaagcgttcagtactgaacgttttgagcccagttgccatctgcttggccttgtggacttctcgagcttgtgctgcaatgaaccgggtggtgagttgactagctggtactgacagttcgcgacgacgtggtggccgcataacggttagatagcccggtgccgtgggtgtttcagtcgcagtcgctagcaattctttggtaaacggccgatagatcagcacaccgatccccgcgggaatttcagtggcaacagcttgatacagctttaagggcaagacgaagtaattatagtggccaacaaaggagagtttggctttagaatgaaagtcgcttttggtcactttcagttcgtaacagcgccactcgatatcgccgctaggtagttcttgataactgagggtgtcgacaataccagcatcgttaggcatggtgacctcttcgacggccatcgtaccagcctcacgacagtaatcgtaaagggtacgttctaaagccagcgttagtttggttttcattcagatagggcctcctggtgccagaaatcatggatagcagagcttaattgttcaggacgatagagccgctggaagtgctgccagtgacttggataaagctgggtgtagcggggactcgcaaagcgttgatccataagtaagataacgccgacgtcgtgtgatccacgaatcagtcgtccagcagcttgaaagacgttattgagtcccggaagttgataagcaaaggcaaagccctgatgtgagcgttcatcaaagtaatcacgcaagaggttggtttccggattgatgccgggaaggccaacactgacgatgccgacgccgattagccggtcagcttttagatcgatcccttcggaaaaaatgccccccagtaaagcaaagcccaccagtgtggttgtcgggttggccgtaaagctagcgagaaaacgactgcgatctgcttcggccatttgagcttgctgacaaacggtttgaatttgggggtaggccaattgaaaggcttggctgacagtgaggagatagctgtaagatggcaaaaagatgaggtagttgcctgtcttgccatcgaccaatgttttgatcgctaatagaatgttagccaaattggcatcgcgtttattgtaggtggtttgaatatagttcgtgacaagaattgcttgattggtcggcttaaatggtgatcgtaattgataggccagactatcctggtcaccacccagaacggtttggtaataatcaagtggtgataaggtcgctgaaaacaagacggcaccgtgtcctagagccagactatcagctaaaaaagcactggggtctagacagagctgttttaaggtgatttgaccgtcatcaatggttaggcgcatgcggtaggtgtcatcataataatcggcaatccgttgatagctaatggccatgaagtagtagtcgagaatggcttgcgtgaacggtgtctgtggttggtccactaaccagtcgtggacggcttcaactagccgtcccagatcgtgttcaaaattttcgggtggggtcatgaaagtactgtcggtttggccggcgtcaattaagggcgcacaaatatcgtcaaatgttgcccgtaagtcctgcaaccggcgacgaagcttaggcgtagcctgatcagtatcacgactgagggtgatgagatgatctaagggatgactactcatcgcagcggagtacatgtcacgtgatcgactgaccaagttgtgggcttcgtcaattaagaagaaattatcgggatctctagtggcaaagaaccgttgcaaatgaacttggggatcgaacaagtagttgtagtccccaatgataacatcacagaacagactggcatcgagctgaaattcaaaggggtctaaggtatgtttgcgggcgacttgctcaataaccggtcgtgttagttggtcatgatgttccaataaatcgagcaatgccggctttaaacggtcataataacccagcatgtaggggttatcttcgggtgctaggtctgcttcttcgggaaacttgattttatccttggcggtgagcgtaatacttttcagtttgaggccctgagaagccataagtgtaatagcttcttcggccacccgccgcgtactttgtttggcagttaaataaaaaatccgttggatcaggccttcgccgattgctttaatggtggggaaaagcgtggagatggtttttcccgtgccagttggggcttcggcaaagagccgtttactagtaacgatggttttgtagacagcgacggctagttcgcgctgcccgggacggtagtgatcgaagggaaaggtgagttgtcgaatggtcgggtcgcggcgttcttgtagatcggcacgaaattttaaccaagtgacgtactcagcaatgacttcgtcaaagaaggtcttagcagcttctttggtgaggacctgttctgtttgtgttgtggtctccgtgttggtttgaaaataagttaacgtcaaggtcacttgttttagcgctgggaacttttgcattaagaggtgggcatagagctttacttgggcccagtacaaggtcaacgtattgtccttaagttggtcaaagaccgtttcggatgttttaatttcttcgatggtggcgtgcgtgtcgcttaaagtaacgccatctgcgcgaccatgaaggagatagtcttgattgttgagggtcaagggcagctcaagatagtattctttttgatagttactgtctcgctgcttttgtagtcgtcgatgaatccgggcccctagttgagccgtattttgactgccagatgtggcactgagatcgccggtacgtagagtaaattcgactaactcacggaccccaagtttaattgtcataagccactaacgcctccatattatggcaatatcataccatatttcattaggagattgaacgcgtgttcgaagttagccaattttggcaaagtggttgttagggattggcaaagcttgtgtaatcgcttacaatgaagccagaggtgatttagatgaagacgattggtattcccttatatggtacaaccccgaagattgatgagacaaatgcactgcagcagatctgtcaacgctatacgggaacggctaagattgttgtgcgtgatactgaactgaatccgcagttggcggccgaggttgcccaattaggtgagcacgggggcgactttatccgaatcgtggctgacggcccagatgaggcgcaattggtagcagccattcaccaacaacttgtgaaagataagtattgttattagctgcttgacgcttttcaactagttcgctatgctcgacttaatgagaaactagtggggaggcgcaacgtagatgaatgaagagcaggttgcccgattgtgcgctatcgcgccgaaatatgggttaacgttagcgcatgacggcctgattattactaagattaaccaacaatcgacaacctttgatacgagcaaatatatgccggatcagtttgttgatttgttggccaaaattattgcaactcaaatgaaagccgatttgtggcagtggcaataaatagtgaaacgaaaaagacgtgagggctgccctcacgtcttttttgtgtttgtctgttaagcttcttcccaccgatcgaagtctttggcatgttgggcgaggtacgttattgcttcgtgagccaatgcttcactagcagcagtgaagtcatggggggtatccgcctcatcagcatccgcttcatcacgtaaaaagccggcggcaacatcgagatatttggtgcgacgaccaacgccatcgtcttttaataaggtgtctaatcccgttaaatcgggttgggcagccgcgactacttgttgggcgagatcaggttgagcccccaatttagctgccgcataatccatcagaaagtcattcatatcaacaataattgcgtggcgagccgcgcgttcattcttctttgccataattagtcactccttagtttcattctagccactttcggcaaatgacgcaattaatcgaccgaccgtttataaaataatcgtgtttggagattaactaactagggatcaatccgtattttgccattttggtaacatttaccgaaaatttacacgaatgcgacgaagaatacatattcatcccttagaatcgggattgtaagttaaggggaagcaccacgagcctagcacttagcttacattgtggtggttcaactattttaaaagacatggagtgacagagatgaataagggatcaaagttagcaatggggattgcagcaattagtttgttattagtaggttgtgggaaagctacgagctccacgagtagtaagagtagcagtgcagcactctcggggaaagttaccgcagtggggtcgaccgctttacaaccactagcagctaaagcggggtcgaactttatgactaagaacggcaaagttaatctgacagtccaggggggcggctcaggtacgggattgagccaagtgcaatctggcgcggtatcaatcggtaactctgatatcttcgctgaggaaaaagacggtatcaaggccgacaagctaacggatcataaggtcgctgttgtggggatggcacctgtcgtgaacaaagatacgggtgttaagaacttgaagatggcgcagttaaagcagatcttcatggggaagattactaactggaaagaagtcggtggtaagaaccaaaagattgtcatcatcaaccgcgcgcaaggtagtggcacccgggcaacttttgaaaatgctgtcttgaagggcgctaccgccgttaaatcccaagaacaagattctaacggagccgttcaaaagattgtggcaacgacaccaggcgccattagctaccttgctttttcatacttcaccaacaagctacaagccgtttcgattgataacgtgacgccaacggacaacaatgttgaaacgaacaaatggaaagtttggtcatacgaacacatgtataccaagggaacaccggacaaagcaaccgccgcattcttgtcttacatgaattccaagacggtgcaaaatggcttagttaaagacatgggttacattagtattcatgacatgaaagtaactaagaacgccaagggtgttgttacccaaaactaattttctagtaggcaacgggtggaggtgcaattagcgcatcttcactttttttaaaggggggtcaacctgatggaacaaacacattcacaattacgtaaaccagatgcccagcctaacgaatgggctgtgcgcttacaccatgccacccgggcaactcgggaagattggttggggaaagccattagttacttatgtattggcgtgattattttggtggtggcgtcaatgctctggttcattacatctaaggggattgcaacgttcacgcaaaatcacgtcagcttaggcaagtttttaacgggaacgaactgggcgcctgaccaaggtcaaatcggcgcgctgcccatgattgtcggctcgtttgcggtgacctttgccgccgcactcgtggcgacaccgtttgcagtaggaaccgccatttttatgactgaaatttcaccaaatcgaggacgaaaattattgcaaccagtcattgagctgttggtggggattccctccgtcgtttatggcttcattggcttagcggtggtagtgccctttatgcgccatttagtcagcggttcaggatttgggattatctcagcgactttcgtcttattcgtcatggtcttaccaaccattacgtcgatgaccgttgatagtttacggtcagtaccgcgctattacaaggaagcgtcactggcactgggagcgacccgctggcaaactgtttcgcgggtaattctccggtcagcgacaccaggaatcttaacggcggtgatttttggaatggcgcgggcttttggggaagccttggccgttcaaatggtcattggtaatgcagccatcatgcctaagaatttaatttcaccggcgtctacactgaccagtcagttgacttctggaattggcgatacgattgatggaaccttacctaacaacgccttatggtcgttagcacttattttattactgatgtcattggtctttaatgcattagttcggatcattgctaaaagggggcagttaaagcatgaacgctaaacggaaagactttctggctacgattatgattaatttgattgtagcggttgtcgttgggattttggtcttcctattggcctatatcttgatttctggcttgccacacgttagttggtcattcttaactggaacgacagatgcgtttagtggtgctggcggaattggggtccaactgtttaattccttttatctattggtcttaaccatggttatttctatccccatttcattaggagccggaatctatctggccgagtatgcgaaagataattggcgaacgagtctgattcggtcagccattgaagtgttaagctcgttgccttcagttgtcgtcgggctgtttggctttctgctattcgttgtgcaattcaagattggtttctcagtgatttcaggggcgattgcgttgacctttttcaatctaccattgctcacccgaaacattgaagagtcgttgagtgcggtgtctcgtagtcaacgtgaggccgggctttcactaggattatctaagtggaagactgagattgggattattttaccagtagcactaccgggaattgttactggtgtggtattgagtgccggccgggtctttggtgaagccgcggctttgatttatacagcggggcaaagtgcacccgttacgaattttgcggattggaatccaatggatgcagctagtccattgaatccattacgaccagccgaaacgttagccgtccatatctggaaggtgaacacagaaggtttagccagcaatgccgcacagttatcggcagcagcctcagcagtactgattattgcggtactgatctttaatctgggggcgcgggtgctgggaacgtatctatatcggcgtgtgacggctagcaataagtaggaggggacggcaatgttaaaacagtattcatttgaaaaaacggcggttcaatcctttgcggccaacacaccgttagcattacgaaccgaagatttacaggtgttctatggtgccaaccatgccatgcacgacgcggatctggcttttcctaaaaatcagattacggcattgattggggcttctggttcggggaagtcaacttatttacggtcactgaatcggatgaacgatggaattgcgacggtcactggaaagatttggtaccatggcgttgatatcaacgaaccagatgtgaacatttatgagatacggcgacacattgggatggtcttccagcggccgaacccgtttgctaagtcaattcgtgagaacattgtgtatgcactacgggccaacgggattaagcgtaaggccgaattgaatgagcgggttgaacaaagcttgcgtggggccgctttgtgggatgaggttaaggataatctggacaagagtgccctgtcgctatctggtgggcagcaacagcggttgtgtatcgcccgctcgattgcgatggcgccggatgttttactcctagatgaaccgtgtagcgcgttagatccgatttcaaccgttaaagttgaagagacactattagagttgcagaaaaaatactcgattgtgattgtgacgcacaacatgcagcaagcatcgcgaattagtagccagtgtgcgttcttccacttgggacacgtcatggaatacgcaccgacgacaacgatgtttagtaatccacagattccagtaacacaggattacgtggctggaagttttggttagtcaaaaaggctgtgggcagcgcccacagcctttttcgtgtatttaatgatgcattttaaattcaagatagcgatcgttatataactcaaccttagtgggtgacagatcacgatagacttgtaggtgtcggagtgtttgctcgtcgggataaaattggcggtcattgcgaatggcccgtggtaagcgtgctttagcccgcttgttcggtgtcgcgtaaccaatataggtcgcgttttgggcggcattatccggttggctcataaagtttaagaatgcgtagatggccttagtgtgttgggccgtcttgggaataactagattgtcaaaccacaaattgctgccttcacgtgggaccacgtagtgtaaatgtgaattaccggccagcatttcggctgcttcaccggaccagtcgacggccagtggtgcttcatcttgaatcatgtacattttaatttcatcggcgacaatggctttgacgttaggtgataattgatccaattttttttgagccgctagcaatgtttgtggattggtcgagttcatggactttcccagtgtgactagagccatccccatgatatcgcgtgctgaatcaattaacataatttgttttttccacttgggtgaccacaaatcttgccagtgttgcacctcgctagccttgacgtacttatcattgtagataatgcctaatgtgccccagaagtaggggatggagtaacggttaccgcggtcaaatgactgatttaaaaagcgttgatcgtagtttgcccacccggtgagtttcgacttatccaatggtcgaagaagatgagcgcgtttcatcttagcaaccatgtattcactagggacggccagatcataatgcgtgccgccctgttgaatcttagtgtacattgcttcgttactatcaaaggtttcgacattgacgtggtagccagtttccttttggaactttgtcagtaggctgggatcaatgtagtcgccccaattataaagattaagcaccttacttccagtgctcccactagagcgttccaacgactgactcgaataggcgagcagaccacaaatggcgattagggcaattgctaaactgagtagtcgtttcatgagatcgccccccgtttacgttgtttgcgcttttgactgacctgctgcatccagtaataaccaccgacaagtagcagagaaaagagaaacataacgcccgataaggcattgatttccaagttaatgccttgacgggcacgggaatagatttcaactgatagggtggaaaagccattgcccgtgacaaagaaggtcacggcaaaatcatctagtgaataagttagtgccataaagaatccggcaaaaattccgggagaaataaagggaatgatgacctgtgaaagtaattggcgggtcgttgcgccaaggtcctgagcggcatcaagcatcgaggcggacatttctctgagacgcggcaagaccattaggacaacaatgggaatttcaaaggcgatatggcttagcagtaccgacccaaaccccaatggaatcttaagcatcgtgaagaagattaagaaactagccccaataataacatcgggagagaccatgaggacgttgttgagggtcagtagagattcacgagtaacccgtttggtggtgcggttgatccccagggcgcccagcgttccaattaacgtcgcaattagcgaggagagcagagcgactagtaaggtgttggcaacaattgctagcattcgggaatcgctaaataacgtttgatagtgtcgccacgtaaagccgtgatagttggtcatggtatcgccttggctaaaggagtaggcgattaagaagacgatgggggcatacaaaatggcaaagaccacgatgaggtaaagtcgggtgaatttttgtttcatcggggagcgccccctttcggcttctgatcaccagttattgtcatgacgataatcatggcaataattaagacgaccccaatcgttgagcccattccccagttcatcgtggttagaaaatgttcttcaatcgctgttccgagcgtaatgactttattgccgccgattaatcttgtcaacatgaaaagtgataaagagggaataaagacagcctgaacgccagctttgacccctggcagtgttaatggaaaaatcacacgtcggaaagtttgccagttgctggcgccgaggtcccgactggcgttgataaacgcggggttgaggtcatctaaggcattaaaaatgggcagaatcatgaacgggatctgaatgtaagttgccacaaagataaagctggcattggtaaacagaatctgttgcgggccaatgccgatgaaggttagaaattgattggctaatccagcttggctaaaaataccgataaacgcataggccttgagcaagatgttaatccaagtgggcaagataaccaataataaccagaattggcggtgttttaattgatggagaaaataggcagttggatagctaatgagaccagtaaatagggtaattagcagggcgtaccagactgaattcaccgtcattttaagataagtcgctgaagcaaaataagtgctgtaattggctagagtgaagtgatgacccagatcaaagaaagactggtaaatgattaacgcgactggcgcaatcacaaagagcgccagccacagatcgtaggggatgaaatacagccaggttttacgtttcgtcaaagcgatcatcctccgttccttcataagtctcaagtcgggcatcaaactcagcttccttttcaccaaagcgcatgacatggaggtcttgtggtcggaaggttaggccgatttggtcgccgtcttcggcgggattgactgaatgaatgagccaatcatttcctaggccatcggtagcggcaatttcatagtagtccccacggaaaagctgggtattgatggttaccgtcaacttggcgtgggccaagtccgtcagagttaagtcctctggtcgaatgacaatctcgacgggttcattgaccggaattccggcatccgcgcattcaaactgatggcctccaaaggcaacttgaaagtcatcaatcattttaccgggtaagatgttactctcaccaatgaagtctgccacaaagtgattgatgggttcgtcataaatatccactggcgagccactttggaggatttcgccctgattcatgacaaagatttcatcactcatcgcgagcgcttcctcttggtcgtgggtgacgaagagaaaggtaatacccagtcgttgctgaaggtcgcggagttcatattgcatttgccgccgcaatttagcatccagagcagacaggggttcgtcaagcaacagaacctgtggctgcatgacaatggctcgggcaatggcaattcgctgctgctggccgccagacagtgcactaatagtgcgatctccatagtcggccagttggacgagacggagtgcctgattaacccgttcggcaatctctgatttgggccgtttctgtaaggtgagtccaaaggccacattttcggcgacagtcatgtgcggaaagagggcgtagtcttgaaagaccgtattgacattgcgcttgttcgcaggtacatcattgattcgtttcccggcaaataaaatgtcaccggtggtcgcatcagtgaagccggcgatggtccgtagaatggtggttttaccacagcccgacggcccaagcaacgtataaaatttaccagattcgagcgttagattaatgttactcaaaatggtgttgtcagcataacgttttgtaacttgatgaagttcaatgattggttgagtcatcaggcgcctcctttagatgattaaatagtgtgggatgaaacgatgataaccctactgattatagcgggtttaccgggaaaaaggaacgaaaaaagatgctaaggatcgagataattaaggggcatggcaaacggcccaattatagaaaatcaagtagcgctaaagaaatagacaatgtgccggatacgtttagaaatcggaagagtaagaagagcgtatcaattaaaaatggacacggtcctggtatgagggccgcgtccatttttataataggtaatgatggttgagtgtagcctgctacaattcgagaaggttaatcttggtaaagaattgtttgccaccagtctggtagcaactgtggtattcaggaaaagcatcgtcaaccagcacaaaccgttcatcttttccgagaaaacggatgatgatatgccaattgaatactatagtcgatatacggttggtggccaagccttcagcacgttaattggtagcgttcatgactaggtggggtgaataatgccatataaaaggacgagaaaatccgattttctcgtcctttttactagtcagttaataacggcgatccaagacaaatgcgcgtccgtaatcttgcggtaggacttctcgaaaacctaatgacgcatagaaagcctgtgttcgtggttcagaatcagtgattagtacggtttgaccaatcgctgcatgttggtttaagaaacggtgaactagggtcgtaccaacttgttggcgctgtttagccggcatcaccagaatatcttgaatgtaaagaatggtgtgattatcagtgattccgcgaatcagcccgattaagtgaccttgttcggtcgcccagaggacagtcgaatggtcaaaggccgctaaggtattggctgggtgttgtagataagccgaccaaccgacacttcggtaaagtgctaggaggtcatcattcgttacttcggtgggacgtgattgcgtgtattttatcattttattttaacctttccttggcattaactcagcagaaaggatcaaaacgtttttttgtcatcagctatcatctctttgatgccctagtatacacgcgggttacagatgaaacaacaaaaaattaaaataagatgaggaaacgtgacggctattgtaagctaggatgatcgttgtgctttattccaatagaaatttcgtcgttagtgccaacaccgattgacgagcagcgccgtctaagccgtgactagcaccaggaatcaaatgtaagtcgctttgtgaataactagcatgataacgtttagtggcagtatcactgacaacttaatcattagtcccgtgaatcagacaaacgggaccggtgaatcgttgggccgtttcgtaaatcggtaaggcctgtgccgtacgcagatagaatccgccgagcacgtgggtggtatctaatggcagtttttccgggatatgatcgggatcgtaggcgaggccacgcgtttgaccagctaaagcgtcggttttaagcgtagctgctggtgctaacaataccagtcgatgaatccagtcaggatagtacccaacgagcatgcttgccactacgccgccctaagagtggcctagtaagtcaatgtgcttaggttctaatcggtggtgaaccgcggtgagcacggcttgggcatcggcgatttcgttgagaacggtcatatgcgcaaagtccccatcgctttgaccatgaccgttaaagtcaaaccgtacggtgctaatccccacggtttgtagccggttagccaattgatttaacaaggatgttggggcatagccgcgattcccagtaaacccatgcattaagatagcaatggtgccattaggctgagtagccggttcgtaaatgccagccaaagtgagaccgtcacgttggacgttaaactccatattcaagatcctttcttaattggacgagctgtatgaataggatcagcataaccgaagttagtctaaatgacatttattttatagttgaaaataccaaaaaacgccacccaatcttaacttaccgagtggcgtcttccagttctattctgctagtttatgcgttttacgatgccaattcaagtaggctgcggcccacacgatcagcagtagggcgaccagataatagcccacctgactgaattccaagtttcccagccatagccacatcccactggctttcttcatgaggctgacgcccacttggagcaattcaatattgccaatcataaaggcggcaatgaccgaaatcgcggtaacggtcaagttataatgtcgtttgcgttccggtgtggcaaatgcccactggtaagcaccagtcatcataacagagtccgtggtatccatgaggttcattccggcagcgaagagcagcggaaaggcagccacgccccaaccaaccgccgtttgcgcatggcctgccgagagggcaatcaaggcaatctccgtggccgtatcaaagccgaggccaaaaagaaagccaatcggatacatttgccagctatgattaatcaagcgaaggagtggcgctaaaattcgcgttaggaagccccgttgttgtaagagctcgtccgtggtggtagctgattgacgagttgttcgatacaagttgataaagattaacaagttcgcaaaagctaagattaacaaaaagctcccagataccaagccaccgattcgaccgcccagactttctaaaatcggtaggtgttgtttaactaaaggcatcgagatgctgacgactaagattaagagacacactaccgtggaatggcccagcgagaagtaaaagcccactcccgttgcgggttggcgctgattcaccagcttgcgaacggtattgtcaatggcggcaatgtgatcggcgtcaaaggcgtgacggaggcccagtgtgtaagccagtaagccgagtccccagaaagttggctgttggctagcggcgagccaaagacaaagaagcgcgatggcatgtagcaaaaaagagagaagatagtagggaagcgctgcggtaaagatcagctttttcattgaaagaaacgtcctttctaaaaataaaaagcaggttgcctgataaagccgggcgacctactttttcaaaaataacgagttagagcttattggaagacgccctgatagaggacggctgccgcaatcgcaccagcaattggcgcgacgattggcacccagctatacccaaattgggagctgcctttatgcgcaaatggccaaatggcgtggagtaaccgtgggccaatatctctggcggggttcaacgctggaccagttggccccccaaaggaaatgactaaacacatgactaagaagcctaagccgataaaatccgcccgtggatcaagtttatctgccgtcatactgatggcccccaacacaagtaaaaaggttccaataaattcgttaatgaacccatttaacttgctgtcagcggcatcaatcgtggaaaaggttcccaggatggcttctgcgtcggttgttttgtcgtagtaaggcttgtaagccaataccaaagtgagttgaccaatgatggcccccaagacttgtgccacgatgtagggcgctacttcgccccaagggaaattacccgtaacggccatagccagcgtcatggcaggattaatttgcgcacccgatacggtggcaaacattaaggcagggatcatgaccccaataccgtagccaaagccaattaagacccaaccaccgtgataacctttggtaccctttaactcaacgttagcgacggaaccgttacccaaggcaaccatgatagccgtcccaataaattctgcgatacaacgaaccaataaagaataatgcatgtaaattctaccccactaaaactttctctttttgtgctgccgaaagcgtttgattcatccgaccactggagaacccttgtaaatcaacagtaatataatcataccccaactggcgcaagttttcagaaactttttcattttgagcaactaattgtgaaagttggttaactgggacttcaatacgggcaatttgatcgtggacccgaacccgaacggtagcaaagcctaagctacgtaaataagtttcagcggccatgacgcgttggagcttttcactcgttaagtctgtgttgtatgggaagcgagaagaaacagagcaagaggctactttgttccaattagttagtcctaagctttgagccaattcgcgaacctcgcgtttatagaggtcggctgtttgaagtacggagacggcaccggcttcgtcacgtgcacgcagaccgggccggaagtcagcattatcatccataatcatgccatctaatacggcatcagcattgaattgggtcgctacttgtgtcatggcttggtagaacatctgcttcatggcgtaccaagattcaggggtgttgtgcttgatctgatcattagccaagtagtctaattgaataccggtaacttgtgcgcccatgcccttggctagttgaccagccatttcgtattctgcatctaagaagagttcggagttggcaacgactgcgaggacattatcgcggcctaaaacatctaaagcctctttcaaaacaacggtcgagtcaattccgccagagaaaccgactacgacccggttgtaagtttttaaggtattttgtaaagttgtttctttatcagctaaagtcatcataattgattatcctttctgttccatagtggtaagttcatttaaaatcttggcctgtaagtcagccatagtcagttgatgagtggttgccaattgtcgcaaatcatcatgttctaaggtacgcttggttgtgttatggtagcgcagatatttgacatgaatcggtccgtagctagtcgtgactaacttgatctggcgattcatgatggcacggtgaacgtggtggtaacgaattccgatcgctggggtggttgttagcagataggtcacaatggcggcttgttgttggggagtaatcaaacaacaaagtttgtaagccgggcgtccttttttcatgacaatgggttcactccaagcatcctttgcaccgcgatctaacagtcccgcaatcgtatcggctagttgttggccggtgatatcgtcaaggttagttgctaacagcgtgacgtgatcctgttcttgattgaccgtttgctggcttaactgggaatttaccagtgtggcccgtaacgcatttaggctgccagtctcacgtttaccaaaaccgtagccggtccgttcaataacgccgtcactggtcgtgtcaaaggccgtggcacagcatttgacaatggccatgccggtgggggtaatcagctccgtatgcgcatcgaaacgttgatgaatcggaatggcagttccaatccgcatctgcatgacagccggtactgggacgggaacggtgccgtgagcaatcttgatggtgccgctcccgtcagctagattattcacaatgacgcggtcaatgcccatcaattccaaggcgatcgccgcgccgaccatatcgacgatggaatcaatagcgcccacctcatgaaaatgaacgtcttctaaagacttatggtgaacgtggccttcagcaattgcgacctgctcaaacagcgcagtggcccgccgtttaacggcgggggttaatgtactttgcgcaatgagctgcttgattgttgcaaagctccggccgtgatggtgaccatgttctgtaatgccattgtctttaacctggtggtcgtctaagatgacatcgaagtcagtgccttgaatgcttgagcggctactaggggtgacggtcaaatggtaaccggtcactggtagtttcttcaattcggtttcaaagtctgtttgagataatccgagatcaaatagcgcccctaggaacatgtcaccactgatgcccgaaaaagcatctaacactaatgttttcatggccgctcctccttcacgagatggttaatcatactggcattgtaagccgcgccgaagccattatcgatgttaacaacactgataccagccgaacagctattgagcattgacaaaagtggtgtgagaccgttcagatgggtgccataaccgacactggttggcacggcaatcactggccgatcgactaggccaccgacgacactagttaaagcgccctccatgccggcgatgacgatcacaacgttggcttggcgaatgaggggtaatttggcaaataaccgatgaattccggctacgccaacatcatagacacgtgttacctggttgccgaaaagttctgcagtcacagcagcttcttcagccactcgcatgtcggaagtgccggccgtgacaatggcaatatttccgaccgcaggtaaggcgtgggcggttcggactaacgtctgtgaggtttggtcataggccaattcaggtagtatttcttggaccgccgctgacttttcaagatcgactcgtgtcacgaggatgggttgttggcgtttctccatagcttgaacaatgcccacaatctgttgcgcggttttgccagcgccatagatcacttcagggtaaccagttcgttgtgtccgcgccgtatcaatcttggcgtaggctaggtcatcaaacccggtatcgctgacctgtttggcagcttgctgcggtgtgagttggtggttagcaacttgttggagacaagttaataaatcagttgatgccattattattcatcctttacgattacgccaagaccatcgggaatgaccgtcactcgggccgcagttccttcacggttgaaggcgctggcgagtgcgtcatcgattgaggttgccagttccatatgcatgtttgtgatgagactgggttcaaccaagtcagaaaccacaatcacgtggtggttaaccaagatccgggccagaatttgtgaagtccattggtccggtaccgtttctaagcgcggtgtgttaatcgccttatccaagaattcttggggatcggcgacgtcagcaatgttgtggtaaaagccgtcaccaccatgaccatcacgacagccagctacgatgataatcgtcccgttttgcttattagtggcttcagcggccgtcatgcccttaactgcttgatagatattttgatcgagtggataaccaccattagtggtgatggcaatgtcgctcttaatggccttaacaccagctaactcaccaacaaaatccgttccctgtttatgagccgcttcaaggtcgccggcaaaggagccaatgatgtgcttgtcttcatccaaaaccacgttcaaaataaactgtaaacctgcttttctggcggcgtagaccatatcatggtgcaccatgttgtggtgaaggttcccggttcgagagtgcttgtcgttgataaactcaccggagtggttagccatgatcgtcttgtaagaagaaatacccggcaagacggacttgcgcccaccagagaacccagcgaaaaagtgggattcaatgaagccttcggagatcaatagatcggcttcttcggccaccttgttgataatgaggtcaccgccagaaggaagcttaccaattttcaccatgtcttcatcaacttgagatttatgcataacaatttcttcgttggccacaatctcttcgccatatttggcgattaattcggcatgcgttgaaggtcggtggaatccagttgctacgagaatgcgaatccgcgcctctggtgctactgagcgcaagcgccgaagtaagattggcgtgatgatgtgtgaaggaacgggccgggtgtgatcagagctgataatcacaatatttttctttcccgtagccaattcttctagggaaggactaccgatagggttgtctaacgactgttcaaccaagtctttttcagagaggctggcttgataggtcgctgctttggataccaaggtgccggctaggttggcatcgttgatgtgtgccgtaaccgatccgtggtcataagggagcttaatgtctgccataatctaatcaatcttctttctttcaaaggtacagttagcaatcataaacgtttcattttcgttttcattgacaatcctcactatgaaagtgaataatcggatatcaatagccagtgtcattaccaaatgttaaggcgaaggggtatcctttttcgctaagataggactttgctaacgataattaattttggaaggagtaccgcttttgccgaataaagatattgatgatctggtccgcttcttaaaggacaaacagatttcgacgattacgaagaagtatcacagttatttaaccttccacggtctgaaggccgctaatgtctttattttgaaagaaggcatcattaagacgtccgttatcttgcaagacggacgtgaatttaacatttcttatatcaaccaacctgacgttatttcactgttacatgacgaagctttgcaatatgatgagcaaccttttaacgtccgcattgaatcggagacggcgaccttttatcaggttaatcgggtagaattttggcagtacgtgaatgccaagtcagagttacagaactacgttaaacagtattatcgacaccgattatcagaaacctttgcccggattcaacgactcaccatgaacggtaagatgggggcactggctaatttcttacatgacattgctgagaagtttggtcgggatcttcccgatgaggccggcgtgttgattgactttaacgtgacgaatgaagatattgctgggttctgtggcattgctaatcaaaccagtgttagccgtatgatgcgtaaacttaagcttgaagatatcattgactttggcatgagcaatgatggcaaacgccgaattatcattaccaatatgaaaaaattagacgactacattgcctattaattttggtaaaaaaagctaccacaaccattcacgtcgattgacatggatggttacggtagccttttttgtgatgaaatgaacgattgatgattagtgcgtgaacccgtattttttaggttgcggatcactatggaaaacgatgtgtgcttggtcgagatcgtgaatggcttgggttagatcatcaataaagtcgtgggccatactcataccaaagtcagcccgaaccacgatccgttgaataacgcggtccgtcatgttttttggtaagggataggtgggaacctgccagcccttcattaataaccgatcggataaatcgtagagggtccattcgcgatcagaatcggcagtgagttcataacagatcagcggtaactcgtggccgtcattaatgagggaaaagccccctaatttagtgagcgatttcgcgagatagcgggcaacgtcgtgagttttttcttgaatttcacgatagccatcaaaaccaaagcgaataaagttgtaatactgaccgattaattgggaggcactgtgggagaagttgatggccatcgtaggtagttcaccacccaagtagctgaccttaaagaccagctcttttggtagatactgttggtcacgccagattacccagccgactccgggataaaccaagccatatttgtggccggaggcattgatggaaatcacgttgtttaaacggaagtcccacttgagctcgggttcaataaacggcgtgtaaaatccgccggaagcggcatcgacatggatatataccgggaacttagtcgtccgattgtaccgctctacaacggcatctaatcgggctaaatcgtcgtattgtccagtataagtgatgcccataatgccaacgataccaatggtgtagtcatccacgtaatctaacacgtgatcgacattcaaggacatgtggtcatcgtccatgggaacgacatgcatgtcgatgtcccaatagacacagaatttttcccaacaaacttgataaccggctgagatgacaatattaggttgatggacagttaagtcaagaccgttcgctttggcgcgcttacgccaagcaaacttcatcgccaaaccggccagcatgcaggcctcggaggaaccaatcgtcgaggtgccagtgaacgactcagcttctggagcatgccagaggttggcaatgatattaacgcaacgattttcaatttcagcggtccgaggatactcggatttatcgatggcgtttttctccagtgtatctttcatgagttcaaccgcttccggttccatgtaagtctgacagaacgtggcgagattcagccgcgagtttccttcatccaatagttgatcgcgaaccaatcgatcggcttcacggggctcgagcgcgtgctttgccaatttatatttggggaggtcgtggcgttcagcgctggccccgaagattggtttgagcgtctcatctgtttcatgcgtgtgttttccatacaacatagccatagtcagtcaccctttctttagagcgagtatagcatggttggcaatgggggtaaatcgattggcgattaattagtcaggcattaagctattaaaggatgatgcctttagcctgtaaattagagcggcagacttggaggtaggcgtcatcgtgttctggataaatgggggtagtcaaggggatcggagtaagatcggtgtacggtgcacagtgtttgccgcgataggtgggatcaaaccagtgatgatctggggtatagccgcgttcttgcatggtatgcaagacgagtaagtgaaattgatataatttgtagggagagtggtcgaagacgtaatcgacggtcgcgtgtttccggccccaaccattgccgcgcaatgctgcgagttcacggtgttgccccaatagttgttggcgcggtaattggggaattaagtattcatgccacagacgcatagtcggcctccttagagttcttgaatgagtcgagagtttaacaggtagtcaacttggtaggtgtgcgcaagttgtttcagaaagggccctaactggtcgttatcaggtgttaaagttgcaagtaattggagataggtggcccgttctgctggggtacagcgtttcttgaaatacccccagacatgttggtaggccgtggtcagcgtctgttttgtgggcgttaatgtgttagcagtcgcaagcaattgcgagaacgcctgttgtttatcggcgttccaagcgttatttttagctaaggctcggccttgattatatagatgctgtgatcgagccatcagccaatatttattgatcgcccaagtggtttgccaggttgtcaatggccgtcatctcctcagttaaatggctagttgtattaaatcatagttgggggaagttagcgactctgcaactgaagaaaagcccccaactggtgatatcaaaataaggacttccgaaccaattaatcggaagtccttgctagttttagttgcggttaatgccgatcaactttaatcgtagtttaaatgtttatcttgatctagaccgttaatttcagcaatttcatcagcggttaagctaaagccggagatttcgaagttttccttaacgcgagctggttttgaggacttaggaaaaacgacaaacccggtatcaatttgccaccgcaaaacaatttgtgccggtgacttaccgtacttttctgcgagcttagtaatcacgggatcttcgaggattaaatgaccgtgaccaattggtgagtacccctcgttaacgatatcgttatccgtatcaaattgacctaaatcagcctgaactttgtatgggtgacgttcgatttgattgaccataggtttgacggttgccatctcaaagacctgttttagttgatcttcagagaagttagagacaccgatagcgcgaactttcttttgttgatacagagtttctagcgcccgccacgtatctaaagttaactcgaagtcgtcttcatttggccagtgaatcaggtataagtccagatagtccaattgtaagtcgctaagtgtttggtcaaaagcggctagggtcttatcgtatccttgatcggcattccaaactttggaggtgataaacagatcagatcggtcaatcccagaggccttgattgcttcaccaacagctggttcattgccgtaaatgtgtgcgcaatcgagatgccggtagccggcatctaaggccgtctttattgctgctggaacgtccttgctgtcaattaagtaagtaccgaagcctaacattgggatggtaacgccgttgcttaattgtgtcgtttccatgtaattacctcgctctttcaatattttgaattccatgacataagttcatgatacaccagtgcgccgggagtttcatggatggtgcttcattgtgaagaggtggcgaatagttagggggagggtgtatagttttagttaagaagccctgcgtactaaataaggatattgaaagctaggggacgctgggcgtcactagcagataggaaggcgagcgatatgtataaaattatgacggattctgaatgcggattaccgaaggcctttttaaatcagcatgaggtgggggttgtcagatcttttgtgcagctggaagaccaccagtttggcgactatttttataatcaacagaatatggcggccttttacgacacgttaaagcgcggggagcatccgattacgtcacaagtcagcatcggcgagtacgtcgcggcttttgagaatattattgcacagcacacaccgattatctttatcggcatgtcgaaggggttaagtgggtcatttaatagtgccaatcaagctcgagatattctgttagaaaagtatccggatgctaagttaatgatagtggatactttggcagcttgtgctggggaaggtttattagtcattaaagccgtccaattgcgtcaggcggggatgtcactagacgaggcggtgacccagctcaatgcttgtcgcttgcaggtgcaccatttctttacggtggccaatcttaaattcttgtatcaaggcgggcgcctatctaagcgggatgccatcttgggtgatatgttgcatataaaacctattttagatgtggatgcccagggcaaactacgcgtgattaagaaagtcagaacgagttctcgggcggttaaaacattagccgatatgattctagcggatattcaggccgatgatcagacggttctaatctcaaccagtggggactgggaagccgccgagatggtccgaaagcaaattcagggggcctctcccaaacttaaactcatggtgacgccaattgggccaacaattgcgagtcatactggttatggttgcttaggcgtcttcactatgggaaagacaccgcggcaataggctcagataattctagtaatcaagatgagcttcggttagcctataaaaattgggctataataaatctatatttggtatatttaacgaatggagaaggcatagatgacgaaaaatgatgaaaaagccctagattttcatttatcgaatcaacatcatatgaagattccttgggaggcatttgtaaaagatgaacaggtcccagcgcgagaggcatccttgcaggatcgtgcctcaattgtgggaagaattggtattctcatgctctcatgtggaaccggtgcttggcgagttcgtgatgcgatggataaggtgtcgcggagtttaaatttaacgtgttccgccgatataggtctgatttcactatcctttacgtgttttagccggcaaggcagttattcgcaggtcttgtcgctacccaatacgggggttaatacagataaattaaatattttagaagaattagttgggaactttcaaaaagacttttcctttctaaccgtcgatgagatctatgagttgattgataagattgagagtcgaccgaaaaaatactcggcctttgtttctggcgcagctgcggcattggcctgtggcgcctttatttttctcttaggcgggggttggccggagatgatatgctcgtttgttggcgcaggcttgggtaacttcactcgggccaaaatgggcaaacaaaaaatcacgacactggccagtactgctgtgggggtcgccattgcttgtttaacgtacatggcgtgctttaggatcttagaggtggcttttcaagtttcggcccaacatgaagctggatatattggtgccatgctcttcgttattccaggctttccctttatcaccagcatgttggatatttctaagctagatatgcgctcagggctggagcggctagcttatgcgataacgattaccacggttgcgactttagtcggctggctcgttgcgttactcttcaattatcaccctgagaatttcattccgttgggattatcgccattattactgttattattacgattacccgctagcttttgtggggtatatggcttctcgttgatgtttaatagttcacagaaaatggcgattgttgccggctgtattggggcggttgctaacaccttgcgacttgaactggtacagttaacgacgatgccaccagccgcggcagctttctttggcgcgctgctagccggcctgattgcttcagtggtcaatcactacaatgggtttccccgaataaccttgacggtgccttcaattgtgattatggtgccaggattatatatctatcgcggtatctataatatcggcatcaacgaaattggaacgggagccttatggctaacgaaggccggattgattattatgtttttgccaattggcttgtttgtcgcacgtgctattttggatcgcgagtggcgccactttgattaagattggtatagcaaaagggcttatgctacttaaaggaatgtttttgatattcagtcaaagatatttccctgcactagaatattaatagcaaaaaaatagttcaatcatcaagggatgtctattataggcgtccctttttgtgaggaaaaagataaaataaaaactgctagccagaaagctaacagttcaatgccatcaccgctatttatttttgaacccaaagtaaaagtcattttatggccttgtgtgagaaaaataaaaaaattgatttgataggcttattctatgatatatcaccaatggaccctaccggatttgaaccgacgacctcctgcatgcgaagcaggcgctctcccaactgagctaagggcccaaaacttacccattaagtatagcactttactgctaaatgttaatgggtaaatcggcagcttactgatgccgaagtcgcttgagtaagtgttgccataaattttgactatccgtttgcagcatgagccgttgatattgacggcccacgtacaaggcaaagagaccgatcgtagccaataagatagtcagtgaaatgaattgttcgccccaattggccgtgttgttaataatccgcatgggcatgaaataggacgaaaagaaaggaatgtacgacagaatcttaaccgccaaggcgtccaagttattttgaaaagggaaggctgcaaagaaagctagcatactcagcataacgaccggttgggcagccttggaagcatcttctgctttggcgaccagtgcgccactataagcggcgagaatggtataaatcacaacgcctaagaacaagaagagcaggttgatattaaagaggttatggataacgccgttaatgagggcctggttatcggccaacagtggcttcaatgcggcattgttcacggcaatggaatagccggcccaaccacctagtaggtagatgccaatttgggtcaaaatcaccaacatgatcccagcaattttacccacaaaataactcgttgccgtggtgctggagaagatgatttccataatcttcgtacctttttcggaagcaatctcctgggccgtgatcgacgaataggtgataaggatgatgtagatcatggtaattaaaatccaaaaagagatggttcgagttaagttagtcgtgccagccttagtggcaatatgttgcttaaagacaggtgttcgagctaacaaacgttgttgcttggccgtcaatttggcatcttgatagttttgcgcctgttggtactgactgagaaagttttgtacttgagcttgtgtcccactggaaagagaattgttgccgtggtagtcggcgcgaatccgatcagtagtagtggaaagggtcaagtaacccgccaaatgattttcccgcatggctttttttgcctgcgttggttgggtgattttacggttgacgccagtggcatgctgcttcaagtaactctgacgtagggtagccgaatcactaatcacagcgatttgcttactgctggcagcgctatcggcactgacgtagctaatgcctaccgttagagcgatcatcaagaaggggctaattaccatgaagaaaaagctccaggatttaatttggcgtaagtaggtttcgagggtcacaatccatgtctttttcattgatcttcccccactttcaaacggaaaatttcatcaagggttggcggctgttggctaaattcttcaatataatgaccttgtgtcaaagcgtcaaagatggcggggccagcattagcgtcatctagatgtagaagatagtggttggcgtgtcgtgaagtgacctgtgtaacgtgtgggagtgttgctaaacgttcagaggtccagtccgtcgtgacatacagttcggtcttgccgaattggttacggacgtcttctagcgttccatgcaagacgatattgcccttacgtaacatcaccaattgatcacatagagccgtgacattttccatatcgtggctagagaaaataatcgctgcgccagcctgtttggcggtgagaatcgcctgttttaataaatcagcgttgacgggatctaacccactgaagggctcatccaagattagcagttgggggtgatggatcaaggtacagattaactgcaccttttgttgattccccttagacaggtctttaattttactacgccgggtacccttaacggcgaagcgggccaaccagtcatcaatctgtggccgaatgattttggcagattgacctttgagacgggccaagtaaagtatctgctgttcgatggtgagcttggtcatcagactgcgttcttcgggtagatagccaatttgatcgaagtcggtcgctgtgatggcgtgaccctgccactgaatctgtccctcgtagtgaatgaagtttaaaatgctgtgaaaggttgtggacttaccggcaccgttttgcccgatgaggcccaaaatttggccttgtgggacgtcaaatgaaatgtcatttagcgctttgacggggccaaaaaccttgctaatgtgctgaatgctaagcatcatgtacgctcccctataaattgatgactttattatacgcgaagcacgcgttgaagccaaaaaaatcgcgagttatcaaggcaaaggaacctgataactcgcggttggttgatgaatttaatttctattctgcgattgcgcgttactgttgacttgggcctgagctggtgaaatagcccgatgtggccgcatattgaagatgatgttcaagatcacagcggagaagctcccaataacaacgccattgtttaaaataatttggagcgattggggaaatgcttggaagatttgagggtaaacggtaacgcctagccctaaaccaatcgaaatggcggagaccaataagttattattatctttaaaatcgacttgttgaagcatccggatgccttgaacgccgaccattccaaacattacgatcatcgcgccacctaatacggggttgggaataacagtcgctaatgcgccaattttaggtaacatacccaataagatcagaaatgctgcggaaaagtacagtggtttacgagttttaacaccggatagttggacaaccccaacgttttcagaaaatgtcgaataggggaaggtgttaaatagcccgcctaagataacggcaataccttctgcccggtagccgcgcttcagatcattttcttctaactttttacccgtgatatcggccaaggcgaagaatacgccagttgattcgaccattgtcgtaagggataccagaatcatggtgagaattgatgaccattcaaacttgggtgtgccgaagtagaagaactgtggtaagtggaaccaactagcttgagcaacgggagccagtgagaccattcccatcccaccagcaatcaaggtaccgatcagaatacccgctaaaatagcgagggatttcatgaaccctttggcaaatgcatttagaccgagaatgatggccatggtcaaaaacccaattaacaggaatttgggatccccaaaatttttagccgtggcactcccaccaccgaggtcttgaaagcccacgggaattaaggtgaacccgataatggtgatgagcgaccccgtgactactggcggaaagaagttcttaatccgagaaaaccagccggcgctgagaaaaacaaagattccggcactaatgatggccccgtacatggccccgacaccatagttactaccgatggcttcgagcggggtaacagcctgaacagcacatcccaagacgacggggaggccgattccagtcagtggggtgcgtttcaattgtaggagcgttgcaatcccacacataaagatatccgcgctgattaagtaagccatttgcatggcattgaaatgtaaagcgcccccgatcagtaaggggactaagacgtcaccagaatacatggctagtaagtgttgaaaacctagaatggcggctttccaagtggaaagtgattgaccattttctgaagacgaagatgttgcggattttgtggactgcaagaaaagttcctccttctcgcgattgtccatacgccgcctaataggtttttttgaaaacaaaaaagctcccttgcaaaaagagagccactgaaaacttagaccgatgaacacttttcatcggcaaaaagagttcatctcaatttgcttatagtccagaatttacggtcctgggtagaaactcgccaaccttattatggcattatataggcaatcacttattttaattggttgaatgttccttactttaccacggcaaaatgaaaaaaacaacacgacaagtcattttttgaaacgatgccagagttttttgataccgtcactgaaccagctcaacaacggcccccaatcagctaaaccacccgaagaactatactttttgggatggacgtgtggccccgggtggtagtatggatcagtttcatcttttttcgccatttgatgatcatcctctccgaattctaacttaattttactgcaagtagggtacaatgtggataccaatatttttcgaaagaagttgacacgagtgaagaagattttagccatccacactggcggcacgatttccatgtcgcaaaatgacaagggggaagtggtccctaacgcgcagaatccaattgcccaacaagaaactattttggccggacgagtggagttgtttacggatgaaatgtttaacctgccttcaccccacatgacaccggttcaaatgttacaaattaagcaacgaattgatcaggccgaacgagacggaattgatggtgtcgtgattactcatgggacggatacgttagaagagactgcctacttcctagacctgacattacccagcaccattccagtcgtcgttactggcgcgatgcggtcctctaacgaagtaggatctgatggcttgtataatttccaatcggcgattgaagtagccgcagatgatgcctcacgagggaatggggcgatggtcgtgatgaatgatgagattcatacggcccgttatgtgaccaagacgcacacgaccaatgtggccactttccggacaccaacctttggtccaattgggattgttgctaaggatcatgcagcttacttccaaaagctcattcgccaagatacgtgtgatattgaccatgtagtcgatcacgtttacttgattaaagcgtacgcggggatggacggtagtttgtttgacttccttgataacgatgagacggctggtctagtcatcgaagggttaggcgccggtaatttaccaccccaaacgttaccggcaattcaacgactactcgaccgcaagattccaattgtcttagtctcacggtgttacaatggggtcgccgaggatatttacgattatcaaggcggcggtattgaactacgcaagatgggcttaacgctgtgtcaaggcctaaacggacaaaaggcccgcattaagctattagttggtttgagcgctggtttgcaaggtgacgcactccgtcagtttttaagcacagccgtttcttaagtaaaatggcaaccgacttgacgggctattttaggcaatatatggtaagattttcaaataaatagacaagggggtcgtcatgtgaattcaattgtgaatgatttaaaccgggccttggcccagcacctgctggtcaacgtttaccaaacgaatcaagaggtcgtttataccggctacgtgacgacagtcagtgacactgggattattctggcaacctatgatgattatgggattccagatggtgcggtgttcctggacttaaccgccattgatgaagttgagttttcaagtgatgatttagataatatggcctttcgaattcaaacggctcaagatgagcagtttgttcaagctggtgggttgaccctacaatttgacgggcaccgggacttgaaacggcaggtactcagtcatgcgtgggtggaccatctcgtgttgatgttggtgttgaaagatgacgaacacttttacgagggaatcgtgaccagcgttgccgccgaacaggtgagcttacagttgcttaacaagtttgactatacggatcaaccgttattaacgctgacgcccaaagacattgaggtcattgaatttcagggacaagagttgaccttgcaagggatcgcgttaccgcatctgcaaaagttaagtcacgttgcgccaacgacggttactgatgctgatcagtttgcgccaaccttgcaacagctagtcggtaaagaaccgttggtggccttggtaccaaagcataatcgcgagctattcttcgtaggacgaattaatacggtgaccgctgatggggtgatcatgaatctactagatatgaccggccaatttggcggctatacactgatgcgacttagcgagctacacgagattgttttgaagtctgattatttgcaaactatgcggttgtttgcgttactcaatcgtgcgcggcaacaaccgattcagccggtgcttaatgatgagcgactcttcgatgctacggttgaccagtttggtgcccgaattagccaggcagccgcctttcgcacgattattcgtttaaaactgcatgatggcacggatttgctcggtttcccaagccaggtaggtggtcaacgatttatcttccatgagattgatgaccagcaggtcgaccaagttggtcaagtttatcggttagccgatgtcgatgaggtggcctttggctacttggatgcgtatctggtagagcgccaattgcgagtagaaggcgatctgtaacgattacggaacgggagggttatctcccgttgcgctacataaggagtttttaggatgaaatggaaacaaattccgcgttggctacgcgatacaatttcagtcgttgtagcgatgtcggtgttattagtgatttacgatgcctttttcgctaagcacgttaattgggcgttagtgcccttacagattgtcgtcgcctttctagcggtgggcgtctggagttttttcagttaccggagtcagcaaaaacgtcaattggcggaggcacagaagaaagcggccgctgagaagcgtcaacaacagcgacaagaacaacaagcgttggcggctaaagaggcggcggttgctcgtcaacgcaatttggcgcgtaatcaggctcaccagcagcgccgtcacgagtagaggggaggcagttgaatggcagctgatttaaagttttgtccgcattgtggcgctccggtgacagctacagatgatagttgcccgaagtgtcagacggatctgcgtccctatcgaacgaatgatccagtggcgtcgtcacagaagctgaatctgggcgcgctatatgccaatccttaccgtgagggaatgaaacggttacgtaagcgagaagtgacgccggataagcccagaaagtggcattggccatggtccaaataaattaatggcaaaaaaagatccgtgtcagttaagttaagctgacgcggatcttttagctttaagttcaaaaagtaagctaactatggcttagttgtgatgaaactttgcaaagaacgctgttcatcgctagtcggttgtagttcgccagtcttaatagcatggaaccgttcgactgaaattcttgagccgaaagccatttcaccatctgttttatcgtatttcttttggtaggtgatgattgcttcggccaaatcggttaattcttgactcattcataacccctccaaatgataatcgtaatgactgcttaggttcattatactaaagtttggcaaaagcggcaggataagtctcaatatctggaaatttttttggattctacttgatgaacggcgcaaaattgcgtaaacttatacccaatacgatgtttcttaacatgctaatgggatgtgttactgatttgttagcggatttttgcatggccgtcacagtcttgcaacacttcttgattaagctagtcggtggatagtcatagacggcgactagtgaggtgacctgatgaacttaagacgaacaatctattggctcatcacggcagtggttgtgttggcacttgttagtgggctttcctggtttatgatgggaaagcggacaaccactcaagtaaggtcgcaaccagcaatggttgattcctcgcgtgtgcgcgcttttcgtacgacgcttaaataactgcgaacaggatgaggatgttcgccccgaagctgggtttgcccagttgtttcactttaatcaacggtaatcataatgattacatgactacagtcacttgtagtttatcaagcagggaaacgggtcggccttcgggttggcccgtttctttttgccaaaagtgtgggcccgtatccattggcgtctatttcagttaactaaaacacaaagagtccgaggcacaagccccggactctaataaagattaatgaacatggtgccagtcactcttgcggtcatgaatatcagtccgaatccccaaaatggcaattagaaaggcaatcagggcgatagcgatgattcctgtccagaaccaactttgggtatagataaaggtaaaataggcaaaacctaaagtgcttaataaaatgacggcaaggctaatcaataagtgttggctgtgaatgaagatagcggccagcgctaaaacaacggcgccaccaaacatgtcatcgccactagcacgactaccaaaattcccccatagggcatacccctcaatcagcagacctagcgccaaggctaaccagccaaaaaattggacaaacgtcaagcgttgtattcgttgcatcttgccacctactttccccaaatactagccttattataacgcacaacactagcattggagaagtgatcactggccgcgttagttgacagaccaatcttcgtggtctaatgccatttgccagaaattaagttcataccagctgctttttttgaagatggctaacagctcagacgtgttttgtggcgtggccaccagattagcgagggccagttgatcggtcatttcgtcggtataatcatcggcgttatagctatcaatccaagcctggtaaatcggaacgggtgaaccaacctgtgccagcattgccccaatctcagcatatagccaatagcaggggagtaaaccagcaatggcaccggctgatcctgccgtcatcagtgcacgatatagatggctcgtataagcataagcactaggcgccatgggggttgccgcaagatcgtcatcggtaatggctaattcttgaaagaacccttgccggacagccatctcaccggctcgtagttgtgcagcgttagcccgtagttgcgcaatgacttggggttgttgactttgatcggcggcgaggtcatgaactttagcgaattcttgtaaataatagtgatcctgaatcaggtagtaacggaatgttgctaacggaagagttcccgcttggagctgttggataaatggatggtgtttagaggccgcccaacttttttgagtggctgtgtgtgcttgatcggtgaacatcagtgaaactcccttcaaattgagctaaggcaacccacagaacagtcccaattggactagcagtaggctaagcccaagtaaccaccagtcgcggtggcggagtggaatagtggtggcataagttcgtggggccccttctacgaaaccgtgagacgtcatggcagcggccaactggtctgaccagttcatagcggcaaggataactttaaaataaagctggggtgaccaaatatggagtacttggccgcgcattaaggccgccgctttgatagttgcaacttccgcttgaattttgggcatgaggttgaaggcggctagaaaaccataagcaaatttagccggtaacttagcgttttgttctaacgaacgtgcgagagcgagtggttgtgtggtctggctaaaccagccaccaaggtagacgtacacaaagattcgcgtgaaaatgacgcctaagaagtggggtgtggtgcttccctggagttttagtgaccagactaaggcactggcgaaaaagagtggtactgccgtcagccaaagcaatcgcttgagagagacatgggcataaatcattaatagcaagctcacgatcaataaggccagattgaccgtccacacctgtgtaaatgaaatttcaaaagcaattagaataacgagactgagctttatcgtgggattcattgatcggcctcctgataacgtaattggcaatcggctaactgcaaatgtagggtaacgaacccatcgagaccactgagttggtgactaatcatgattaacgttaactgcaagtcgtgctgaacggttttgagaatcgacagcacagtttggattgagtcataatctaagccttttagaggctcatctaacagtaagacttgcggagccatcattagcatacacaggagctggacctttttttgttgaccgccactcagcgtgtaaataatttgatcacgctgttgggtaaggttaagttgcgcgagtaactgatccacacgttcaggcgtaaagtacgtctgccgaccgtacttatgggataaagcaatctcttcagcaacggtaacgttgagaaattgtgcactggccgattgaaacatgagggcaacttggcgcgcataagctttgcgccggcgtttttgaatgttaatgccgtcataagtcagggtgccttgataatcggttagccggacgagcgcgcgtaagagagtggatttgccactcccattagggcccgtaatcaaggttatttgatgggcaaagagacttaaatcttgcggattgatgagttgtcgcgtgccttgtcgtaagccgaggtcttgtccctggagaataacggggagctgacggtcgggtaaggtaacgtgagtcagttggcgttgtggtgcgctaaagatcgccaagcgttgttgagtcgcttctggagacaacgtggtcagatgaccggcttcaaggacggagagatgatcaatccaccgctcataaaagctcaggtcatggtctgctagaatgatcgttttactatgagcctgactgagctgaaccaagttctgcaataggtccaaacgagcagccggattaatgctagcaaagggttcatccaatagaatcaccttactatccattgccacaatcacagccaaggcaactttttgttgttcaccaccggagaggtgcgtgagatggcgattcttaaggctggtaatgcccacaaagtccaaggcagccgctattttagctggcatctcggctgccggaatctgctgattttctaaagcaaagcgcagttcgtcaaggacggtatccatggtaaattgcgtactgggttcctgaaatagcatagcgacttgactggcacgttgggtagctggtaactcctgtaatgcttggccggcgagtgttatctgggaaccggttggcaaaggcaacagtccagcaatgagttttaataacgttgattttccaccaccggagggtccggttagtaagttaaaactgccatcgggaaaagtcgctgacaagtcagctaagaccgggtgctcttggttgggataggtaaaagttaaattgcgaatagcggtggtcaagcaaattcctccaaacagttaaggttaacggttagttgtaggtaagacgtgggcccggattaataaattggcaatcagcttggttaagacaccgccaaagaagaagacggatagcaagcgaacgacaaataatagcaataagaagttaaggtgataagtggcataaccactacgtagtaagtcccaagcgaaagtaacgatggtggtggttaaagtactgagggctaatgttccccaaccaaaacgcttataaccagtcgctgcaaagccaatttcagccccaagtccctggatcgctccggaaattaacgtactagctccccagatgccgccgagaaacatttcgacgacggcgccgagaaattccccaagggttgcggcaccaggaattcgaatgatgaaccccgctaagggaccggccatcacccaaactcccagtaggatttcattggcgagcggttgtaagccaaggggggccaatgctgctgctaacagggtatagaccgggttcagggcccagaaaataacgcccataaagattgccagaatggtaaccaagataatatcgcgtaaatgccagtttttcatgagatgaaacctcctaaaaattcattaactgtggcgaccaaatgacaaaaaaatccccactaagtcatgcctagtggggttcattgataagtctaaattagacgcgttcccttcgctggtcctaaccagagcaggttcaatgggtttaatctcagccatagtggcaccccagtcatatgtgattaactttagcctaaccaatttgttcagaaattgcaaccgttaccgagaataatcgtaaccaaaggatgaccggtcacggggcacaaccattcaggggaaagacgggttaatcagtaaccagataattttgaccagtggggatcacctatgctaaaattcataggttattttaattatgtagaaagaagcggcggaatgaaaaaaatgaagttaaaacggtggggcctgctggtgatggcggcgatctcactaagcggtgtgacaactgcggttactgcgccagtacaggcacacgcagcaacgtttaaattggctaaggccaaagcagcagttgccatgaatgcagatacggggaaagtggtgtggtctaaggctggaaatacggcccgaccgattgcctctgtgagcaagattatgaccctttatctaaccttagctaaggttaatgggaagcaaagtaactggaaccataaggttaagatcactagccgcgggttggtctcaatgagccgaagtgcagcctgcggcggatttaagtttaagctgggtcataaatacacggttaaacagttgtatgatgcagctttcttagattcatcgaataatgccgcgatcgctttaggtcaatgggttagtggcagcaatgcgaagttcattaagaaaatgaacgcccaagctaaagcgtggaaattggggaaagcccattttgtttctgcctcgggtcttgaaaatagcgacttgcaatattacggttatcgctatggtacggcgaatgccaatatggtttctgccaaggatgtcgcgttgattgcccggcacttaatcacggactatccccgggttttaacggatggacaagcaggatcgaaaaaggttgatggtcagttgtgttacaactacaacaacctcttggccggccggaagtattatcaggctagcttgaatgtggatggcttgaaaaccggttatacaccattagccggttactgttttgttggaaccggtcagatggcgggtaaacaccggatcatcacagttgtcttgcatgatgaggatgaatttacggagacgcgttctctgatgaattatgcctatcagttagccggtatggatgcttaatgaatcgaggtcgtcactaacaaatacgggttagtggcgtctttttttgtggaaattgtccttcgtcagcaagttagttaagcctagaaacgatggattacgataccgttacgtccccaacaagcaagttacaaaacgatggctatccttgtttggtcattgttgtccgtgttagggtaatccttggaagatttaatctgagaaaagaggacaatgtaattatgggattgaagaaagccaaacgcgcaatcatggcggtggcattgacggcggcgattggtagtggcgtgttggttggcacacaagctacggcacaggcggcaacggcatacaaaacagtttccacgaagacgttgacgaagaccgcttatcacaaaaagagtacggctggtgcgctttataatcagacacataccaagaaggtggccgcactaaaaacttaccccaacaccacctggtatgcgaccaagcaagcgacattaaagcatagtaactcaaagggcatttactattacgttaagaataagtcaggctcggtcaagggctggatttggcatggctacctgaaaaaggggaaagcgccatttgggttgaagtatgcgaagaatgcgattgcgttggattatacaacgggtaaagccgtgtggtcaaagagcgcgaatactgtgcgaccaattgcgtccgtttcaaagctgatgacgctatacctcgtattgaagaaggttgatgggagcgctacgaaatggaatcaggtcgttgataccagtagtaagggcttaattgcgatgggcaagagttcagcttgtggtggcttcctgtttaagaccggacacaagtacacggtcaaggaactttatgatgccgccttgctagactcctcaaataacgcggccattgcattgggtaagtgggtagccggtagtaatgcgaaatttattaagcagatgaatgcgcaggctaagagttggaacttaggtaaggccagctttgtttcggcgtccggactcgaaaatgatgatctaaaagcgttcggctacgcctacgggagtaaaaatgccaacatggtatcggctaaagatgttgccttgattgcccgccatttgatcaaggattatcctcgaattctgactgatggtgccgttggttctaagaacgtggacggtcagctatgctataactacaataacctgttgaagggccggaagtactatcagtcatccttgaaggttgatggtttgaagaccggttatacgccactagccgggtactgcttcgtcgggactgggcaaaagtcaggtaagcatcgggtcatcacggtggtcttacatgatattaatgaattcacggaaacccgttcattaatgaatcacgcgtacacttacagcagtatgaacaactaagtaaaaggctcgtcgcaattaagcggcgagcctttttacttagccttaagcagtcaaccacaattcagggtggtcaaagacccgctgaagttcgttaaaaaactgactgacgtgatagccgtctgctaccgcgtggtgaatggtaaaggataggggcatgagccattgaccatccttaaaggtaaaacgtccagcttgaatcacgggaaaaaatgtattcaatggcgtaaagggcagtggcgtgtagctgttaaaatgcgtccacggaatgctcccaatcatgtaggtgttggcaccttgtggggccttgggcatgggggtatgttggtcgccataagttgcctgatcagcgaggtagttttgatgaaactgctcgaagctaggatcataggctgtccataagttagagatggttaaatcatcaccatggaaagttgaatacgacggatgcaaaacatcgtattcgactagttgaccgtccacctgtcccacccgaaattcgggatgtttggttatcagtttagtgaccagatataagtaggccgggttaaatttgcggtcgtgtttcgtgagccacgctttagtagcggtaatatccatgtcgacatttagagtaaagccagtgggcatcatttttgtaaagtagtaaaagtattcacgccgagcccaagttgtttgatcaattggtgtggcgtgggtatttaattcagtcattttattctcctaattttggttataagcgggatggcatttttccaaccattcttgttttaaatctttgagtttatggcgcaggttgatgacatcagtggcgtcctttttccagagaacacggtaactaaaagcatcagcacctaaacgatcccaatcagcttgcggggcggtatcatgataaaaatgattgttcaagttcgtctgataatacccccaacgattgtgaatattgggaacggcatcgataaatagttgaccagtttggtcatttttaatttgaatcacgccatagaatgttggcgttagtttgtattgttgaatgagatcctttttgttcatgagagctccttatagttggggttgcgccagtagtcacgaccatcggctgtgcggtttaggaagccatagtccacaagatagcggcgcaagcgcggaaaatcggtatagattggcttgagatattgggttaatgtagtctcatcgaagtgttgatcggcaggtaagatcgtggcaacttgctttagaactactaaaatggctttttgttgcttaggccaacgggccagtcgtaagggggtcgtactggtgaaatatttggcagttagttgttggtagtcccgagtcgtgatggcaaaacgatcatcgactgccccggtctgttcaggtaaagaaataaacgtctctgcagcgggtgtcgtctggaagacacggttgtaaatggccagataaagtttggcctgtttagccttttcgcgaaatgtaaatttttgatggcggatggttgcagcggcgactcccatttgtttggcaatctcagcatctttggttccttgactgaatgccgcaagtaaatcctgttgtttggccgtgagggtgttatatttacttttagtttggattaataaatgagtagcatcaggatgggccgtttgtaagtggtgttgaatcatccgctcagctggataaaaagcgtcgtctactggaaagacttgatcgcaagcaaagtgcgcatcgcagtaattacagctaaagtagtcggctgattgatgccagccttgctctaattcggtaagtgttagatcaatttgcgtcatgggataacctccaatagcaacagtgtacatttgtttactgaaacagtcaacattatttttttagtgtctctataaaataaacatttttcatttaaaaatttgtaagtcaaattcgttgtctgtctaagtgacgccaagtatgatgagaccagttaagcagagtgggggatggcaagtgatactacaactacttgcgattgatttggatggaacactgctagatgatgccggtagatatgatgagtggcgttttgacacagattgccacttggctggtttgagcaatggtctttccaaccgaatagtttagacctgttctggtggccgttgggcttacaatggtgggaaatagggggcgagagtcatgccaagtttaacagtttggggccagcggcttgtaaaatttgagctggcttggcaacgacaccaacaagttcgggcaattcggcacgcgttacgattaacctttccactcgttttcttggggagtcttgccacgttcattgaccaggcgtggctacaaacaacgggctactattatcaaacccttcacgttaatcattggttgttgcaattaacgttattgaagcgttatgttcggctagttagtgcgggtaccttagggttttcaggaatcatggtggcgtttgcggtcagctattatttagtcgcagacaaaacggcgcattcgactgaccggttattagccggggtgacggcggtgattgggatgaaattttttaatgtcgatcgcggaaccgtcttacaggtacaatccatcaagtggtcggctaacaacttaggcttatcggggattttattgggaatcttaatgggggtcttagtcggcaatagttttcgttgggtggttcaacggcggaccacgcaagaagaaccgttaacccagtcgttgtggctaaccagtatttggaccctaggaacggccgcggtgggattgttgtgggttagtgcgcagacggtgagttttaatgcgacccttatcggattactgcgttggccttttagactgtcacattttattgttggactgtgggggttcagtgcccttaccggagtgtttgcgtggttaggcatgctggggccattagcgaccaccggtcaaaccgttgagacggcccaaaatttggcggcggtgttattacatcatggttggcagctgccttatccactgacagtccatatggtaatcagtgtttatgcgaattttggcggttcagggatggtgctagggttattattggctttgttcctgacgcggccgccgcgagcacaacggcgaattggctggttaagtgtgttgccgacgttaggcaatttaaatgcaccattgatgacggggctaccggtaattttagatccattattaggcattccttttttattagcaccattagcgacgattacagtgagctggatatgtttacgtttaaactgggttccggcagttgcttatccattggctgctgggacaccggcaccactgttagcctatttagggaccggtggtaattggcgagcgttcgcgttagcattagtcgatttggcgattagtaccgccatctattggcctttcttgaaatggttatggctggctgaagcacagggaggcgatgagaaatgaagcgacgattgcaggggtcacccgttcttctaatcgttgggttgttggtcctattgtgcataccaggcttttggtggcaacctcaccaagcagcgagtgtccgtgcgcattaccaaagtgccttagcccccgtgttcttggtaccgggatcgagtgccacgcagaatcgattcaacgccttagtgaaagaactgaatcacgaaacgcctaagccccatagcctgattcgcgtggaagtattaacgaatgggcatttacactatagtggtcatttgcgccacggtgataattgtccctttattgtggtggggtttgaaaatcatcatgacgggtatgccaatattttaaagcaagcgcaatggtttacgatcgcctttaaggaactgcagaaaacgtatcaatttaatcacttttcggcgatggggcattctaatggtgggttgattttgacgctatttatggaacaagacctagcggcgactaaggctaaggccgaccggttaatgacgattgcctcgccattcaatttagaggagtccgatgcagaagttgatacaccgttatttaaacaattggtggctaagcgtgaccagctccccaagcgcctattggtctactcgattgcgggtagtcaaacctttgctggcgatggcattgtgccgtttgatagcgtgaaccgtggaaaatttatttttcaggggcgcgtgaaaaactttacgcagatcacggtgacgggcgctaacgccaatcatgcagatctgcctgagaacaaacaaattgtcggcctcattcgccaagacctcctgacgtaactgaaggtttatttcgagcggcataacgtgtaaactgagggtattagggaataaaacggaggacgttgacgaatgataaaaatgattgcgctcgatttagatgagacgctactcaatacggataagacgatcagcgaagaaaatgcaaccgccttgcgccaattgcatgaggccggtattaaaattgttttgtgcaccggccggcccatcaatgcgatttggcattacttggagcagctgggattgacaacagacgatgactacacaatcacgtttaacggagcgttagtgattcagaattcaactaaagaagcgttggcacaaagtggactgagccggaatgattttgaaccgttgcatgcttttgccgcggctaaccattatccgatggatgtgcttgattttgatcaggtttatccgattgcggatctaacaccatcggtttatgagcaaatgcttaaagcgccaatgaagtttatcccaacggcctttgctgatttgccagaccaattatttagtaaagccgtgatggcgaccgatgctgccatcttggatcaggtcgtggctaagttgacaccagagcttacaaagctttaccacgttgtccggtcacaacccaagattttggaatttttggctgcggatatggataaggccgttggattgggccagttattaacgcattttggctgggatttcagcgatttaatggcgtttggcgatgctgaaaatgatctgggcatgattaaggcagccggtgatggtgtggcgatgcaaaatggtcaaccagcagtgaaggcggcagctaaccatcagacaccagtggataataatcacgctggtgtggcggcttatttacaacacgtgtttccagaattactgggatagagctggtaattaggcttgtgaaatgctagtataaaaagtgtacagcatgaatcttaaggaggattatggtcatgaaacgtttaatggtgaagatgggattattggtactggcagcaggaactttgggaggaattgccgcaccaagtgttgctagtgctaagacaaaagccaaaccaacgtttaccaataccgatttaaagcgttattacaagagcgccaaatcgaagaccgctttttactttaagacctacaagtcatctggcaagaccgggacattgttgatcttcggcgattttaatggtgctaacgcgaatgtgaagtatggcgtgccaagttctattaaattaagtaaaaataagcggacgttaacgactaagtacaagctgattgaatttaaaacaaaagataataagacaacgacgtccttgtctaagaaaaactatacgtttaagttggccaagaagaccagtacgacgtttagtacgaaggtttatggcacgaagcttaaccgtcgattagcgacatcgggtaagagctatacgtataccaagactaagacgagtccagcttctgcctatgctaagaagtatgtgaagccagtaatgttgaagaagtacacggaggcttttaacagtgcttcaacattaacggcagcacaaaagaaggcctatgcaactgagtatactaacacggctgtaaaaacgatgattagtaatttcaattacaaggcataataaaaacacgacctttaacgggtcgtgttttttagtgggcctaagcggcaaaaatacgaattgctcggtaaatgttatatagatagagcacgacagatagtagcaccaaagccgcgccaatgattaagccgctaccggctaagaagcgaccgttaacagaggtgaagagtgatatgccaccgatgctaaaggctaagacgatgaaacaaatgaatggcagtaattgcaagatcaatgcgtgccgtgctgagcgggtcacgtcgggtgccaattgggtgaaagctgccgtgattaacaccaataatggaaagccgactggcataaagataacgctcaaataacttaaaccattgatgacccgatgttcggactgaacttgtggttgcatagtggtccccccttgcgtaaagttaataagttaagtttacgggatttcagcgtgggcgtaaagaaaaacgattagactgacagaatattaaaaaccattgctcgactttaaatagcagagcaatggtttttgataatgagttagttttctttgaataagttggtcaggtagtccatgaagactttcaggtaacgatctttgtcgaccattacagcgaccttgacgttagttggttcgttcaaacggttgtcatcaccgatagttcggccataagtttccttattggtgttgacgaccatattgagatcaatcgttgtcacaaagctagggtctaacgctaccccaacggctaatggatcgtgcagtgcacagccacccaagttgtcgttaaattgcttgtaggcttcgatgtagtagtccacgatgtcagcaaacttttcaccagacgtcgtacctaaatcacgccattgttgggtttctttcttagtcaacaaagtccgtagcgtaacatctaggccaaccatcgttgagtggagtgggctagtgaggacggcgttagcggcttcggcatcttggttaatgtttgcttcggcgaaacgggttacgttacctggcatggttaaagcgccgcccatgaaggtcatgttgcccatttctgtggcaatttctggggccttcttcaaagcagcagctaagttagtcattgggccggttggaaccaacgttaggtctttaccatattggtgaacggcatcgattaagaagtcaacaccggattcactttcgatagcacgcgttggttcaggcaggtcaacttcaccaatcccattttgaccgtgaatgttggcactgacttccatccgatcaaaatgatcggaggttgaagaatgactttcacctagatagacggggatgtcagtgtgacctaacagttccaaaatctttagtgcgttcttgccaccttcttcgataaccacgttaccgtaagaaccgataatcccaatcaaatctacatcaggtgcacccagtgcgtaagcgattgcgagagaatcgtcaatcccagtatctaagtctaaaatcattttgcgttttgccatgataatcttgtctcccctttaatccagaattagttaaaagcctctctctactataatgtaacgggttacatttagcaagctcaccccgtcaccaagttgaagcatttgaccgttcagggtaagataggaaccgaattaatccgttgatagcaggaaagggacgacaccatgaccgataaggaagccattaaaccactaaaaaaacgatttcactaccataaccacttattagacgatgccaccaaagagatgaatgagtggaccggggagaataaggtggttgaaatccacctattccagatgttctcatccgtctttaagcaccacgatcatgacgaggctgaagcgcttttcattgttggaactcgagaaacgacgccgtctttagaggcagtatcggctgcaccagtcaagccatggctattttcccgtgtgtttgcattgttgggtgctagtttcttcttactagcgatgctcttcttagtctttcggagtaataatgcggttccagggatgattttcattggctcattaactgtgccattttcgttactggtcatgtttttcgaaatgaatgttttccagaatatttcggtttaccaactgatgaccgtatttttggtcggtgggatcttatcgctggttgcgacgatgattttgtactcattaattccctctggcaatggcgtttcatgggaatcggccctaattgtgggctttattgaagaaactgccaaaatgttagtaattgcttattttatcaatcaatttcatttgaattatatttttaatggattattagtcggcgccgcaattggcgcaggttttgccgtatttgaaacggccggctacacgggtcaatacggactagtgacactattaatgcgcagctggcaagcaatagggactcacacgatttggtccgccattatgggtgctgcaattattttggccaaagatcggcatcagcccgtcacggggagcaacatggtggcaccgaaatttttacgtttctatttattggcggtcgcactgcatgctatttgggattggaatgccccctttgccttgttagatattctttatctccagcaatgggtattaattgctattggctggatggccatctttgtgttggtcaatgcggggttacgggaagcacgcactttacaaggccagcggattttaaagaatactcagttaggtgggtaaagggcccgaataatcagtgcgtctaacgcgggattctcatgtagcagggaatgttgtgtgttccaaacgggaccggcataacgccggaaatggtaatggacgccgcgttgggcaaccaagtgtgcaagtggggtcacggtcgctacaggaacctcgctatcattatccaaagcaccaatcgtgccggctagattaagccaattacagctaggggtaacgcggcgtaaaggtgttcgctccggaaagtcagcgccaattgtcacaattcggcgaacggttaccggggcttgtgaccggttattgagatagtcatagataatggtgccgcccgaagagtgaccgacaacgttaatgtgattaatcccataacggcggtggagttggtttaagacaacgagcaactggcgcgcttgtcgttggggatgtgtgttatctttaaagatgatcggaaccaatggattatttgcccgaatagcgtgccgttgttgccaagagacgcggccggcaaaagaaacgtgggctgtgagcgcaaaggtggccagatgaggccggttaagactggtgaccatgctccgaagtgacagccatctgccactgcttccgggtaaaaaaattgttgcggtggtggtttggggaacgcgaacgtgagttaagaccgaccaacggtggttccaccaagtacagagacctaagagaactacgatggtggtcaagagaaccgttaagcgacgtcgatgagccatggcaaacacctccttaaggacagaatagaatggagtaaatgagaatgacagaaacatacgatataaccattattggtggcggcccagcgggaatgtttgcggccttttacgcgggcatgcataacgccaagacccaactgttagaaagcctaagtgaactgggcgggcaggttaatgccctctatccagagaagacaattttagatgtggcggggctaccggctatcaatggacgcgatttgattaaggctcagcgtgaacaactgacccagttccccctgacaattaagacggggcaggaagtaactaatgtgaccgctaatgaggtcggatttaccgtgaccacagatgccgggaccacgcagactacagcgattattgtggccattggtaatggcgcatttgcaccacgtcccttaactgttcccggtgccgaagccgcaacgggaaaacaattggtctacagcgttccccgactggccgattttcaagatcagacggtgatgattgccggtggtggtgatgcggcgattgatcaggccttgatgctggaaccggtcgccaagtcggtgacgttactccatcgtcgtgcccaatttcgaggattggcacatatggtagatttattgtacgcctcgacggtagcagttaaaacaccatacttgattcgtgaggtcgcaccaacggcgacggggcaactcaaggtgaccttgaaggaggttggttcacagacagccaccgccgaacaaattgtggataagcttgtcgtgagctatggctatacgtcagatcatcacgccttagctggctgggatattgacttagcggaaacccgtaacctgattaatgtgtcacaaaccatggagaccagcgttcccggcatttatgcaattggggatggcgtcacctatcctggtaagcaacccttaattgcgacgggctatggcgaagcgccagtggccgttcagtcaattatgacacagttcttcccagatcggcggggacccatgcacagtacgtcgctgacacctcaatcataaaacaaagtgttaaaaactcaaagaagctgttcgccagatcatgagatcgagcgaacagcttctttattaatggtcatgtctatttgccactggtatcgtcttgattggtaatcttgatccggttggaatccgtttctttatgattcaattctggcgcatcagtttggtaaagagactgtgttgatttatcaccattacgggagaacagactagttgactttagtcccaactttttctccaatttttcggctttttgtaggccgtcagagtagttataatctgaggcatctacggttttgaagccactaggatggtagaatcgtagcagattcttttggttcagtgaatcggaatcgttgagaccttggttaacgtgtttctgaatagccgcgatcttctttgctagttttccagtcgggtgaatctcttgtttggtgcgattactgtaaatggtgtcatcaatggacgtatagcccgggctgacccaatcccgatttcgaaaggcaactacgggattatgttcgctggagaaaagatcagttccaaattgaatgtacttcttggaattaatgcccatcagatggagcagtgttggtaacacgtcgatctcgccaccataggtatgctcaactttacccttcgtatagccaggcatattgaacatcagtggcacgcgttgaagttgggcgttatcataatcattccaatcatcgggattgacacccagcaactttgctaaactcttatttgatgagttagagatcccataatgatccccataaatcatgactaaagaattcttggcgaggccggatttatcaagatagtggtagaattccttgatggattgatccaagtaatgagcggtcttaaagtaattatcaaccgtcttatcaccagtattcggtgttttaaagctggaatcttccttatctaaagtaaacgggaaatggttggtgaccgttaaatacttcacgtagaatggctgctggagatgttgcaggtatttgacggaatcactaaatagtagcttgtcttttagcccgtaacccaaagctttgtcgcctgatgtatcgaagtaactggcgtcgaagaagtactgataacccaggtttttgtaagtgttactccgattccagaaactcgcgacatttccgtggaagacagcggtcgtgtatccagattgatcgaagattgcgggggccgcttggaaggtattgtcatttcccagttgggtaaataatgaaccttgtgagagaccataggtgcccgtttcaagcatggtttcagcatccgaggtcttcccctgaccaacttcatggaagaagttatcgaagctgtaggtggccttactcttatagagtttatttaggaaaggtgtgacttcttgaccgttgacctttttgttaatcaggaactgttggaaactttccaagtgaatgacaatgacatttttctttttagcaacgccgaagagttgtttgttcggggcggcatagttcttgtggacatatttgagaataccgcttaactctgattttttggcgtgagagcgcaattcactggtgtgctgggacttaatcccatcgtaaacggtaaaggcgtctaggcctaagtatttgacgacataggtccggtcaaaggtccgagtcagcaactggggccgatccatctcgcccatagtcaagttaacggtgaataggagtaaggctgatgaggtgaccgcaaagccaacccgtttattaactggacgaggatcaatgtagatacgacgagtcgccatcagaattaacacgatcactaagtccaaccagtataagatatcgtgtggcgacgttaaggcgagtgaactaccagagaggccctgatcaaccttggaatagccgagcaccgtgctgacggtcataaagtcagtaaactcccggaaataaatgacatttatgtagaggagtaaggtattaagaatatcaatgagaaacaggaacgggtaaaagaaccgggcccgtttgaaatataacgccaatccaaataacaataacgtcgtcgcaatcggattgatgagaataatcaagaattgaaacgggtcactgagatttagattgaagtcgacgaaataggcgaccagcgttttggcccagaataaaaagaccataagcatgacaaagcccattcgggtcccggtccgcgcccataattttttgaaacgttccacgtgttttcgctccttcatatacggttaagtagtctcattttaccatagtgttttactagaaaccgactagtccatcataataacatgctatctatcctaacaaactcagggcgcgtcagcgttagagactgacaagtttaggaaaactttaaggcccgatagcgaattgtaaccgctatccactgaaactttggtacactagaggtaatttagatgagaaaggtgtgacaagcaatggcaaagcaactgaacttatatgtggtgcgtcatggtcaaacgtattttaacatttataataaattacaaggatggagtaactcaccactgacagaagctggaattgcagatgcccaagcggcgggggaacgactaaaagcgattccgtttgccgcggcttattgtagtgataccacccgtgccgaacaaacggctaaaacaattttggcggcccagacccaaccggcaccacagttggttacggccccgttctttcgagaagaattttatgggtactatgagggaacggatatggctcaggcttggtacgttgctggcgcgccacatggggtgccaacttttaaggccattgaggcccggtattcgattggtaaggcgaaggatttcttaaaggaagccgatccctttcaccaagctgaaaacaatgctgagtattggcaacgggtggaccaagggtttgatctgattcgtcaaaatccggcgttgcaagatggggataatgtcttaatggttagtcatggcaataccttacttagcttaatggaacgctatggccaagggaaatatgatttgagcgaacgaccagccaatggtagtttgacccaattgttgctgacaccggatgatattcaggttgttcgctacaatcaaaaagattagagacgaggaaatgttgatggatattaaatggacttggggtaagaaagatgcatgctatgaggacgctttggcaattcgtaaggcagtctttattggcgagcaagggattgatccgcgcctggagcttgatgggacggatgaagataagatgcattacgttggctacgtagatggccagccagtaacgaccgcccggattgatatgctggcaggcaaccgggtcaaaattcaacgggtggcaaccgtcgcgagtgctcgacagcatggctatgccggtgagctgattaaaagtatcattgcggatggtcagcgttctgaagtggcccatatcgagttggatgcgcagttgacggcgctcccgttttatcaagaactgggttttgtcccggtgggtgaaccctttgaagaagctggtattcagcatagaaccgttgaatatcgcgggtaagtatgatcaaagagtcaattctaaaaaaggtgatctcagaattgttataattccgggatcaccttttttagaatatttggagacaaaagaaaatccgttacgataagccactatgcttatccgcaacggattaattttaacgttcagatgaattcatgaggtgttaactgaacgatgtcataattagtcagcgtcagcaacccgtgcataaccaacagcatgccaccaaggtgcgtgaacggcttcgcgaacaacaccgcggttttgggcatcgatcattttaccgttaccaatgtacataccaacgtgagagatggacgctttgctaccaccaaagaagactaagtcacccttcttgatgttcttgtagctaacatgatctaaagcattgtattgtgcttgggcagtacgaggaaggctaacgctagcacctttcttgtagatgtagccggtaaaaccagaacagtcaaaagcgtaaggaccagttgcgccatacacatagctagcacctaaatgagatttagcaaccttgtatacagagctaaatgatgttgtgctggcagctgaagcagtggttgtgttgctagcgttaaatgcgataaacccaacaaaaactaaaatcatcgatgcgattactttactaactttcttcatcctaataaacacccctcatgaattttacaagtactagcgtaccaatgtaatatgacaaaagtgtaacaagccagtttcaatggcgttaaatgtcttaaacaaaacgttacttttgcccaatgtcttgcatgtggggtagaataattgctattatctaacatagttggtaacttagttaacaaataagtgattggagggggagacgaccatggctgaatttacaaatgaaatgcgaaaattctttgatattcaacgcctagtttttcgtatcggggaactgtcagcaatgacggatgtatccgcacgacagttacgctactgggagaagaaggggttgattgcgtctcaggcgcgcgaagatggccagcaggctcgcgtatatacgtttaaaacgtttgtgcaggtgtcgatgattaaatatttcctagatgaagggtatacgctggaagcggccagccaccaagcacggagtcgccaagatcggatgaagtacattcatcgatttatttcatcaggcttacaagggtttgcaacagttgatgggcaaatggccattaacctgggagcatttgacgcagaccagacgctgatggctatcttgccggaatcaggacccacgcaatatcgcctctttcccaatgatgaggcgcaacgaatgacgcaggcggcacctaactgaatgctatgagtaagcgagataagcaaacggcttgtctcgcttttatgttggtcagagctttgaataacgtttcgtacaattgtgataaattttgcttgaatatatctgttagatacattagactggttaatgtcgtaaggaggggtcaggatgtatgaactttttgtactaggtcagctaatggatcagccaatgacaggctatcagctacgcaaggccttaaaatttattgttggggaagagcagacggttagctacggtgttttgtatccgctactagataagttaaaacagcagcagctaattaagcaaaatgcaacagctaatgcaactcgatcccagaaacaagcagaaatcacagcggccgggcgacaacagttccacgatttggtcttagagcccgtgaccattaataagcagacacagctcacttttcaaatcaaatgccgttttttacatttattaacgggtgatgagcagcaacgcgtattgaaagactttcaacagtttagccaatttcaattggcaaatttagaagaaacacagcgctacttaacggatagtccccgaatggtggcggaagacgtgattgatgctgaccggcttaatacgttgcagttgatgcgagctcaagttcaggatgattggattgctgagcaactggcacagctaactgaggaggaatgaacatggcacctaaaacctttgcagatgatccacggattcaaaaacgacggtggtggattctagtggcagtctgtctctttacgttcatgtcaacgttagatgccagtattgttaatattgcgttacccgttatgagtacggatttgagaatacctatgaatcaagccgaatggatcgtttccatttatttaattgttatctgtgccctgttacttttgttcggtaaattaggggatacccggggcaaaattcgaatcttcaaaataggctcagtcttgtttatattgggatcattgttatgtggttttagtgtaggcttgccgttacttctggtcgcccgctcagttcaggctgttggtgcggcgatgacgatggcgactagtaacggtatcattacggaggtttttccattcaatgaacgagggcgagcattgggtacgatcggatctttcgtggccttggggagcattgctggtcccggaatcggtggattaattttagcccatctaagctggggatatatcttctggattaatgtgcccgtcggtattgtggcattcatggttggtcaacggatcttaccgcgggatattacgctgacacatgcttccgttgatattgctggtgccagtctgtttgcagtgatgatggtgagcctctttgccgcggttttcatgggtcaagagattggattcaaccgaccgattatttggggattatttgtggttggtattgtcacaatggttagctttattcgcttagagttgcaggtgagcgaccccatattggccttacatttgttcaagaatacccggtttagtgtcagtgtactctgtgcctttctgatttttgtggttaacttcttttttaatgttatcgcaccattttacttagaaaatgcgcgggggatggcagctaactatgcgggctatgcattaatgacatttcccattgtccaagttgtggtcgcaccaatcgctgggagtatttccgataagattggtccggagttgcttacctttatgggattaatcttgattgcgatcagtcaggtgggctatatgttgacgacattagcgactcctttgtggcttttcatgttctttattggactcgtggggttgggcaatggtatcttcatggcccccaacaattcgattgttatgagttcggttcctgttaaggatttaggcgtggctggtggggtgaatgcattagcgcgcgagctcggaatggtgatcggtatttcggtggcaaccaccgttttgtttgcggcgatgagccgggctgctaagcgccaagtgacagcttatttaccagctcacccggccatttttattaccgggatgcacgtggcctttttagtctcgctaagtatctgtttagtagccacgataatcactgggtggcggctcttaaagcacgcaactcaagcttaatggacacaaaaaagatcccgattcgagatattgtcgaatcgggatctttttacctattatttttcatcatgtgtcgtgtcatcagttgatttcaatgaacgatcagcacgacgttgacggcggaagcgataaggcttttgcgccggaataacaacggacagcttgccgaaagccgcggccatgattggtaacgtcaaattaaagatgattgccgtgaagatggtaatcaacgtgacggcggttaacgtttgggattcagcagctaacaggcccaatacgccagcaatgataatgaagagagagtggcgcatcgtttgaccaacatccttcaagccaggcaataaccagtccattaacggtgcttcattcagacggaaactcagggctaattgcgtgagttcaacgacaccgagaacggtaaccggaacaaaggccaacaggggcacctgccagttgaagtcgccgtttccagttaaccatttcatgatgaggtgagttaattggtaactagcggcaaccgaagctaggaaggtcaagaaccagtagccagcctggagaagcgaacggctgaagaggatgaccagtagcagcgtgatgccaaagactagcaataagacgcgtggtaagtcatgttgatactggttttgaatagtggcagtgacaacgggttgaccggcaaaggttagcgttgcattctttaggacggttccccgcagttgagccttggccacttggcgtagttgcgtcaaggtcttagccgttgtttgtgcattaggggcttgcttgagcgtaatggtcaggtaagtggacttaaccttctcatccgtgaagttagtcagggattgttggaaatcgccgctagcaatttgggtcggtgagaggtagagtgacttcgctgcttcagaactttgtaagccatctaaatacaagtagatcttattcgtggttttttgcatgttgatgacttgcttacgtgagttgttgaggctatcgttaactgccttcaagccagtcgcgtagttactcaagttggaatgtgccgcggtagcactcgtattcgctgtatcaataccattagataggctggttaacgtactgagtgcggtggacaattcggtgttcacttgatttaactgtttaatgtaactcttggctgccttggatgaactggaaccagaagctgatgatttactagaagcactttgaatcgagctttgtaatgtgctgctatcgcttaccagactattagtcttgctcgtcaatttctggagtcgtttaatttcggccttaagtgctttttgacgaagattaacactatcagacttcaagtcattacggacagtctgtaactgaccagacacaccggtcagttcattatcaatcgaactgagttggctggagacatagtattgcgtgatgggttgaccaccaggctgggtgacagaagttaccgaagcaactcccggttgtgcccgcagtttcttggttaaattatccaactggaacagttggttttgattatctaaacgttgactagtctgaagataaagtgtcacaggtgtcgctttaccttgaccaaaatgagcactgagaacccgagcaccctgcacggcttggttatttgaaatatcggtcgcattatcatagctgagttggctacgataactataggcaaatgggccaatcaagtaagcaactaccaagatagcgacccatggttgccacatcccgaagcgggccagtgtatgccacatcttgtgatcacgcaactgtggccgtgttttcttgggccagaagaggctattacccagcataccggcaaagacgggaactaaagtgacactggcaatcccagtgatggcaaagccaattcccaatagcccgtaagcccgaatcgtggagaaatcaaagagcatgagactaccaaaggcgagagtcaggctcaacgtactaatgagcacccgatagcctagattttggataacctgactcgttgccgcctgactttccattccatcatcgatgtgattacgtaagtcacgatagaaccagaaactggtcagcaaggtaaagaggctaatccctaataataggaaaatgggggtgtactcagagtacgcaaaattccagtgataggctaagttagttgccaaactcaatgtagagatataactaattaagatggctaagaaggtaataattggcgcgatgattgaggcaaataaaatgcccatggcaactaaagcaacgagtagcgtcattagaatgacgattaaagtaaatgacgaaatgtgctcgttagctgcatcactcacaatttctggactggtaacgtaagtgtttagtccaattgtcgcaatctgatctttcaattgagacgtaatttgccgcactgtaccttggttatggctaacagctaactggacaatctcggttgatttgtccttagaaaataattgcggtttgctggtgggcgtgttagtcatcgtggtgatcttttgaatcccataatagctggagcgtttctgcaattgggccactgacttattaatggccgccaactgtttgttggttaaggcaccgtcagggttgttatagaccgcgttgaccgtgtacgttccgtttaaattgtgaccccaagtgttgcgaatttgggatgctttaacgggttgactcgtattcgccaattgtggttgaccatcgtattgaatgatagtgttgacgtttggtaaggttacaatcgccgcaaaaatcacgatcaaccagaatacgagtgcaaaaattcgattatggtgaagcttactaatccgttctcgcataagtaatctgagtcctctctatgtatcaaatctcccgccgtgcaagcagggtacaatccactctcaattctaccatattgaggcgacttggggccgttttgtgcccgatttaagaaagtttaagaaactctttagttgccataaatgctgaaactgctacagtagaacttatttgtattccacaaaaagggagagaaccaaaatggcaaagcatcatcagcgttatcatagtccctacgcagcaatgttaactgaacaacgttacgcctttgcgaatcagttggccgaccaaacgggcctagatccaagtcaaattatgtttggttacttacagataaccgcggctgttccgacgacattaccagtgttaccacgacaaaaagaaattgaccgccgctttcaggcttttttaacggatgcccaagccgctaatcattaactgttgaaacgcttacatttatatggtttaatggagctgttcttgatgtttccgatctaatcaaaggagtggttaagatgaccagagttgcaatcgttacaggtggtggccaaggaattggcgcaggtatcgttaagcaattagcagcagatgggttacaggttgctgtcgctgatttgaatgaagaacacgcgaaacaagtggctgaggaagttggtaatggtgcccaagggtattttgtcgacgtttctaaaaagcaaacggtctttgatttagttaaggccgttgtggcggatatgggccacttggatgtgatggtcaacaatgctgggattgccaagattgcaccggttactgaaaccacggaagaagatcttagtcagattctggacgttaatgttaagggggctttctttgggattcaagcagcggcagcgcaattcaaagcccaaggaacgggcggtaagattatcagtgcatcgtcgattgccggccacgaaggctttgaaatgttgggggcttattcagcaaccaagtttgcggttcgaggattaacgcaggcggcagctaaagaactagccaaagatcacattactgtgaatgcttattgtccagggattgtcttgaccccaatgtgggacgaaattgaccaaaagatggcgaaaatttacaatgtgccagaaggggaaaccttgcagaagaatattgacagcattgcgttaggacgaggtgaagaacctgctgacgttgccaatttagtgtcattcttagctgacaagaagtctgattacatcaccggacaagccatcattgttgatggtgggattaatttcgcttagaatagattaaccggataaagatcggggcggtcatcgcgatgcggtgcccgctcttttgacttttacgttaacctaggaggatggtaactgtgtgtacaagtattttacaaatagccaaagatgggagtcatattttggcgcgcacgatggattggcacgtcttggcggtgcaaccactgtttgtaccgcgtggctaccaatgggagagtgtgtatgataatcgggtgcacacaaaccgttatgccatgattggtggcggtggggcccaccatcatgagattgacgtgtccgatggggttaatgagatgggactgagcgtccagaagttaacctttgccaatggatcacagttggtggacgagccgacaccggggcgagttcagttggcgccctatgaattttctttctatttactgggtcattacgcgtcagtggcagatattgaagggcatttggatgagattcaattgatgaccaaccggtacgccgttaacgacattggtcacgctgagttacactttgcggtggtcgatcgaacgggtcgtacagttgtgattgaacccacgcattttccactacgggtacgggagaatcccttgggggttgttactaatagtaaagattttgatttacagttagagcgtttgggacaatacgttaactttaccgaggcgtttaaacagggaaaggtcccccttaatacgccacgcgtgactacaggaaagttctctggtaagccagtaccatccggttcctttaccccgggcgggcggtttgttcgcgcagcctactacaaagaacgcgccgacattccggttgatgaaacgaccggaattatcagcgcgtggcatttgttagatagtgtgacggtgccacagagtcatcagtatcgaccgacgtattccgtgtaccgagcagcgaccgtttgtgaatcgctgacgtattattttcaaccttataatcggttagatctggttcagttgactttaacgccggaaatgttatcgtggacggcccctaaattttatccagttgccaatgacttacagacgacagtcctaaattaaagcaagtaccagagaatgttggccgtgattaagccgactagtatcccgcgatgtaggcgtggatgaagcatgataattgccaaaaactcgcgtgcccatgcagccggcaggtagccccggcgcgttggggccggatagccacccaagcgtaagcccaactgacttgctaggtgctccgcacggaagagatggtaattattggtgacaatgacgacccggccaccttggtgggggagttgactccataaacgttgactgtaaagtaagttagttaacgtactggttgcgtgattttcctgaataatacgctcctgtggccaaccgtggttaactaagtaggtggtcattgcttcagcttcggtaaggtgttcatcgggcccctgaccgccggtgacaattagcgtagtgggcgttgactggcggtgcgctaattttagtgccgcatctagtcggttggctaacgtacggccaatctgattgccgtggcgaaggccggcaccgagaatgacgattgtgtcagcccgccgtgcacgccaaacatttgctcgtaaatagccaataatacttgcgccaaaaagaatacccaggtaaatgctgaaaatggggatgaagctgagccagggccaaaagctgtcggcgaagtttgattcccgaagaagggcaattatccagccaaggtctaggagtagccataaccagatgccacctagtaaaatgggcgtgaggcgttcgcgtttgcgaagaactttctgtggagccagtaaaatcaacagcaacaggtctagcccactgaaagcaacgacaccaatgaggacccagccgatgtgggccacccattgccacgctgcatgatgagagaaactggctagtaggattagcaatccaccactgagacacgtgactacggcactagttagtccgcgtggttgccaaaaggtcagcagaattgagaggcagagtaagaatagactcgcactaatcagcatgtcgggtcctcctttcataaaagttaagtttttttgagagtttcatcaattgaacctatgcggtcagaaactcggtataataagtctattataacggaaaacggagggacttgggtgcctaaacatcgaagaaagtcacgtaaaaaaaccaacagccccgtcacggccacgtggatttttgttattgtcctgttggtgctaggcggtggcttattgattcggggaaaaataaaaacagagattcaatcaacacgaattaatcagaccagtagccaaactactgatggtgaaacggcggcccaacaaaagtttattaagaaaatggcagcccctgcagtccgcgtttatcagcaaaatggccaggtattacccagcatcgtgattgctcaggcaatcctagaatctagctggggaacgtcgggactattcttacaagccaataatccgtttggggtgaagggcgcctatcaaggaagctcgaagtccttcccaacaacagaatacgtaaatggtaaaaaaattacagttcaggctaattttcgtaactatccaaatctaacggcggccattttggatcatgatgcgttgttgaagaagagttattttaagcagaccgttacggattataaaacggcagctaaactcttacaaagtaatggttatgcgacagatcccaagtatgccaaaaagctggaaaatgtgattgcaacctataacctaaatcagtatgacacataaacacaaacccccagctcgctagactaatcagcgagctgggggttatttgtcgctaggtaattctgagaaattgagagtaacgctcactcgacttgaagacaaccaatgttagttttcgttgtagtagcgtgccaaatcatagagggttttggctaaagaatcaatggagcgggtaggactttggttagcgaataagatgacaccggttttgttgccttctgaaccataaagaatgttgttataaccggcaccagataaggcgccgcgaacccgcttgataccaccactgtaatgatacagcccgccggcataactgagtttgtagtcattcgccaagtcgtagtactgtgacttagttagaatcttaccattgcgtaggcctttttggatggtgtaatagtcactcggcgtggcgtaataattaccggctcctaatagggatgacatcaatttttgggaaacgttttgggcgacattatcctgaccattgctgtaacgatagccgttggcaacggtactggtactggggagcttattccaagcgtacgtatgggttaactttaagggtttaatgatccgattttgaatcagcgtgtcatagttttgtccggtgaccttcgaggctacggcggccaataatgtgtaattggcattggtatacgtgaaagaggtatcgccagaaactttcaactgggccaaggtgtagttgagctcagccgattgtgtgttgagtacggcagacggcgcggtttcatccatgtcaatgccagaacgatgattcaataactggcgtagcgtaatgtttttactattggtgacactcgggtagtaacgactcagcttgtcatttagtgacaattttttgctggcagccaattgttcaatgatggcccctgtcatgactttttgtaaagaagccaatgggaagagtgtcgtgttagtattggcaagcttggccgttgcatcggcactgcccacactaacgtggcttgccccggtggcgtagttgttaaatagcatggcgttaccttgaaaatgtgactttttcagcaaggcagcggcgttttgggaacgactatatttttgcagggccgcttgatcgacccacccaattgctttgccataccaagagaactgcgcaaagcttgagccattggagagcttggccaccttagtgactttaacgaaacgatgttgccaatcctttccactagcgtcgcgggtcttggctgaacgttgggtataatagggcgcatagtaatagatcccatcattacgcgttccttggttgttaaatcgcgcattgtagctggtgttttgcgtactggtaattgtcaaataacttttggcttcggccggttgggtggataatagaccaccagcaacacagagcccgcctaaaataaaccatagcttcttcataaaatccctttccctctttttaatgtcctcatggtaacgcggcttagttgcgaacaggtaacagaagcgtagcgttttggtaacttttttaataacttgggaaaaatggtgtgaaataacaccgactgccccgcgcctgacttacggaaaattagtagaatcaatcgcaagttaatggggaatatggtacactaaatccagcaaaaattaatatctgaaggagctgaagcaagcattgttacactttttgggtcaattgtacggaccgttctttgatctccataattgggaaactgtgattacctcaggcgacgattggctgattattttttcattggtcttaattgagtgccttttgtcagttgataatgccgtggttctagccgcacagacacagtcgttacctactcgtgagcagcaggaaaagtcgttgttctacggtatttggggggcttattttttccggtttgttatcattggattgggaacgtatttgattcatttctgggaaattaaagtcattggtgcattatacctattgtacttggtctttcaattctttacccggacccgagtcaagcatacccgtaagttagcttcagagaagaagcaccgatggttgcccttgttttgggccgtcgtgcttcaaattgaaatgatggatattattttctcggtggattcagtcttagcatcgttagctatttcgtctaatccagtcattgtgctaatcgggggattgattggtattctagccatgcggggagtcgccgaagttattatgcgcctcatgcagaagattccggagttggaaccaatggcctacatcttaattgccttgattgctgtgaagctctttatttcaattccagcgattgatattgagattccagccaccttgtttgggttgctggtagtgggggcaattattgtgaccctgattattcatgttatccgccggcgcacaacaactaaaaaaaattaaactgatggactacgagttgttcgtagtccattttttcgtcgtcccggtaacgagttagtggccggttcatggtatgatggaggcaatcaaaaacgggaggcagtgcttatgcaaatcggatttattggaacgggtgttatgggaacagggattgtcgggaacttgttgaatgccggacaaaaggttgttgtgtataaccgaaccaaagcgcatgctcaggccgttctggatgcgggtgctacttgggcggaaacaccacaagcggtcgctgctaaagcggatatcatcatgaccatggttggctatccgcaagatgttgaagacgtctatacccgagaggacggtatctttgcgggggctcgaccaggaagtatcgtcgtggatatgacaacaagtacaccggcgttggctgttaaattggcacaattggcgcacgatcatcaattgctggacttagatgcgcccgtgtcaggtggcgatgttggggccaagcaggcgacactgacgatcatggttggtggtgaccaggatgcctacgagcgtgtcttaccagtctttcagcagttggggcaacgtgtacattattttggtgacgctgggaaagggcaacatacgaagatggccaatcaaattatgattgccgggacaatgaccgggttaaccgagatgttggtttatgcgaaagcagccggccttaatttgtcagatgtgttagcaacgcttagcagtggtggcgctgataactggagtatggataactacgtgccacgaatcttaaagggcgattacacgccaggcttttttgctaagcacttcttaaaggatttacggattgccttacaggaagctgatcgaatgggcctagatttgccagcaacgaaacaagcaaagctactgtatgaagccatggtggatgactatgatttgggtaatgatggcactcaggggttaatcaagacttatgaacaacattaaggtgttggtgattgatagaatgtggggcaaatcggtcgcttaacgtagggatcgcgggtataatacaattcctcctaaagggggatgatgatgccagcaaaatttgaacgacatttctatcgaatggcgacgttttggttaggctgggcgttagtattaccagccacaagaatgttgtggttagaaccaaatgaaccattatggcagggcacttggcgtattttgctagtgtctctagggacagttagtctattaacctcactggttcgtgcgaaggtcgataagtgaaatcaaaacagttaaaaatgcgtgtcttgccaattggtggcgagacatgcattttttgaagggcttattcaatatcagcaaagaaactataaagcttttcggtggtcaaagcagctttggcttctccggctacgtcgaaagttacctgcccgtgatgtaagacaatgaggcgattaccataggttagggcatcctccaagtgatgggtgatcattaaacaagttagcttctcttgttgaacccgttcattcgtcaagtgcatgagatcttgactggtctgtggatctaaggcggctgtatgctcatccagcagtaggatttccgggcgtttgagcgttgccatcagaaagcttaaggcctgacgttgaccaccagacaagttccccgtagccgtagttaagcgactatcaagaccattatgcatggtagcagttagttcacggtagcggtcgagttgtttattaaggtgccggggccgtaatccgcggtgctgcccgcggcgctcagctaatagcagattctcggccacgttcattcggggagccgtgcctaattttggatcctgaaaaacccgggctaaaaaacgcgtacgtttctcgacagattcgtgggcaatgtccttgccattgaggaggatttgaccgctatcaatactgagatcaccaccgatggcgttaaataaggttgatttcccagcaccattagaacccagcacggtgatgaaatctccggcgttaatggtcaggttgagatgatctaaaatcatgatttcttcgggtgtgttccggttgaccttgaggacaacgtcttttaattcaaggagtggtttagtcattggtatctaacccccgtttcaaaatatgcttgaagttgagaacgttcttgaagacgggcaacatcatgcagagtgctaagacgaccgaagaaaccaagttcaaatcggtggcgttgaagcctagttttagcacgattaacaagacgaatcggtagaggatactacctaaagttacagccacgagccgttgatttaatgttaaatcaccaaaggccacttcaccaataatgatggaagctagagcaataacgatgatcccaatgcccatgttaacatcggcataaccgttgttctgcgcgactaaggcgccgccaaaagcaatcagaccgttagagaccattaatcccatgatcttcatgttatcggtattgattcccaaagagcgagccatggtttgattatcgccagtggcaatgaagccttgccccagttcggtttgtaagaaataaatgacgagagtggtgacgataatcatgacaccggcgccgaggacgacgctatcgaagtagtgtggtagagaggctagaaagtgggatttaaacaacgtttcttttcctaagagtgagacgttagaacgaccgctcataactcgtaaattgactgagtagcaggcggtcatcactaagattcccgctaatagaatgggaatatgccctttcgtatagagcaatccggtaattaacccggctgcggccccggcgataaacgccagcaaggttgccagaattggattcatgccgttactaatagccgcgacggcggtggcggcacctaatgggaaagtgccctcaaccgtcatatcggcaaagtctaaaattctaaaggtcaggaataatcctaccccgaggacggcccaaaggaggccttgtccgattgcagataccattaaactcatttaaaaacctccccgtgggtttgcgcttctttaacgacagatgttggtaaggtgatacccagctttttagctgctgataagttaatcgccatttcaccttggcgttcaaacttgattggcatggttgccgggttcttacctcgtaaaatggcggccgtcattttacccgtttcaactcccaattggtactggttaacgctgagagttgcaaggccaccagacttaaccatggtatctacggccggaaagacaggcaccttctgagcattggcagccgcaactaatgtttgcatcgcactggcaatggtattatcagttggcacgtagacagcatcaacttgggtgaccatttcttcggcaacctgattcaagtcgttggtattagcgattgaataggactttaagcgaacgtgttctttcttacataaagcaacgaattgatggtattgcgcggtggcggaagaatcagatgacgtgtagataattcccagcgtcttcatcttcggcataatttttttgatcaggtgtaactgtgatttgagtggtgcttgatcagagacccccgtaacattatttccggggtgacggttactcttgaccaagtctgctcctttgggatcagtgatagctcctaagacgatgggggttttgctgctagcgttcgctaacgcttgcgcagctggtgtcgcaataccaatcatggcatcggcgtcttcattgacgaaccgggcactcatcgtttttagattactttggtcattttgggcattttgataatcaattttgatgtttttacccacatggtagccttcctcagccaagccatgaataatccccttatgaattgtgtcaagggcagggtgagatagcagctgtaagatgccaactgtggggaccttttgccgggtagctgactggggacggctctcttgaacaaaggcaaaacagagaaaaataacaataattccaattaatccatacaggcgtttcatagcgcatcaacctcacttgattttttgcttatcgcgacaaaaagggcacccagaccggctgggtgccccaaagaaaaaggacccgcaacaccggataaaacatccgtgcaggcccatcagaaagttagccggcgcagatgcgaaaatcgctctgggagctcaagtcgcatctacatgatgacgacttgattaccggctttgccaacgtccattaagttcaaaggcagacatttgcatttcactttccttcctttccgtttcgaatagatatagtgtacggcattgctgaaaaaccgtcaaccatcttttgtagttttttggtatacttgagcgtaactaagcctgtccgtgaggctaagcccgccctctggtcgcggtaaattgtaccggacacggctttaagccaagcaacccacttgtcttaaagctcggtcttatcctaagcgcgctaaaaacgcgcgccaaggtcagtaagaacccacggcgggaggatggtcttgtcccatttccgtttgaaaatgaatctaattgaagaatagtttgaaggaggttgtgatatgaaagttgcagtgttaacggatacgtcagctgggattgaatttgtcgaagctaagcaacagcaaataaccctattggctgcaccgattatgtttggtaatcggcaatatcatgaatatcaagatttgccgacggccgattattatcggttattgcgactggctaagtctaaaaagttggtaccaaccgctccacagatttcaatgaagatggtgcaccagacctgtgatgagctagcggctacgggggttactgatgtgattgtaattggaccgtcactaggtatttctggatttgtgaatacgttagcggcctatgctgagaatattaccagtctccacgtatggccgtgggattctcgcggcattctgacaactatgggtgaccaggcgcgattagcggcaatgctagctgtgcaagggaccaccccaagagagattcttgaacaactgaaacgattacgggacacgacccatagtgcctttgtcgtggattccatcaaaccacttttgcgaacgggtgaagtgaatgggcatggtccgggcaatgcaccactattgcccggaaagccaatcctagtttttgaatcctctgggaaaatgcgggttgccggtagtgcgttgcggttaaagggtgcaatgagtgacttcttggatgatttggcggcggcattggccgaagcagtcccagtaaaagcgactattctgaatgccgatcagccagaaacgacggcacagtggttagcaactgctcagaaacggtttccgtcggttaaatttgatgtcgctgaaattgggccaagctttggggtacatgttggtgatggtgccatggggttggcctggagccaagattatcagagtctaatatccgttgaaaatgagaagtaaattaaaagttggggttgacagcctcatttttaaatggtttactaatacttgtaaattgataaatgaaagggaacttgccattatgcaatcatcatacctccaacatttaaatagccaatttgcctttagctttttctttagatagcgtttgtgttcagctcgctggatacgaacgcaccgcacaactgcgtttgtatctatcgattagctaaagtttttcaacatgacttagcgccagatagatacgggtataatctatctggagaaataatatcgggcccgataaaaacaccaggtagattctactttgaatctatctggtgtttttgtttattaaattaaaattgaggggtctcattatgaaaaaattattaatcagtagcatcgcactcttaggattagtcttagccggttgttccagtcattcatcatcgtctaacagtaaatcattgtcagttggtatcttacaggtggtgcaacatggctcactcgatgaggcacggcaaggattcaaggctggcctgaatcagcaattgaaagcccacgataaatcaaccaaggtcacgtatcactacttaaatgcgcagggcgatcaagctaacttgaacaccatgagccaacagttggtccagcaaaagaatgacctgttggttggaattgccacgccagctgcgcaagcattggctaagaagacgaccacgacgccaacgctggtgactgctgtgactgatttgaaatcagccggactggtaaagtctaatcaacagcccaatacgaatgtcagtgggacgagtgatttaacgccggttggcttgcaattaaaactgttggctagcatgtccaaaggcaacaaaccattgggaattatgtacaactcatctgaagaaaattctgtcttgcaagtaaacttggctaaggcctatgcgaagaaacataacttaaagctaaaggtggtcagtgcgacgagcaccaacgatgtgacgagtgtattggccggattaaccgggaaagtttcagggctgtatctgccaacggataatttgatggctagtgccatgaagacaattggtcaaaaggctaagaccgccaagcttcccgttgttaccgggtcaattgaaatggccgaagatggtgggacggcaacctatgggattaactactacgatttgggcaagcaaaccgggaagatggcttatgatgtcttagttaaccacaagaagccacaatctatggcggttgaaacctctaagaagctacatctgtacgtcaataaagctaatgctaaatccattggattagccacaaatcaaatcaagcaaccttaagaaaggggttcggttctatgttaatcaccagtatcggtcaaggtctcctctggacgccgcttgtcatcggggtctttatcacatttagaattttagatattcctgatttaaccactgaaggaagcttccccttggggggcggcagtgacggttagcgcgatgttaagtgggcagtcagctattgttgccagtctgttgggtttcttggcagggtgtatcgctggctgggtgacgggggtcttggatacgaagcttcatatgccttccttactcgccggtattctgacgatgaccggattatattcggtgaacatgcacatcatgggaaaatccaacgtgccactattaaatcaaaaggtattgatgaatgttttaccggcgagttggtcattagacctgcaaacgattgctattggagcagtggtgacgggattagtcattgtgctactcatctggttattcaagacgcgactgggattatcgttgatggcaactggtgataatccggcgatgggtgcggccaatgggattcataccgaccgaatggtgattattggttacatggtctccaacgggtgtatcgccttgtccggagcgctgattgctcaaagcaatggttacgcggatattggtatgggaattggcacgatcgttattggattagcctctgtcttagtgggtgaaatcttcctacacggtcgccagatgtggttacgattaaccgcgatggcgttgggcgctgtgatttatcgttatttattgaccgtagcgatgggacttggattcccagtcgatgatctcaaaattttatctgcaggaatcttagtcgtggtcatttgtctgccgattcttcgtaataagtaccggacccggcaacagttgaaccgttatctcaaacagattggagtcgatgaacatgcaacaaccagcagtcttaagcgtcaagcatctccagaaggtcttctttcccgggacagcaaatgagcgtcatgtgttaaaaaatgttagcttagagattacgcccggagactttgttgctgtcattggtaacaacggggcgggcaagtcgacactgttgaatacgattgctggcaccttgccagtcgatgcgggtgagatgacattagccggccatcgggttaccaagaagtcagtggcttatcgggctaaatggttatcgcgtgtgttccaagatcccaagatggggacggctggtgagctcagcgtggcctagaatctcacgttagcacaagagcacacggggagtatgagcttacgacgttaccgtcgggcagaccagctggcggcttatcaggaacttttgcggccacttgaaatgggtttagaggatcgcttgacgacgcaagttaaatatctgtcgggggggcaacgccaagcattatcgttgctgatggcaaccctcagtcagccagaattattattgttggatgagcacacagccgctttagacccgcagaccagtcaaaaagtgatggacttgacgcaaaagatcgtgacgagtcatcacctaacaaccatgatgattacgcataagatgagtgacgcattaacttatggtaaccggttggtgatggttcaagacggtcagataaaattggatgtgcgtggtgcgcaaaaggctaatttacgggccgaagatctgatgacgttatttacggtgactgattagcgagcacatatcatttaaagttggttaaatataaaagaagcttagaaaatcaaatactgattttctaagcttcttttcagagatatgctaataacgacaacgcgttattcataaaatgtaaggttgtgttgtatcgaatatcccggaaatgaagataagcccaacctaagatgcaaccgagtaatgaatacatgatccacgtggtagacagactggtaacatgcatgtagccgaagatcatgccagagaacagaacgcccaagacattcatgacgcgagaattttgccgaaaaaagtaattcagaaaaatgccgcgaaagatcagctcctcaatcactggtgcaaaaagaatcgaataggccagattccagaatggtaattgaacaatctggctattgacggccgtctggttagcgggtgttcccaaaatatgcgcgctaatcaagaggctccacaccatttgaataccatacatgagaaagaagaatgccatcagctggccaaaccgggtccccgttaatttggtacgaccaaagtggcggggattgttactttgtaattgtttttggtacctccaggtgatgaaagccaagacgaaagctgaataaatcagcatcatcccaatcgaacggttcaccacggtggggtgtttaacttgcatcgttgcaaacgataagatgacggtgtccacgagataaatcaacaggaagcccacccatctgaagcaacgggcaatccaatcaaagatttggttgaaacgattcacggcgaagcctcctatttctcgtatttgccgatttcgatgaggttttcatcaggatcacggacgtagactgaggtcatgggtcccagagccccctgtttcgtaaccggaccgtccacgatttcaacggcataattggttaaatgcgataagatattagccagagggtcggtggcaataatggcaaagtcagctgcgccaatcgtgggatgattagccacggggagatgcggagtatcgctctgttggaagttaagcttttgtttacccaccttaacgccttgacgaccatcgtcaaattcaatgatggggaggtcaaagacttcatggtaccagcgaatagaccgttcaatatcactcacagtcagggttaaatggtcaatattacgaatgttcatagtcagtcagtccttaagcagtaaatttcacctattatatcacagatgataggtagcctcctaggccatgaagttgacgaacccccgtatttcgtggtaagttactacctatataagttttaggattagagcctgacgctgtcgggcttttttctgcgtaagagaagaagggaaggatacacgtgccactattagaagttgacgatctcagtatgagcttcgctgataagaaactctacgagaatgccagttttaccctcgaaaagggcgaacacatgggtgtcgtcgggcaaaacggggttggaaagtcaaccttaattaagattattacggaacaggaactccccctaactgggacagttaaatggcaaaaaaagacgcacattggttatttggaccagtatgccgatattcctgatggaatgacattaattgattttcttcatacggcctatgctgatttgtatgccatgaatgaccgcatgacggccatgtatacggaatacgctgaaacgatgaacgacaagctcttagaacgcgcgggccggattcaagaagaactagacgcccggaacttctatgacgttgaaactgagatcgaacgggtgatctcagggttgggcctggacgatattggtcgggatcacgccgtcgctaagatgtctgggggtcagcggtcgaagattattttggctaagttattattggaaaatcctgacgttattttacttgatgaaccgaccaactacttagatgtggcccacattgcgtggttggaagattatctgaataattttgacggagcagcactcatcatttctcatgattatgattttttacagaatgtgacgaattgtatcatcaacgtggctttcggccaaattaccaagtatcggggcagctttaagcaagccatgcgccaacggggtgaacgtgaaaaggctcagcaacgggagtttgataagcaacaggttgtgatcgaaaaggcggaacgctttattcgaaagaacaaggccggttcaaaatcaacaatggccaaatcgcgggaaaagatgcttaatcgattggaccgggtcgatccaccttcgaccaatgtgcaagcccattttgattttccttatcaagaaacgggttcgcaaaatgctttagtcgttgacgagttatccgtgggatatgatcgaccattacttaaaccggtaaccttctccgtcacgaccgatcaaaaggtcgggttgaccggatttaatggtgtcgggaagtcgacattgattaagtcaattctggggattatcaaagctaagggtggcgaggcgcacttctcaccgtccgcacggattagctacttcagccaagatttagtgtgggataataaccagcaaacaccgctacaaattatccaagccaaatacgagaagttacctcaaaaggcgattcgcacgaagttatccaaatgtggtttggattccgctaacgcgatgaaacccattggtgagctctcagggggcgaacagaccaaggttaaattggccttaatggaatttgagccagccaacttcctgattatggatgaaccgactaaccatttggacgatgaaacgaagcaagctttaaaacaggcgattaatgactttcctggcaatgccatcattgttagccatgaggccagcttctataccgggttagtcgataagattttaaacgtggaaaagttgagtttgcgtaatggctcaaccaactagatgtcactgagattacgttttggtaaaaagcattccctttttcagaaaaatccgttagagttaacgctagagatgaaaaaatcgataaaggacggaagagcatgagacgttttagacggttattggtaattgtcgtattaattgttgctgtggcagcggggattaatcgtgtgattcaaaagagttcggcggatgatgcgacccagtcgaccgcacaacccacgaccaagaaaaaaacaaccaccacgaaggctaagaccattaactggcgtcagccgtcagaaaacaaagcctatccgaacttgaagcaacatccggatgcttggctggatgttaataccagcaaacaacgggtctatattcgggatggccaacagattctatacacgatgtattgctcaacgggggttggtaagaacaagacgccgcatggaacgtaccatattcaagcggaacgcggcaagttcttctataaccaaggttctggtgaaggggcccgttattgggtctcttggaaagaccatggaatttacttgttccacagcgtgccaacggatgccgacggtaattacatcaagaaagaggctgaggaactagggaagactgccgcttctcatggatgcgtgcgcctgtcagttgccgatgccaaatgggtttataatcacgtcccttatgggatgaaagttgttattcacgattagaaatcagcgggatcgctacagcgaaagttgtagcgatttttttactataagtaactaaaaaaggattgttaagcttaaaccttaaattgtgtcaaaaataaaaagccaaccatcgcctttcagcgtcggttggctttttagattaatcgttaaaattattggcttccacgtcgcgaataaacgttgccaagtgatcgtaatacacaggggcattatcgatcatgtggtggtggccaccttcaggggtagtcacaaagcgagagtgagggataagctctgccattttctgaccagttgccaatggcatggtttcatgttccccaaacgtcaagagggttggcacttgaatatccttcaaatgatcacggaagttccattcagccagctttcccttgatgacaaattcattgtcaccttggaaggcaccatagacgtcagttgccatcgtactgatgaggtgagaaatagcggctggctttttccggtcaacgtaaccgtcatttaagatgtcaacatagctctggtacttggcatcgtcgtagttaccttcagcctcgatttgtttcatgtaagcgacttggtctgccgttaaagccgtttcccgaatatggttaatactttccacgtattcgtcaatgttatcgaccatggaggaaataatggcgccctttaagtgttgaccatacttagctgcgtacatttgaaccagtgcgccaccccatgattgaccaatcagatagaagtcatcaatgcccagcttttgccgaacttcttcaacttcgtccaagtagtaatcatacgtgagatacttcttagcaatttctgggtcactgtagtcaggttgatcagaataccaagaacctaattgatcgtacatgtgaacttgaacgttcaatccttgggcggccaactgcttagccgtgtcttcccagtattcatggttgccaccagggccaccgtgtaaagcgagtaaatgaatgtcgccagtgccttgggtattggtccaaagatggtagccgttatcaagtgtgataattgtggtcccttgtttcatgaaaaattcctccgtttctgtcaatgaagttaattattagtctatcactattcgcgtgaattccaaactgtggtggcttaatcggtgatgaatggtacgtgaagcgccgactggcctaactgaatggagtactgcaaatcctgattaccacggacggtcatcccaaagtcggtcgcataaataacgagccccaattgatgaccggctagtaaccggtagtgggtgggctgtaaggtgacactcaaatcatagaaggtattgggtttgagttcatccacttgataggcgttggttcgattttgcagattccggtgacctttggtaatcattttccatggcgtggttgcagccacagtaaattcgcgcagattgtcttcacgccagcgatagccttcatccaagcggatccgtaaaggtgttggactgacgcctaatcgtttagcatcaccataatcgactaattggaaactgagcagtcccagtggctggttaaccgcgacttgcaagtcaatggtgggccgaccgtctaagaccaagtcgtcggtcaaaacggccgatttgaacagcagccggtgcttaaacatcgcgttatgtttatcgccgagtaaatcggcttgccactcgtcaatgtggtgcgtgtaatgattaaattgatcgactggtaattgatcgttaaagctggtggccgccgcaggggtgtgatcactgggggcgactaactcgtcagcttgaaggttaaagtgctgaaccggattgctaggggcatcccaatcagggtacgcttgccaggtttctggcgtcacattatcttggatgatgacattaggcaataaagtttcagcgtgattgtcaacgcctaacagttcatgcgtcagccataggtttacgatatccgtgtagtcaatcgaccgaaaggcattgatataaatatgctggccttgatgcaagatcagtttcttagtcacgggcaagtcgcgcacagcccgccaaagattattgacatttcgtggttttacattccagtcgtttaacccgtggacgagcaacagatcagctttaatatttttggcatttttgagatagttgcgggcatcccagaagcggttgtaattgccggtcactcggtcttgattctgagtgatggcggctaactgatgttgccatttttcttgaatccggtgataatcaccggctagaagttgccgactaaaggtttcttcggccaacacgtcggcgtcttcaccgggaaagccccctggggcaacgaccaaaccgccatcacggtaataatcgtaccagttggaaatggctgcttcactgataacggttttaagaccagctaccccagttgttgcggctgccgttgctaaggtgccaaggtacgaccggccggtcatggcaacttgatggttactccaccaagccggaatggcctgagttgcattgcgggtagtaaaggcagtgcggttgccagctagccattcaatgatggcaattgttgaggtggtctcttccggatcgccagtggtccgtaacccgtctgagtctttggttccaataccggccgcgtagacgacggcaaacccccggggtaagaaatagtcgttgagggtgtatgattgctcacgagcaaacgtttctgccgcagtgtgggttgtcgctgtcactggccgtgcatctggcagcggggtggtcactggctcagccgtgacgtcggctaaggttgtggccgctggctgcttggcagtgagcggaacgttgacgttgtgtgtcagggcttctcctgcctcgtcgttagtcccctgattgtaaggactagccgtatacaggaccggaaccttgagtccgttagccgtttcagcaggtcggatgacttcggctttgagcaagtcacggtggccgtcatgatccgtatcctgcgggctttcaacgtaaaccacttcatgaattaattgggtcgtatcaaagacggcctgggccttaccattgaagatgaggggcttaggcacgctgttatcatgaatgagtggtgcaaaataaccgtgtgtggtcaattgatctaagaaagtctgaccagttttgttgtgcgtggtgagtaagacgtaccacgcattcattaattcatttaaagtaaaggtcgttccttcatggtcagccacgggtaattgaatcttagtcatggctgctaatggatcggtgagctgaaagtctaaatctaccgcaaagccgagtcgttgcagggccagattatagaagacatcaaccgggacctgctcatgggtggtcaaataggttagaccatcagtttcaggcgttgccatgaggttactgagctgttgagcaaccacgctgctggtggtgtactcgggccaactccggtcgtagaaatcccgtagaaggtcgcttggcgtcgtaaatgacagattggtgtcatctaagaagtgaatctgttgaagttccacgcgcgcttgatccagcgtggttggtcgaattgcaaattgttgattgcgcataaatcttcgcctaccttttaagttagaaacgagtgactaggcctggtcgtttaaacgactgtggcgcagaccataactaaagtaaataatgagtcctaatgcaaaccaaatactagaggcaatccacgtttccgcgggaagctggagcatcatgtagaaacataagagtccagagacaatgggtaaaacgggataaaagggaacttggaatcccgtattatgcggcaagttatcgagatgtcggagccggataatcccaaaggaaacaaagaggaaagcaaccaacgtcccaatattaaccagattggtcaattgagctaaggggacgaagccacctaaaacagcgatgaccacggtaatgacggctaaactgtgtttaggtgttccggtttggtgatcgatttttcccaagaacttaggcaataagccatcgcgaccaacggaatagatgagccgtgaagaactatagatcatggtgaccatcatggtaaacatgccggccagcgcacccaatgagataatgccggaagtccagttttgatgaaccagcgttagggcaagggctacgggatcggcaacgttaagcttggtgtaatgcaccataccggttaaaacgatggccaccatcatgtagaggacggtagcgacaatcaatgttccgataatcccgatgggcatgtttcgcttggggttcttgacttcggcagctgaagctgagacgacgtcaaaaccgagatatgcgaagaaaacggtcgaggccccccgaagaattcccttggaaccgaatggcgcaaatggttgccaattagcgggtttaacataaaaaatgccgaccaccacaaataaaataataatagcaattttaacaatgacaatcgcgttgttaatccgcatggattcgcgcataccacgattcagtagccagctgatgaggaagacgactaaaatggcaatgatattgccataggtgccatgactgggatcataaggtcctgtgatggcagtcggtaggttgaccccaaacccagctagaaaagatttaaagtaagcgccaaaagcgttggccacggctgccacagctagcacatattccaaaatcagtgcccaaccaagaatccaaccgatgatttccccgaagacgagattaccgtaagagtaagccgatccggccactggtaaaaccgaagcgaattcggcgtaacacatggcggccgttgaacagaccacagcggctaggagaaaggataaaacgatcccggggccactatactgggcagcaattgtccccggaagaatgaaaatcccagtaccaatcacggcaccaatcccgagtgacatcaaatcttttgctgacatggtcttggcaaaatgctggtcactttttaagtaattatctaaattttcgcggcgaaagatgcgcgcaagtcccataaaaaccctccttaataaatggtgatatctcggatagtgtaccctagagttaaattaaaagtcaatgagagttgggacttgttttaacaaaagtcaggtaaaggactcccattacagaccatttcgatttaaaatgaaaggagtttagtcaattctgaggaggcaatgacgcatgattaccgaaagagcaagtggggctgtcgtgtaccggctggtagatgggcgacttgaatatttattgttaaaaagtgccaccagtaatttctggggtttccctaaaggccatgtcgaaggggacgaaagtgatctgcaaacggccgtacgtgagataagggaagaaacccaattagatgtagccatcaatccagactttcatgcagatttggattatgacatggttaatggccaccataagcatgtggtcttgtatacagcgttagtgccagcggacagtgtcattgagcgacaaacagttgaaatcagtgcgtttgactggtttgattacgcgacggcacgtgacacactgagttacgacaacttaaagggcttgctggatcaagctaatacctatttggaggattatcatcatgcataaggtactggtgattaccggcgcaacgggaacgggaaaaaccaccgtccaagattacttggttaaaaactaccctgtgacaaaaattgtgacccatacaacccggccaccacgtcagggagaagttgatggtgtcgattattactttgaagatgaggtaagcttccaacaaaagcactacttggaatcggtcgtatatgccggttatcattacgggtcgtcgcgcgaaggaattgcggcaggatttgaacgggcgccgtttgctgcgattgttttggataccaaaggcgcgatcacttacgcccaagagttaggcgatcaggccgtgattattttcctaacagttagtgattcagagcagttagcgggtcgattaagccaacggggtgatgacaaatcgatgatggctcagcggttggctagtccagagtatcgccgtgatttaaagatgcccttagccttaaagggccgggctgttcaactaaacaatgatcattggcaacagacacaactcaagttggatgcgctcatgacgacgcttgagcaagaccaagcagttgatagttgagtttcgcgataaatatgctaaactaacaaggaattcgggtttcaaccgaacgggttaccgacagggttaggtctaacaaggaggcacccaaaaatggcagaatcgctaaccgccgcaatgacgattttacggcagaataaattaaaaataaccaagcagcgtcacgccttactagagttcctattaacgaatcaggcacattacacggatgtggttacagttgatgcttacatgcgaacggaatttcctgggatgagtcacaatacggtttatcgtaacttgaaagagttcgaagaagtgggaatcgttgaacagaataccgaacaggaacggactcgcgtgaagtatcagtgtgactttcatcatcagcatcaccatcatttcatctgccaaaattgtggcaaggtgattgaattacagatgtgtcccatggacttttttacggctcaattaccagactgcaagataacgggacacagctttgaactttatgggatttgtggaacctgtcaggcggcaggcgtaaaagagaccactttagttaaaaattaaggtaattttgaaaaaaacttgagcttcttgtggcacaataatagaagtaggtaaatcgtaaggaggaattgtgtatggcgtatcgaacaccaccctttatcacgccatttgccattgtctcgatggcactagcgctcggggcaacgaatgtggtaaccaatacggtgaccaagacgaatgaaggggccgcacgcgtttcttctactagctcgtctctggtcagcggcatgtcatctaatgattcgaagaaaaaagccagcgatgacagcaagaaaaaggattcagattcatcaaagaaatcttcagatagtagtgactcctcttcaaaagacagtagtagtgagtcatcgacgacggatacacaaagctcatcggctaatacgacttctgagaaggagtcttctaatgggacgactgggaatactggatctacgggaaccacgtccaaaaagaagacgtcatccagtgcggctagttcatcagatgggacgacgaatgatacaacggacgatacgactgataatacaacgaatgatacgactgatgatactggatcgggtacgtacagccacaatacgtatagtgcaacgactaatggcaccaatacgactgatcaataataacgaaagggggatcggtaatgctaagctttcttgatatggtcaaccattacttaggttatatcaatgtgaatgccaagattaagaatcgggtttatgtgattctaggggccttgggtgacctctatttgttttatatcgccattcgttatctgcaaaatggtcatccattttgggggttactaatcttgctggtggccttactgctcttgtactttgtgtacttgaatggcatgtattacttcacagaaaaaaaggcgcccttcgatatttctccgaaaattgaaaaatggctgcacattaagcctaaagaagaggagacaaccgggcagcagactattcatggccggaatatcccggctaatggctactttgatgaaaagaaaatcttgccaggaaaattagcgtcaacgccaagtgatgtgcaaaatattcaaaatttggctacgcaattgcaacaagctcggctcttaaagctggattattctggcttgggtgatcgtgagattatggagcaaacgactaaaacgggcaagccggtttatgcgtcaggaccgggaacactgattccttactttgagatgcagccggaaggtaaccaattggtggtttatgccggaatcaatcaagctgataagcagcgggttggtacggtcagcacggtgggattgcagagcgtggccgatgtgcgtgatcaatttgaattgtacctagctaacgcgacgttagtaggtggtccctttaaggtgttaggccggacatcaatgattgaacaggctaacgattttgaagtggccgttcagttggcgtataagcatcagcgggatcgcgccacaggcgatcggaagtcgacagctggtgaaggcaggcgtcgggcccgttattcgaccgatagcactgaatcatcagcgactgatgaaccgatgacacggacgtctcggtatcatcattaaggcattctgcgattaatggcaagcagtgatttgccgatccagaatttcaatacttgaataatacagaaaggctgagacttagttctcggccttttttgctgggaacagcgtcaaaaataataagtgttagaatttataacattaaactgtcaggtgctttcttgaacataattttttttgaaaggtgttaagtccgtggtatacctaacttttaccccctcaaaacatcagtagtgagttgtatcttaaggttgtttactttgaccgggtaatttttttggtttaaactttaatttagcaactaaaaaccagtcctacgggattggtatggagcgctagtccaccgaccgaacggtaaactttaactagtggagggaatacttatgtcaatgattgaatttcacaacgtggaaaagtattacggtgattttcacgcgctacacaatattaatttaacaattgaggcaggggagacggttgttctaatcggtccttctggttctgggaagtcaacgttaattcgaacagttaatggtttggaagaaattcggcatgggcaattgattgtcaatggtcaggatcttgccaaccccaagacggatatgaaccggattcgtaagaacgtgggaatggtattccaacactttaatttatacgctaacaagacaattctggaaaacatcatgttgtcaccacgaattgttttgcaccgtggtgaagaagagaataaaaaagttgcgatggaaatgttagatcgggttggcttagctgaccaagcaccgaagatgccatcacaactttctgggggccaacagcaacgtattgcgattgcccgctcactggcaatgaagcctaagtgtctgttattcgatgagccaaccagtgcgcttgatcccgaaatgattgatgatgtgctgaatgttatgaagacgattgcgcaagactccagtatgacgtcgcttgtcgttactcacgaaatgggcttcgctcgagaagtggctaaccgagtaatcttcatggcggatggacggatcttggaagatgattccaaagagaagttcttcgacggtgaaccaagtaatgaacgggctcgtcaattcttaagcaagattattacacactaatcaggggaggaaagctcgtatgaaaaaatggattcgtagtttgagcctcctactgtcattggttgctttaacggccgttattagtgggtgtgggagtacggcgttgtcttcacgaaatgtttggaagacggatcaaaagtcgaaaaccattacttggggggttaaagcggatacgcgattattcgggttgctagacaccaaggacggtaaaatcaagggatttgaagtagatttagctaaagcattaaccaagcagatgctggggaaaaatgccaaggccaagtttatccaagtaaccagttcgacgcggatgccgatgcttaaaaacggcaatatcgatgccattattgccacgatgaccaatacagcagaacgacgcaaacaagttgatttctcgaatacttatttctatgccggccagtcattattggtaaagcaaggcagcagcattaagaatgtcaaagatctgaacaagcaaaagggaacggttctaggggttgttggatcggattccgttgaaaatgttcaaaaggttgcgccaaatgcaacggtcttgcagttaaccgactatgcgcaagcaatgactgcgttgaagtccggtcaagggcaagcgttaacgactgataatgggatcctttacgggatgtcagtacagaacccgggctatgtagtcaccggtggtaccttcgtctctgaaccctatgggattgctatggataagaaccaacaacaatttgaagcagccgtcaatcaggctttaaaggaagttcgggccaacggcgaatacaacaaacttcttcacaagtggttccacaacgtgaagggctttgactacgaggaggcggctaaagaatgattcatatctttcaaacatatggaggcacactcctttatggtttaggccagacgttgttatgtagcctgttagcactcatctttagcttgattattgggacattctttgccttgctggaagaatcacctagcaaatttggccgtggtgttgcacgagtttatattgaaattttccggaatattccgctactggtcatcaccatgttcttttacgtggttttcccgctgtatgtgatcaaaatgaacggatttacagctgggacgattggtttgaccctgtacacgtcagcctttattgctgaaacggtgcgggctgggattcaatcagttgatccaggacagatggaaggggcccgggctaacgggctatctttctggcaagctatgcgctacattgttttaccgcaggctttccgttacgtgattccaccactgggaaatcaattcgtgaacttggttaaaaactcatcaaccttagccttcgtgggtgggtttgatctgatgtaccaagggaatgtcattgcctcgagttctctagagactatcgcggcgtattcagccgttggggtgctttacctggtgatcacgatgccgatcagttactacatgcgctacttagaaaagcgcttagcttaaggggaggggacatattatgttgcaaaactttatcgcggcttactctccggataacttacgctacctgttcggtggactaggcattaccattttagtatcggtgatttcaattatcggtagttttattatcggctcgattctaggagtcattcgttatgtcaaaatcaagtatgtatcagccatcgttgggtttatcattgatgtgattcggaacctgccattgattttgattctgttctttacgtactttggactccctaacttaggggtgaagcccgatgtcattccggcagcgattttggccatgaccatctttgaatcaacgatgttagccgagattgtgcgttccgggattcaagcggttgatccaggccagatggaaggggcccgggctaacgggttaacgtattggcaagcactgtggtacattgttctgccacaagcgctagttaagatgattccagcgctagtgagtcaatttatttccctggttaaggatacgtcattggcaacgattatcttgctgccagaaatgctcttccgctcccagattatctatgggcaaaataccaactacattattccaatgtttgtggccattgcggttatgtactttatcgtttgttacttgttatcagtactagctcggtacttagaaaagcgccaagcttaagttgaattggtttaagacaaaaagcacgtcagaagttaatttctgacgtgctttttcgttggggctaaggggtgacaacatactgcttgaatcgattgaagtcggtatcttggagttccacttttagggcggttcctgtcgcttcataacccgttgataagacattagcgtgatcgttcaagtaggcgaccacatcaccatcagcgaagggaattaagaaatctgctgtgacatagttgtgaaagaccttttctttgagcgtctgaaccagtaatgcaattgaggcgggatcttgtgccgaaaggattaactggtcacccgctcgactgggataggtggcttcagtcaaatcagccttattgaagaccgtgaccatgggcacatcggtaaccccaatgtcgtgcaaggtttgttcggttgtagccatcatagcttccttgttaggatcggcgtagtcaacaacttgaaccaaaagatcggcattggcggcttcggccagtgttgagcggaaggctttgaccaattgtgtgggtaattgactgacaaacccaaccgtatcacttaagagcagtttcttttgatcggggaacgttagctgccggacgctagtatccaacgttgcgaatagcatatttttaacgaagacttgtttttcgtcacttttaccaaattcacgaactaatgcattcatgagcgttgatttgccggcgttggtgtaaccaaccaaagccacggaaggcagttggttacgctcacgttgttgccgttgcgtcgctgccgcttgattaatttcttttagctcatgattaacgtgggtgatggcgcgttgcagggttcgtcgactgatttcagtctgtgattcaccagcaccacggttggtaaagcccccaccgccgccactcccagtctgttgatccagacgttgtgaagcactggtgtgtagccgcggtagctggtactgtaattttgccagttgtacttgaagtttggcttcgcgagactgggctcgattggcaaaaatttccaaaatgaggccagtgcggtcgatgatccgagctttggttaccttttccaaattacggatctgactaggcgtaagttcatcgttaaccacaacggtatcgacgccatcgtcagcgacaatcgttgccagctcttcaacttttccggtaccaaagtatgtcccgggttgaggccgtgacagggcctgctgcacctcttcaacgacggtcatgtgatttgcttccaccaggttctttaattcagccattgcgtaatcaaatgtcgcttgaccagcatttaacccaattgtgatgaccggtgttcgtggggtttcttccaagagatcaccctccttataaatgtctatgtgttgagtataccatgccgaatgggattccagtaaggattagcggtggaagcccaaaatctagctttaatcagtattaaacaggggaacagatagaataaatgccttaaattaaaattcggtattgattctaatctaattttaatttatagtagactgcatacacaagaaccactgaggagttggaatgagtatgcaggttagagcaatgatcaagttaggcacggtggccgcgctaacggcgatttcgttagcggcgtgtggcacgtcatctaagcagtcacagaatcaaaccttaacgtggatggagacgtcgtcgctaccaaccatggataattcgttggcaacggatgttgtttctggcgagaccctgaataacacaggtgagggcttgttgaagtttggaaagaatagtagtacccatccgggggtagccaaaagctacagtaagtcgaaggatgggaagacctatacgtttaatctccggaagtccaagtggagtaacggggatcaagtaacggccaaagactttgtctatggttggcaacggacagtgaacccgaagaccggctcgcaatacgcttacctgtatgctgatgtcaagaatgccaatgccattatgaaagggaaaaagccggtttcaacgctaggcatcaaggcagttggcaagtacaaagtggttgtaacgttaacccacgcggttagttatttcccaactttggttgcccaaacagccttcttcccacaaaataaatctgttgttgaaaagtacggcaagaagtatgccacaaatgctaaggacaatgtctataacggagctttcaagctcacttattggacaggaacatctgataattggacgctgactaagaatccaagttattggaatgccaagtctgtcaaattaaagcacgttaagtttagtgcggtaaaggatccgcagacggcgttgagtcagtaccagagtggcaagctagatgccatttacttgagtggacaacaacccaagaactacaagaacagtaaggattaccacgctcggaatgggtcacgagtggcttatcttgaattgaatcaaaagaaggactcaatgttacgtaataaaaaggcgcgtcaggccttatcattgattattgaccgtaagcaatttgtcaataaagttttagataatggttctaagatcgctaatgggattgttacaagtggactggcaatccgtaatggtaaggactttgcgagtgaagctagcacggctagcgcaacggagcacaatattgctaaggcgaagaagctatggaaagaagccctaaaggaaacgggtcgttccagctactcgttgaccttaatggctgacgatactcctgaaggcaagagtacgactgaatatgttcagagccagtggtccaagttacccaatttcaaggtgactaattcaaatctaccttacaagacgcgattagcgcgatccgcagcaggccaatttgatgcagttgtgacactctggggtgcggacttcccagatccaattacggatctatcgctatttacatcagataactcatacaataatggtaagtggtccaacaagcagtatgatcagttaattaaggccgcgaccaccactaacgcgaacaaaccggcggcccggtggcagaatctaatcgatgcgcagaagatcctattaaacgatcaagggattattccagtctaccaagcaggcaaacctcaattgatgaaatctaaggttaagggcgtcgtttacttcccggttagttcaaattgggacttcagtaaagcttacattgctaagtaaattgtgttcgttgatgggtaacaaacgtgtgggcacgttcaacgaagcgctgataaaaagattcgagacaaggtgtctcggatctttttattaatgacgatgtctgtctgaatagaaaatgagtggataaggtgaatgttcgccatttttctgtatatggtatacaaaaaaagcatgtttatcctcagaaaaatgtgacatcgaattttaatttttcattttaattccttgatatataaggattgttgaaacttttttaaataaaattagcttttaccattgattttaattgttttctaatatacaattggaaacatcaaatttgaggttgtcaatttatttcacacacaactaagaggggttggaattataatgaaaatcaattcggcagttaaactgggaacagttgcaactttcgctgctgtgctactggcagcgtgtggatcaaacggcagttctagcaccgccagcaagcagacgttaaactggatggaaaattcagcattaccgtcgatggatgcttccaccgccaccgatgtcgtttccggggaaaccattaacaacactggtgaaggtctcttacgaattggcaagaacagtaagacgtatcctggggttgccaagagctacaaggtttccaaggatgggaaaacttacaccttcaatttacggaagtctaagtggagtaacggggaccaagttacagctaaagatttcgtttatgcctggcaacggacagttaatcccaagactgcttcacaatacgcttacatgtatgcgccagtgaagaacgctaacgccatcatcaataagaagaaggctgtttcgacattagggattaaggcagagggcaactataaggtggtcgtcaccttaactaaggccactagttacttcccttcattggctgctagtccaatgttcttcccacaaaacaagtcagtggttcaaaagtacggcaagaagtacgccactaatgctcaagacaacgtctataatggaccatttaagttaacgtactggaccgggacgtctgataattggagcatgagcaaaaactctagctactggaacgccaagaatgttaaactaaagaagattaacttcaagacgatgaaagatccgcaaacggctttgagtcaataccagagcggtaagttggatgcgacttacttgagtgggcaacaacctaagaactacaagaacagtaagcaatatattgaacggaagagtgcttcaaccttctacattgaattgaacgaaaagaaagattcaatgatgaagaacaagaaggctcgtcaagccttatcattggcagttaaccggaaccaatttgtgaacaaggtcttacaagatggttcaaccactgctaagggtctagtttcaactggtttagcttcttacaagggtaaggacttcaacacggatgctgcggttccatcagcgacgagccaagacttaacgaaggctaagaagctatggaaggaagccttaaaggaaacgggccgttcaagctactcattaaccttaatggctgatgatacaccagctggtaagaacattactgaattcgttcaaagtcaatgggctaagttacctggcttgaaggtgacaaacagtaacttaccatttaagacccggttagctcgttctcaaagtggtgacttcgatgctgtggtctctgcttggggtgctgacttcccagatccaatttccttcttgtcactgttcacttctggtaattcgtacaacaatggtcgttggtcatctaaggcatacgataagtatatcgcagccgcaactggtaaggatgccaacaacacggccgctcgttggagtgacatggttaacgcacaaaagacgatcctgaatgaccaaggaattatcccaatttaccaacaagggaaagcacaattggttaagtcaaacgtcaagggattgacttacttcccaactggcgctaactgggacttcagtacagcatatatttccaagtaagctcatcacttaagtaattgttttcgtcgggtgaccgactaaataagtcttaccggggagtaaggattaacgggagttggtccttacttttcgatgttattgcaggctttttatcatcttgttgttttcgtggagttcttgttaagtttcgtaacttaacggtaacgaataagtctactgattgagaggtaaacaaatggcaaagtacctagcaaagcggatcttctacctgatcctgactttattcattgtgattaccgtgacgttcttcctaatgaagttattacctgggacgccactgaccaaccaagctaagctatccaagagccaaattgcgttgatttatcagcaatatggtttggataagcctgtatggcaacagtacctgttgtacattgctggggcggttaaaggaaactttgggacctcgttccagtttagtgatcaacccgtttcctacttgatttcaagtcgtattgcaccatccttgcagattgggctgcaagccatcatccttggcgtgctcgtaggtgttatcatcggtgcctttggtgcgatgcgacaaaactcttgggttgatacgacctcaacgatcgtttcgattctgggaatttcaatcccgtctttcgttttagcggtgttacttcagtattacttaggactgaagctgggctggttcccaattgctgaatggggtggttttagttatacggtgctaccaaccttagcgctggccgcaacaccattagccgagtccgctcggtttgtgcgaaccgaaatggtcgatgtgctgagttcggattatattgagctagctaaggccaagggattaagtcgtacgggggttatttaccaccatgcgctgcggaacagtttgattccgttgattacgattgtgggtccattagccgtgaacattatgactgggtcgatggtggtggaaaacatcttctccattcctggtattggggaacaatttgttaagtccgtcttgaccaatgattacccaacgattatgggcttgaccatcgtgtactcattcatgttgtgtgtggttctgttgttcactgacatcttatatggtgttgttgatccacggattcggctcacaggaaaggctaactaggaggtaaataaatggcagatacagtaaaactccctgaagatagctttaaaccgatgacggccgatgaccgggcatcgcttgacagtgaaaagattgccgcgccatccttgacgtttacccaagatgcttggcggcggttaaagaaaaataaaggggcttgggtgtccctgattatcttggcgattattttcatcatggcctttggttcactcttcgtgtcacctcatgatcccaatgcggtgcacccatcgtatgcgaacttaccgtcaaagattcccggtgtggggattaacggattcaatggaacgctggttcaagcgggccaacgaattgatgcttatcaacaagccggggcttctggtaaggcctacatcatgggaactgactatttaggtcgggacttgttctcacgggtcctttacggaacacggatttccttgattattgctttggttgccacgctatttgatttaacgatcggggtaacttatgggatgttctcggggtggaaaggtggccgtattgataccttcatgcaacgggtcatcgaaattatcctgtcaattccaaacttggttgtgatcgtgctgttgattttgattctgaaacccgggatgacctcaattattattgcgattgcgttaacctcatggaccaatatggcccggctggttcgagcgcagacgttggaattaaaggagcaagaatttattctagctgcgaaaacactgggtgagagtccgttgaagattgccttcaagcatttgttacctaacttatccagtgtcattatcatcaatacgatgttcacaattcccaacgccatcttctttgaagcaaccttgtcctatattgggatcgggatttcttcaccacaagcttctttggggacattgctaaatgatgggcaaaagaacttccagttcctgccataccagatgtggtggccagcactggtcctatgtatcatcatgttagcctttaaccttttgggtgatggcttgcgggatgcctttgatccgcggacgaaagagtaggtgaccggacagtatggaaaatgaaaataatgtgttagaagtacgcaatctccaagttaacttcaaaacctatgctggtgacgtgaaggccatcagaaacgttagcttcgatttgcgaaaaggcgaaaccttggcaattgttggggaatctggttccggtaagtccgttacgacgcggaccatcatgggcctaaatgcccgcaacgccgatattgccagtggttcgattatgtacaagggcgaggatcttctaaagaagagcgataaagatatggaagccattcggggccaagatatcgctgaaatcttccaggacccaatgacctcccttgacccaacgatgaagattggtcggcaaattgctgaacccctcatggtgcacaaggggatgaagaaagacaaggcttgggcgcaagctttggaaatgatgaagttagttgggattaccgacgctgaaaatcggattaacgactaccctcaccaattttctggtgggatgcggcaacggattgtgattgcgattgcgctgattaactatccagacgttttaattgctgatgaaccaaccacggcgttggatgtgaccattcaagcccaaattctgaatttaatgaaggaattgcaggataagatttcaacctcaattatctttatcacccatgatttgggtgtggtggctggtatggctgatcgagttgccgtgatgtacgcgggtaaaatcgttgagtacggcacggttgatgaaatcttctataatccaaagcacccttatacgtgggggttgcttagctcaatgccaaccttggataccggtggtgatgaattaccatcgattcccggtacgccaccagatttattggatccaccaactggggacgcctttgctgcccggaatgcctatgcactaaagattgatacgcaacaggaaccaccgttctttaagatttctgatacgcattatgcggcaacctggttgctgcatccggatgcccctaaggttacgccaccagcacaaatcgtggcgcggcaacagcaatatgctgaaatgaatcaggaactgttagccaagcaacggactgccggtccagttgaagaagaggaggaacagcaataatggattacgaaaatgccgaaaaaatcctcgaggttaaacacctcaaacaatacttcaatgtgggtaaggctgatgaagttcgggccgtggatgatatttcctttgacatctataaaggtgaaacctttggcttagttggtgaatccggttcagggaaaacaacgaccgggcgggccattattcacttgtatgagcccacctctggagaaatcttgtttgacggtaagaacgtggatagttttaccagtaaagctgatcaacgtgaatttcgtcaggatatgcagatgattttccaagacccttacgcgtcactgaatccacggatgaaagttaaagacatcgtggctgaagggattgacatcaatcacttggcgaaagacgatgctgaccggacgaaaaaggtcgaagatctattggagaccgtggggttgaacaaggaccattctagccgttatccgcacgaattctctggtggccagcggcaacggattgggattgcccgggcattagccgtggaccctaagtttgtcattgctgatgaaccaatttctgcgttggatgtgtcaattcaagcccaagtggttaacttgatgaagaagctccaacgcgaacagggcttaacgtacctgttcattgcccatgacttgtcgatggtgaagtacatctccgatcgaattggggttatgcattacgggcggatgttagagatcgctgattctgacgaaatctatgcccacccattacatgattacacgaagagtctgttgtcggctgtgccggttcctgatcctgagtttgaacgggcccggcaagagattgcctatgatggtagcggcgaaaatgatggtaaggaacgtcatttggttgaaatttcaccgcgtcactgggtacgagcagctgatgatgaaattgatatgtacacgcagcgagctcatgaggcgtcattgattaagaagtaatccaaaaacagtcatcgtccgattgggcaatgactgtttttatttgctcacaaccaaccgtcaagaattaggcgagttaatggcggctagaattaaattttaccatcagtgttgttgtagtagtcaacgtggtaatgaccatcattgactgatagcttggtgatactgccgttatcgacgggtacggaaacatcaatgtccgagtattttgaaacaatactacgaatcgttgtgctgtgagtggcaatcaataaacgatcaccatcgttcgctgctgcaatggcgtgatctaagccaggctgtacgcgatcccagaaacgcgcattgtcttcagcgtcaccgaagggatcttgagcgtggaacatgtccttagttttttcgatggtgaggttggcaatcatggcatcaaaggaatctaaccctagtggtgttcccaaggtgtgccacgtgagacctgtatctaggccttcaaagtaaccaaagttttcttcacggaaggcgggctccgtcgtcagtgtgacgggttgcgcattagcggctagaatccgcttagccgtattctgtgcccgggtggtgtcactcgcataggcggccgcaaatgtcacttgtgccagtcgttgaccggcgcgcttggcatctgcgattcccttgtccgtcagtggtgagtcggaccatccttgaatccggtggtacttgtttaaataggtttggccgtgccgcaccaaataaagttcaactgccatctcttactctctcctttagcattgactgctattagtttaacagttctaattgagaatgcctagttcgcgccgaatttcacgagcggtgtcgggactgctggtaaagatcaaccggtcgttaagttttaagagtgtcgtacctgtgggccgaatgaactgaccatcacggaaaacctgactgatggtaatatcgcccacgaaggggagactacgaatttcttggtctgtgtatcgccggtttttgagggcaacttcatagacggcagtcgttgatgaggtgagtagacgtagcgtcgtgggcgcctcaattaggctacgaagcatagcaatattgacgttaggcgtgtcgtagacctcaataccaagactggtgagctcgtcttctcgttcgtctaatacattgcggtcttcaaacctgacgattacccggctaaccccgtacgccttagcagccttagcgagttcatagtttttagtcgcgttaaaatgaccgagaaccacggtatccgcatcgaacacgccttgttcccgcacgtaagtcgtttctaaagagtccagtaagtgaacattaacttctgaattgtatgttttatagttagcggccttgtcggtatacattgaaatgtcataccagccagctaattgttgggcaacgggaacggtcagcagattagtcccaatgaaatgtacggtggtcttcttaaggtcttcggcttcggctgagtagctcgtgttgaacaacaagggacccaagacacacgttagaatggccgctaataggaaagcgccggattgttgggacgtaaccaccttcatggttttcgcaacttgtagaacggctaagaccatcgtaatggtggctgcggagatagcagtaccagcaaaggcgttgccccgtttgaaacggagacgtaagataccataaataatggctttagagaataagtaagcggcaaaaaaggcggggattagcaatagggttgctggatcggctaatagcgtgcgcaaattgagattgatgccactcatcataaagaaaatggggatgaagaagccatacccgatggcatcaagacgaacgcgagtgtcttcatgtggttgaagaagtttcataacgataccggccacaaaggcgcccagaatcccttctgcgccaaccgattccgccacaatcacgagactaaagattaagaagaaggccaagcgaatatccagctgggtcgtggacttattaatccgttcgtagaaattaaagaagggcttaaatcgtaagaagagtagagctgcggcaaagaaaactagtagtaacagccataaggactgactgttgttgccaaagactgaggcatatagcgtaagcgcaaagagtgggacaatttcaccgagcgcagcaatcagtaggatagtttgaccaaatggtttgctgagcaattccttttcttttagtgttgcgatgacaatccctaaggaaatggtcatgaagataatggctgctagccatgggtccttgaagagaccggtccactgacataaaaatcccaagaaaagtgagctgacaactacaccaacgtaggcactaatggctaagaagacgggtgaatagcggggcgcgctgccggcaactttagcggctagtggcgtctgtggctgtttgcgtcgattgaacagactgaaatcaatttccatcccgctaagaaatagcaggaaaatgaccccagtattggacaacagtgtcaacgtactattagattgtacgagattgaagacactcggaccgagcaagatacccacgagaatttccacgacggcagttggtaaggcagttaaccgaaaccaagccatagtgagcggggtaatcagtgcagcggctaaaatgattaataaggaaagttgatccataaagtcacccccagaagttatggtacacaactttcattatagcaaaactggtctgattaggggttgttcgccctctggtcgcggtaaatgggctggaacgtaccggacacgactttaagccaattatggtctctactgcagaaaagttggatagtgttagtttgaaggtgccccagtttagcagaaaactatcggtcaagactgatggttagacgagtaggagtgtgaaaagctaacggattccgtagcggtcagtttgctttatttatacccggaagacgtgtagaatagttaggcgaattattagtttattttaacaatccagttcactgaggagggatcggcttgccagattcaattaaagcttacgagcaaaaacatttggatgacgtggtcgccaaggttaaggtggcagaagaagacgccaagcaacgaattgatgttgcggaaaatgatgaagccggtatccgcaaaaattttgttaatgacttacggattaaaacggatagttatgagggcttgttggaaacggcactgtctgtgcggcaacagcagcaaatgttggcagaacgtcagaacagttggcaacatgccacaactgagttgagcacgttacagcggcttgagaaaaaggcctattttgcccgaatcgattttcaagaagggccgaccgctaagactgagtcaatttatattggattaggctcgttttcggacacgccggatcattttttgatttatgattggcgggctccaatttccagtatctattacgatggtgaactgggcgatgtcagctatcaaacgccggatggggaacagaccgtcaacgttcagttaaaacgacaatttcagattgaagatggaacgattgtcacactctacgacactgatcaaacggtgacggatcagatgctgttatcggcgctgagtgaacactcagataccaagatgaagagcattgtgacgaccattcaaaaggaacaaaaccaaattatccgggataccaaatcagatctgttgttcgtccaaggggcggccgggtccgggaaaacggccgccattttacaacgcgtggcgttcctgttgtatcggtaccggggccatttgaatgcgggacaagtcatgttgttctcgccaaaccaactctttaatgattacattgatcaggtgttgccagaattaggggagcacaatatggtgcagatgacctattaccaatatgctggcagacggttgcctaagattgatgtggagactttggcccaacgatttgatgaaagtaatacgcccgcccaaaagaagattaatcagctaaaggggagcctggcctttttcgatgctgtgacggggtatgccgatcatttggaaagtgccgacatggtctttagaaacatcaagtttaagggccaagtgttcattgataaagcaaaaatccaagatatttattacagtttcaatcgtaattatcatttagggaatcgactgcaagcgactaaggaagccttgattcgcattttgaatcgccggatttctagtgaaatgaagacaaagtgggttgaagaaaccattcaggatttgagcaagcaggagctagattcgctgtatggcgatgagccacgagagttcgaatcctctgaaaaggaaatgcagttcttatcacgtaaagtggtgatgaaggcctttgaaccaattcgtaaggcgattgtgcgggcgcgtttcttgagtatcaataaccagtatgtccacatgctacgggatatacccaatcgtttggaactacgtgattatggtatctcgatggctgattggcaggccagcgtggaagagtctattactaagttgaaggatcatcgtatgcagctggttgataccacaccgtacctgtacttgtatgacaaaatgacgggtaaagacggtgagagagacatgcggtacgtcttcattgatgaaattcaagattataatgccttccagttagcctttttgaagtttagctttccacgagcgcggttcacaatgctgggggacttaaaccaagcgattttcaccaaagaaaacagtcggacattgttacaagagctgagtacgatgttcgatcccgataagacccgggttgttcaattgacgcagtcgtatcggtcgacgcagcaggtcacggactttaccaagcatatcctcaaaaatggggaggcggtcacagcatttgcccgtgaaggggaattgccaacggtgacggtggctaatgatgaagccggtgcgctaaagaaagtgattgcgcaggtccagaaaaatgaagcggatcaagaaacgacggcgatcattggaaaagacttagctgattgccgagctttaaccgatcaactcaaagcagcgggtgctagtgtgactttgattcagtcagaaaatcagcggctagcgccggggaccattgtggtaccgtctttcttggcaaagggcctagagtttgatgccataattgtttggcaggcttcagctagtcgttatgcggctgaagatgaacggcagttgctttacacgatttgctcacgagcgatgcaccgtctaagcttagtggcggtgggggaagtctcacccttattaagtgacgtgccagccgaagaatatacagtgatttaggtgattaaaactagggtaatcagaacggtttgtgttctggctatcctagttttttattaaagcaacatttttcgaggctgcctgcctttgggtcgcaacaaatgtgttgtggcgtggtcatacggtcggctactgcccgccctctggtcgcagcaaatgggctggaacgtaccggacacgactttaagccaagcaaggcacttgtcttaaagctcggtcttatcctaagagcgccaaggacgcgccctaagaataacgacgatactgagcccatttgccgcttcccgccgggctagtgttgtgtggcttgataccacttggttaaatccagcttgaacaagcctagcttcgagacttgtgagcttgcaaggctcgaagtcgggcccatagcgacttacatgagacacgcgcctggaaggcagggtagtagcatacatgtctggcagcgggataaagccaggacgtggctgctggattttcaccgagaatattgtcagcctgaccaagttctgcggtataataggcagtaattattttgtagaagttgaggtgtctcgattgcgtgatcccattaattacaacgcgtttacccgtgagcagtggcaacaattctcggcggacgctaccttaccgctaacgcaagaaagcttgcggcagattaaggcgttcaacgaccgtatttcgttgcaagatgtgcaggatatttatattccactagtgcacttggtacacttggagtttgatcattatcggcagttacaacgcgataaagcaacctttttaaagcaaccacaacagcgagttccatttattattggaattgccggtagcgtggcggtgggcaagagtacggctgcgcggttattggaagtgttgcttaatcactattttacggatcaacggattcagcttattacgaccgatggttttttatatagcaatgaggaacttaaaaaacgtaatttaatggcacgtaaagggtttccagaaagctatgatatgacggcactgattcaatttctcaatgacgttaaggcgggaaaggaactgattaaggccccagtctattcgcacaaagtgtatgacatcgttcccgatcagtttgactacatcatgcatccagatgtgctgatcgttgaaggcatcaacaccttacagttgccgactaacgagcaaatttatgtcagtgatttcaccgatttttcaatttatgtagatgccgaccccacgctgattgaaagctggttcttggaacggtttgaattgctgctagcgacggcttttcaggacccgaccaattactattatccttacgcgattggcgatcatgatgaagccattgctaagagtaaacgggtgtggcgtgatattgatttaaaaaacctggaagagtatattttaccaactcgcaaccgggccgatatgattattcataaaacattcggccaccggattgatcgattgctgttacggaaatattagggggcgatgggagtgctacgtgatgcgaccattgttgatgcggatgcggtgagcatgttggtcttacacgaactggaacgccgccagttacgccgattgcggcgccttagtaaagagcaattatcgcagctattgtttgtcgggtatcaccagtcagcgtttcgatatggttttccacaagcgcgcgtttatcaaaatcagggcgtggccgtcggggtagcttacgggtacccagcagccgttgaaatgacattggataatgagtggacgcccctgtttgaacgcttgcaggtgacaccaccgcagcagtcagtggtctcaccgcgcgcgttgcctgatgagtggtacttggacttgctcacggtacgtaaccgttcgcaacacaaaacttatcaacaaaagtggtttgacgagtggttatttggggatgccattcatcaggcccgtttgagtggtcaggccttcttgggattagatgtgcggcccgggagtcgtttggcccagctagcagccatgtttgggtgtgtgaccaccgaacgccggcgcttggatcggcaaccataccttcatctgcgttaccggataaactaattcgtgatagattgaacgttgttttagattgacccgcgtttcagaaatcggtatgatataagcaatgttgaaaaagaagaaagggtgaatggcttggcaaacgttgatatgtctaaattcgacaagatcatcgtcttagactttgggagtcaatacaaccaattgatcacccgccggattcgtgacctcggagtttactccgaattaaaggcccatacgatgactgcggctgagattaaggcttggggccccaagggaattatcttctctggtggaccaaatagtgtctacgacagtagtgcatttaatgtggacccagagatttttaacctcggtattccaattttaggaatttgttacgggatgcaactgatggcccacagtttgacgggtggcaaggttgaatccgctgataaccgagaatacggtcgggccgatattacggttctgagcgacgacgcaaagctattccacgacacccctaaggaacaaacggtgtggatgagccatggggacttagtcactcaagtgcctgatggttttgaacgggtagcaaccagtgaaaactgtccaatttcagcgatgcaggatacgacccgtaatttctatgggattcaattccatgcggaagtccggaacacagaatacggtaacgatatcttaaagcactttgcttttgatgtctgccaagcacaggctaactggtcaatggatgatttcattgatttacaaattgctcaaattcgggaaaccgttggcgacaagaaggtcctgttgggtctgtctggtggggttgattcatccgttgtgggcgtgttattgcataaagcaatcggctcacaattgaccagtatcttcgtcgatcatggtctattacgtaagggtgaagccaagcaagtaatggacagcctagaaggtaaatttgggttgaacatcgtgcaggtcaacgcgcaagatcgcttcttgagtaagttggcaggcgttacggaacccgaaaagaaacgtaagattattggaaatgagtttattcaagtcttcaatgatgaggcccagaagctggatggtatcgacttcttagcccaaggaacgctgtacactgacgtgattgaaagtgggacggatacggcccaaacaatcaagtcacaccataacgttggtggcttgccagaagatatgcatttccaattgattgaacccttacgttcgctgttcaaggatgaagcccgtgaattgggtgaaaagctgggaatgccaagcgagttagtgtggcggcaaccatttcctggtcctggtttagggattcgggtattgggtgaaattacaccagaaaagctccaaattgtccgcgatagcgatttgattctccgtgaggaaatcaagaaggccggtctcgaccgagacatttggcaatactttacggtgctgcccaacatcaagagtgtcggggtaatgggcgatggccggacgtatgattacgccgtgggtattcgcgctgtcacttcgattgatggtatgacggctgacttcgcgcatattccatgggatgtcttgcaagatatttctgtgcggattgttaatgaagtggaacatgttaaccgcatcttatatgatgtgacgagtaagccgccttcgactattgagtgggaataatggttagtagaattcatgtaaagaagccatctaagcaatttagtttaggtggctttttttgtagtatgcggcgttaaccaactatacaaatgccaacagttgagctatctcgatgaatcccgaatgtaactgttgtatgataaacaatgtaatcgatatcatttttgaaaggaatcgatgctatgtcaatccatgtcaatgaagctaatcttacgtttcatctacaaaccgatcacacgagttatatttttcaaattatgaaaaatggcgaggctggtcagatttattatggaccaagaatccacgtgcaaccgacctatcaaaatctcatgtcacaggaatggcgtgacgcgacaccgtcattgaacgaagaaaacccgaattttcagccagctacgatcaaggccgagtatgcgagcttgggcaagggcgatttccggcaaccggcttttcaagtgacccaagcaaatgggagccggattaccgagttgacttatgatcattaccaactactaacagggaaacagcgattagccaacttgccatcaacgtttgatgataccgatgacgatgcccaaacattagtcgtgtcctttaacgatcggattaccgggttggcacttgaccttaattacagtatttttccacaccaagatgtcattgtaaaaagtgcgaagtttaccaatccaagttccgaaaaattagttctgaatcgggcgctcagttctcagttagatttgccggatgccaattatgacctaatccaattttctggtacgtgggcgcgtgaacggcatctgtaccgtcatccattacgaccgggaatgcagagtattagtagcctacggatggcctcaagtcaccaacaaaaccccttcatgatgttggcccgcccacagacgaccgacgagcaaggggcggtctttggcttcaatttagtttattccggtaattttttggatgccattgaagttgaccaatacagtaccagccggattctgaccggaatcaatccagacgaatttggttggaatctggccccgcaagcgacatttcagactcccgaggcaattttgagttatacctcagccggaatgaaccaactgtcacagcaaatggccagtttttatcagcagcatttggttaatccgcgatttgctcatgaggaacggccggtgctgattaataattgggaggccacttactttgactttaacgaagcgaagttgatgacgattgttaaccaggctaagcgactgggaattgagatgtttgtgctggatgatggctggtttggccaccgggatggcgacaccacctccttaggggactggtttgtcgatcagaggaagtttccggatggcatcgaacacttcagtcaagcagttcatcagcaagggatgaagtttggtttgtggtttgaaccggaaatggtttctgttgatagtgacctttaccaacagcatcccgactggttgattcatgcacccaaatcgacgccaacgcctggtcgccaccagttcgttttggatatggcgcggccagaagtggtcgattacctatttaagctgatgagtcagatgattgaatcggcgaacttggactacatcaagtgggatatgaaccgctatgcgacggaaatgtttagttcaaggttaactagtgatcagcaattagaactgccgcatcgatatattctaggcgtttatcagttgtatgcccgattaacgcaggcctatccgaatgttttgtttgaatcctgtgcgtccggtgggggccggttcgatctggggatgatgtattatgcgccgcaagcgtggacgagtgatgatactgatgcggcagaacgcctgctgattcaattcgggacgtcctatgggtatccacaagccatgatgggagcccacgtctctgcggttccaaatgaccagatggggcggatcacgtcgctaaagaccagaggggccgtagcgttcttcggtgatttggggtatgaactcgatattaccaagatggcgccaacggaattggaccaagtcaaaaaacaagtggccttttataaatgttatcgccagcttttccaatttggaaagttttaccgaatcgacagtccctttgtggaggacggcaatgtcactagttggcaggttgtgagtgacgaccagaaacaagcgattgccgcccggtaccaactgttgaatcatcccaatgcgccttatacccgcttctatttcaagggattacgtcctaatcagcgctatcaaattaatgatgacccatcaacctattatggggatgaattaatgaatgctggttattttgtcccaaccattttggcggacggccaagagtctaaagacttttatacccagttgtttgtggtgacggcaatttaggcgagaatttattgaaaatgtgatatccttacaattagtaagaatatcacagctaacccaaggaggttcccactatgcccgaaattaccctaacacccgatttttaccactatcttcagcaaaaacacctgacggaccacaacctgattttattagtggatgatggtggcggcaagtactcgctacaaggcggtgcttgtagtattggcacgaactttagcatcattgacgttgatgagccagacgctgactaccccattttgctgacgaatacgcaaggtgtccggctctggacctctaactatgatctggttttctgtggaacggggttaaagttagactatcgtcacggaagcattgccattactgatgatgcccatatgatgttggatggcactgttcagctggttaagggggccgatgttctagctgcttttcaggctggggttaagctaagtaatggtggatgttaaaagtctttttgatacgctccatagagtgagaataatgatacaatttttaaaataagctaccaaactagggtaaatatgagaaaatggcaaaccattctcatatttaccctagtttgtcgtataatgtagatattctatttaatctggaggggaactcatgacagaatcaacgcacttgtatgacctgttccacccggcacactacgatatttatctcgacattaaccgcgaaacgaagcaaattagcgggaagacgaccattaccggtgacgctttagctacgacgattggcattcaccagaagttcttaaagatccaacaggtaacggttgacggcaaagccgtgacggttacggatgatcctgcggccgaagccattcggattccggtcccacagacgggtaacgtgacgttagccattgattacacggcgccattaactgatagcatgatggggatttacccatcctactacgacgttaacggcgaacaaaagcaaatcattggaacccagtttgaaacgaccgctgcgcgccaagctttcccaagtatcgatgaaccggaggccaaagcaacctttgacctagcgattaagttcgatgaacagcctggtgaaacggttatcagtaacatgcctgagaccaaggtcgaagccggcgtgcactactttgacaccacggttaagatgtccacgtacctgattgcctttgcctttggtgatttgcaaagtaagatgacgactactaagagtggggttcaggttggggtgtttgctaccaaggcgcatcaagccaatgaattggactttgcgttagacattgccaagcgctcaattgaattttacgaagacttctatcagacaccttatccactaccacattcctggcagttagccttacctgacttttccgctggtgccatggaaaactggggattggttacttaccgggaagcttacctcgttttggaccccgacaatacgtcgtttgaaacgaagcaacgggttgccaccgtcattgctcatgaactggcccaccaatggtttggtgatttggttacgatgaagtggtgggatgatctttggttgaacgaaagttttgccaacatgatggaatacgttgccattgatgccatcgaacctgactggcacatttgggaagtcttccaaacaactgaagccccaatggccttacaacgggacgcaacggacggtgtacaatctgtccacgtgcaagtagaagatccagctgaaattgatgcgctctttgatagtgccattgtttacgccaagggtgcccggatgttagtcatggtgcgggctttaattggcgatgatgctctgcgaacgggcctaaaggcttactttgacgcccataagtttggcaatgcaactggggctgacttgtggtctgctttagggactgctgccaatatggatttgaagagcgtaatgaattcgtggctggaacaacctggttacccagtattaacggctgcggtggtcgatggtcagttgacagtgacccagcaacaattctttattggcgatggcacagacgccaaacgtcaatggcaagtgccattgagcagtaactatgctgaagtcccagaattgttgacggcgccacaagtgacgttaggaacttatgcggatttacggcaggctaatggacagccgttccggctaaatgtcggcaataattcacatgcgattgtgaagtacgatgataccttactagcagatattttagatcacatcactgagttaacagcgattgatcaactccaattgctacaagatcaacgactattggctgaaggtcggcagatttcttatgcggatgtcgtcgccttgttgccacgatttgcggctagtgaagctacggtggttaacgatgcgttgtatcaggtcgctggtaacttgaagaagttcgtcacgccagattctgatgccgaaaagcaactgcaacaattctttgatcggttaagtgcggcacaagttgaccggttggggtggacccccaaagctggcgaatctaatgatgaccagttaacccggccatatgtattaagcgcggccctttatgctaaaaatgcccaatcggtcgccgctgcgcatgaactgttcacggccaatcgcgacaatttagcaggcttgccagctgcaacgcgttactatgttttggcaaacgaagtcacgaactttagtgacgcaacggtctttgatcagttgctgacagattaccggcaagcaacggatgccagctacaaggctgatctgtgtgccgcattgacgaccacaccagatgccaagttgattgcgaagttgatcgcagtctttgaagacgcagccacggttaaaccacaagacttacgggcttggtaccgtggtgtcttggccaatgccaaggggcagcaggcagcttgggactggatccgtcaagactgggcttggttggaagcaactgtgggtggtgatatggaattcaccacatttattacggtaactgcggcgatcttccacacacctgaacggttagctgagttcaaggaattctttgaaccaaagattccgacgcctggtttaggacgtgaaatcaagatggataccaaggttatcgcaagtcgcgtggccttagttgaagatgaaaaagccgcagtgaatgctgcggtggcacaagtcgtccaataatttatgtaagtgacgaagaacctagacgatggtctaggttcttttttgcgtttcatttgcgaaaaactgaacaaaaaagttaaaatgcataaatagtctgaattcccagctgttattttatacacattcgttcagtgcaaaatcagcgtataagttgtgattgctatggtttgttggtcaataaaatgcgaaaaagttcatgtatatttatcgtgtgagggtgtataattctgacatattgacggatgtgttggctggcagtagtgtgccaatggttattttatttgaacatgtaagcgcttatattgtttgccaatctgtctatcatccaaagcgctttaaaattgacgttgctcgaaaggatctttactcatgaaaaaggccacttcatcacctgataaaagtcacggcctcgggttgttggcactgatttcaacagttattacgtcatcaattggtgggggaatttttgccctcacctcagatttagcgattgcagcgtcacctggtcccgcgctgattgcttggggcatcgtggggttgggaaccctgatgttagccttatcgttgaacaatttagtcctcaagcggcctgacttggagggaatcttttcctatgcagaagagggttttggcaagtataccggctttatcagtgggtggggatactggatctcggcgtggatgggaaatgtggcatttgcgacggtgatgatgagtgctgtgggctattttctcccggtatttaatggtcgcagtcaaattccctcggttattgttgccagtgtgatcctgtggttactaaccttattagtgaatcatgggattgaaagtgccgcgctcctaaacgcgatgattacggtttgcaagttaattccactctttgtctttattgtttttgccattttcctatttaagggccaagtttttacggctcatttttggaccaatgttggtagtaatttacaagggactgaaacaattgcgagccaaatcaaacggtgcttcattattatgatgtgggtgtttgtcggaattgaaggggccaccatgctgtcgtcacgggccaaaaagaccgccgatgcggggaaagcgacactgattggtttagttggtttattaacgatttatgttttggcgtcagtcttgccctatggttacttcagtcgtcaggcattagcaactattcatcaaccggcgatggtttacctatttaaagagatggtcgggccatggggtggggccttgattagcctgggtttaatcatttcaacgttggggtcttggctatcatggaccatgttaccggcggaaacgattcggttgatggctgaccagaaactattaccacgggtctttagtcgaaaaaataagcagggagcgcccacggtctcgttggttaccagtagtgtcttggttcagttctttttggtcacgctgatttttacggatcaggcttatcaaattgcctattcgatgtgtacggcggccgtgacaatttgttatattttagtggcggcttaccagattaagtactcatggcaacatttgcgtgagtccggtagtcgttggcagttagccattgggattggggcgctgttatttgaaggaaccgccatttacttttccgggttcaagtaccttattctctgcacgattgcctacattccaggaagtattttatatctgatggcgcgcaaagaaagtgagcgacggtggttccagtcgccattagaacggctgtacgtggcgagtgtcgtcatctgtgcacttgtagcgattgggttagtcattgcgggaaaattagtgatttaggaaaaagtacgtaccaaatacacgaaaatacaaagcgcccagggcataagtcctggacgctttgtatttaaaatagagttgactagagcattagtcgtttaaattgtagcgtaacttcatgtgttcagaaccaaaggtcaccatgtcacccaataatttggtttgacgcgtgaaggattcattggaaagctgttcgttagcagatttcaaaattgacacatcggcgccgttcttgatggctgcgtcagtatcgttttgaatcttccggtaggctcccatggcttctaaagcgaaggtattacggaagtcttcatataagtcgaagtccgtgtcaccaagtaatgccgtggtgcagcttaaccagtacatatgattcaggttaaaggtaccatcagcatctttataagcggcgggggtgtcgtcgacattcgcgtagaacggaacgaccgtattgaacgtattcgcgccaaaggctagccagtgaatcccggcaatgctggcggggacatcgttacgaatttggaggatgtgtacgtcgtgattccggttgataccgattgggcggaacttggtcttgtcactttcagtcccatcaccataaacatcgtattgggtgttttggtagtgtgagctcaagacgtacttaacatcttcaatggaaatcttgcggttagcatggcagatgaagggtaggtcttggccttgagggtcttggtcaacgtctggtgtaaagtacttttgaccaaaccaagcccgaggattgttatagacggtatccttatccgttgcgctaccgaagatgtggcggaggtttattcgatcgaaatcaggattcaaatgatacgtttcaatgaggtcagccaaatcagcggaggccatggtatcatcggcagcaaaatcaaagtcgtcaatgttcattcggttgggggcaacgacgtaagcgtcgtctggaatccgcttggcagcccaatgatgaccgccaatggtttccaaccaccagatttcatcgttatcagaaaaggcaatcccgttgggttcgtacgtcccaaattctgccagtaactgaccgaggcgttcaaccccttcacgagcactgtgaatataagggagaacgagagtgaccaaatcttcttcaccaatgccaccggcaacgtatggatcgatacccaagacccgagcattcgtcgtgatggtttctgtggcggacatggctacattgtcactgttaataccggcagcgggccagattccgtttgtcaagatagagttgggaatcgacgtataccggagcgggttatcaggtaatttaatgttgacgccactgataacggcttggtaatcagtgggctggtcggcaggattaacgacgacgaatttttcggggtcgagcgcttcgtgaccatcatcgtttcgagaaataatggtggagccgtccaacgaggccttcttacctacaagaatagtggtacaagaacctttaatacgttttgtcataaatgcagcactccttttatcccgtattatagcattgatggctagagaagttgaagggattatcagccgcaaaaacgagatatcagcgactagtggtagtgtcttgagcagatgactaaataaaaacccgctccctttaacaggaatgcttgctaaaagaaccgggtcttggggattttaaatgtgcgtttagttgagaatcgcaaagccaccggtccagccaatcttttcactggccgctaacgtcatttgtaagaagcccatggcctctaattcacgagcccacttaagcgcgccggcatcaatgactttcacgccactggttttaagcgcatctgctagcatttgtttagcagcggcgtcatcgccggcagctagaactgtagtgacttctttgccactaacttgtttgctagccaaagtagcggcgaacgtcgtattgaaagctttgatgacttggctgtcgggcaacaacttagccagttcagcggttgcggaactgtcggcggggacaaccagttcatcccaagtatcgaaattcaaggggttgctgatgtcgatgacaacctttccggccaactgagcggcttgtgctttagcgattgacacggctactggataaggcacagccaaaaccacgatatcacccagattttccactgcatcgtcacgatcgatgtgcgtcacggtgttgccaccagcggtaaagacactgtccaaagcctgtcccatattaccatttccaaaaattgtaattgctgccatcataaatccctccaaaacttgttctttttttaagtacaaatatactttaacctgtttctgcgattctgtcaaattaaatcatttgattgtttattataatattttgtcttataatcaaatacaaaaagggagtgagtaagatggccaacacgcggctcagtgatacaattcacgtattgacgtacattgcctactttaaggatcagaagattacgagtcaggcgatggcgagcagcttacagacatcacctagtctagtgcggaagattctagcgaatttgaaacgaggaggactagtttgtccggggcaggcaaccacccacgtcagcttagcaaaaccagccgcagagatcacgatgcgagatatctatcgaacattaccagatcgggggccattgttaaatgttgataccaaaacaaacgaagactgtccagtgggggcggcggttccggtggcattaaaccgctactatgcggaaatccaagctgcggctgaggaccgaatggcgcgcattaccctgcaagatatcctagctgatattgcgttacaaaatgatcgttaggtaagtggtgcaaatggcgggcagtcagcggatttcgctaccaaatatgtgaagaacggagtcggggataaaactcccagactccttttcatgtcttcaaatatgtggtgttgaaacgcgagaccccgtaagtcagagaatatccgacttacgacgttaatgatcgctgaaaagggatgtttggttgtgtccggaacgaaatgccagtagaatggaagcattgaataagtgaggggtaaatagaatggatttggcggcagcacaacaggtgttaaaaacagtcttcggatacgacgagtttcgaccaggtcaaaaggccgtcattgaacacgtgctggcgggcgatagtagcttggcgattatgccaacgggcgggggaaaatcactttgctatcaaataccggctatgttattttctggtatcacggtggtggtatccccactcatctcattaatgaaagatcaggttgatgcgctaaatgatagtgggattccagcaaccttcattaacagttcggtggactggccggaaattcaacaacggttagcagcactgcacaatggggactacaaattggtgtatattgcgccagaacggttagattcagaagcctttgttcaagcattggcccggttgccaattgatctgttggcggttgatgaggcccactgtatttcccaatggggccacgattttcgaccgagctatttgacgttgagtcatgccattgaacagttaccaagtcagccacaggtgttggcactgacggcgacggcaaccacccaagttgctcatgatatctgtcagcagttatggattgatccgcaaaatgaagtgaatactggatttgctcgggataatttgaatctaacggtcgtcaaggatcaagatacggatcgctatattttggattatttgcaagtcaatcaaggggaggcgggcattatttacgccagtacccgtaaggaagtcgaacgactgacaaaattacttacgaaacagcacgtcactgcagcggcctatcacgcgggcttgagtgacgaacagcgacagcaaaatcaagaagatttcttatatgatcggattcaggtcatggtggcgacgaatgcgtttggaatgggtattgataagagtaatgtccggtttgtgatccatgcgcaggtaccgggaacattagaggcctactatcaagaagccgggcgagcaggtcgagatgggttgccgtgtgaagcaatcttggtctatcacgctcaggacttacagattcaacggtttttcattgatcaatcggaaatggacgaagagcatcggcaacgtgcctatcaaaagctacaggtgatgaatcattatgcgaatacggagggatgtttgcagcagtttattctccaatattttggggaagtatcaccggcgtgtggtcggtgtagtaattgcttggacgaacgggaatcccaagatgttacgacagcggcccaacaggtgttgtcgtgtgtcgtgcggttgcggtcacgatttggtaagggcgtggtcgcgcaggtgttgacgggggcacgaaatcaacggatccgtgaaaacaatctgacgatgttgccaacctatggtttgatggctaatcaaaagcaaaagaccgtgggtgaactcattgacttcttaacggcagctggttatttgcagagcgtgggtggtcaatacccgacgctgcaggtgacggctaatggtgtcgctgtgttaaaggggcaagaacaggtccaccgcaagatggcgcaacgggtgaagcgattggtaccggaagatacggcgttgtttggcaagctacgcgatttgcggcgtgaattggcagaggaacagcatgtgccaccatttgtgattttttcggataaggccttacacgcgatgtgtgaagccttaccaacagacgatgagagttttcttgcagtgaaaggtgtcggacagagtaagctggaccgttatggggaagcatttatggcggtgattcgagagaatcaagatatggactaaaaaacacgcgatcgatagtcggtcgcgtgttttgaattaatgagtaacgtgtaaacgaaacatgttccaggatagtggttgtagtgacgccgttagggtgttgtcggacaaatgaacgtttgaattgggatgcaacgccatttgttggttctcattggtttgcttgatgtcataaccacagaattgcgtggcctcaatcaccgtttgggcgttgagatcgtgcagatcagtttgaaagtccatcgtcgtgttacctttattttcggcaaaaattacgatttcgtggttttcggaattgtaaacggctaggctatccaagtaagggacatctttaaaatctttgctatcgtaggttgtagcggtttgctgtggcgtaagcgcaattccccggccgtatttggaaatttgcaggaaggggaagaaaatggattgcagccagataccatgctcgtccgtcataattggcgcaatcacgttgactagttgggcaaggcaagcaatcttgacgcgatcagcatgtttgagtagtgtgattagcatggtgccgaccatcaaggcatcttcaaagttatagtggtcttctagcaagtgtggggcctgttgccagggagccgtctcatcatcttgtttgtgagaatggtaccagacattccattcatctagggctaaattgagggttttgtggctgtgtttgcgtgctttgacagcatcacagactgcgacaattccactgatgaactcgtcaaaatcaatggatttggctaaaaagttagcgagatcattttcttcattgtcatagtaacggtgaagggaaaggtagtcgacatcgtcgtaggtatggtccagcaccgtttcttcccaactgccaaaggtagccatttcacgagtggaactgccactgacaactagatcaatgctgggatcaacgagtcgcatgactttggctgtttcgtgggctagacggccgtattcatcggctgttttatgaccaatttgccaatcgccatccatttcattgcccagacaccaggttttgatattaaagggttcctcagcgccattttgttttcgcaggtcactccagtaagtgccgccggaaaagttacagtattcgactaaattacgagcagcatcgatccctcgactaccaaggttaacagccatgtcaggccgtgtgccagttttttgcgtccatttcataaattcatgaagaccaaattgattagtttcaatgctccgccatgccagatccaaacgagtggggcgggtgcttttaggcccaatactgtcttcccaattaaaaccagagacaaagttaccaccaggatatcggatgaggtcgatatttagcgatttaacggcgtcgataacgtcctgacgaaagccgtcctggtctgactggggatgattgggttgatagagaccatcatagacggatcgaccgagatgctcgatgagcgcactgtaaacacggtcatcaattttggcgatttggctggctgggtcaacggttagttttccttgcatgatttttcctcctttagaaaaaggagccctactgagaggactccttaatgagtgtcgcaattcactcattcacgactatcagttgaagaagccgcttccactttagctttaacattaggatcctcgacttcaccggcttgaatcggatcttctttcttcaggaagaagacggcaaacaaggtaatgaagaagaccacgatccccatgatgatgtacgtgtgttgatacccgataacgtcatacatccgaccagcaactgtggagaagatgaagacggatacctgtttagcaaagtttgacgccaatgcgtaaaccgtggcgtataaccgaatatcaaaggcaccagcaatgtatttcatgatggaagttaatagcaatggcatttccaaaccagctaacaaacggaaaccaacaacccagatccagttaggagataaagcagaacctaagatccggatgcaggtaatgaaaccgtaaattaacaaaccattacgagaaccaattttgttgataatccatggcattgggaacattaaacaaaattcgatagctgtttgagcagaactcatgtaagagtaaaccagggtcccctgagcagcggtatcaaagaaagtcttaaagaagatgataaactgttgatcaaatacatcgaataaggcagaagcgcccatgtagaaaatagctaaaacccagaggttcttaagtttgaagacagacagaaccgtcttcatatcaagtgaatcggacgtgtcaccagcagcggcagcgttatctaagttaaccttgtcagagaagagtaataagaaagttaagataatagcggcaatggtacatgcccagaagatggagttaggcttccagaggaagattcgcccggcaactaatgaagcaacgacaccggcgacggaaccaccgacccgggagtgggcatattcgaagccgttagccaaactagcccgctgtacgtattgttcaatgacggacaccccaccgtttaggatgaaactcagaaaagtcccagtaacgatggctactaagaaggcgctaatgtgtaagatgggcatgaagacccattggaagtaaggaccgatgaagatcccgacgatcgcaatcgttaagattaagtttttcttgaagagtaatttatcagaaacaaccccaaagataggttggaagatcaaggaaatacccgccatcattgagaagacggcaccagattcggtcccgtttaagtgggcaacttgttccatccagagggttaaataaccgttaacaacggcccaaatgaagaagtagctaaagtgagataggggaaatccccagaaatgtttcgattcagtttttgcactatccatgatttattcgcctctatttataattgtaaggaaccggcttgccaaagttaggcgtaccatcgtcattccaagtaaacggttgcaccattgtgtgacggttaggatcatataatggatcacctttgatatcggtgtaattccggcagtggtaaaccagcatgtcagtttcaccgtcttcggcaactgtaaatgagttatgaccaggaccgaattgtttgattggcatgttgctttggaaaacgggtgtttcagatttggaccaactagcgggatctaagaggtcggcatcttcggcaacggttagcatccccatggcatagttctcgtcggtagcgcttgcagaataggtcaagaagaagcgaccatttcggtgtaagacggccggaccttcatttacccagaaaattttggtttcccaatcgtattctggttttgttagcatgaccggcttggtctttaacgtccatggattagccatttccgcgatgtagatgttggaattacccttgatagcgggatccttttgggcccaaacatagtacaatttgttttgtgcttcgaaaactgtcgcatctaaggcaaatgtgtctaatggtgtttcaatttggccgtgttcagtccaatcggcttcatcgcgcatgggatcggggttgtcacactcaatgcagtacatccggtgttggaacatcccattatggtcgaactctttggtatgtgaagcggcaaagtagatgaaccatttgccatcaatgtaatgaagctctggtgcccagatgagttggctcatggcaccgctaccatcgggatgcttacgccagatggttcgaggagcagcattagccaatccatttaaggtcttggcccgacgaatttcaattaagttgtacgccggtacggaggctgtgaaataataatagccatcagtatgtttataaatataggggtcagcccgctggacaatcagtgggttgatatagtcttgagcttggaccattagtcaatctctccttttgaaatttgtaaggacttaaattgctttaagaaaataagtcctaataaattagtacacttgaaatatacagccggttgaaaacgctgtcaacattaaaattaatatttttgctaatttattttcgaaaaatcgtctgaattaatataaaagttaatcattaagtggtaatataaaagcatggttaatcttaattaatataaaagttaatgaaaagaaggcgacaacatgcaattagatatgagcagtgcttcgttgccagtttatgaagcattaagtagtgaggttcgtctgcacattattcgattgatttcggaaaagccgatgagtgttaaggagttagcgcaagaattgggcttaagtagtgcaattgtgacgaaacatttagataaattggccgccgccgagttagtcacgagtaaacgagtgggacggtcaaaaatgacggagcttcgggttgatacgattgaggtaaagtttccgcgcgaaatctatccgacgtttcaagtgcatcaaacaagtattccggttggacattacacagaataccgcgtacagccgtcatgtggcttggcaggaaagaatggctatattggtaaagtggacaatccccgatattttatgtcgccagaacggatgaatgccggaatgatttggtttaataacggttatgttgagtatcagacgcctaactttcttcaaggacatgaacacttagagatgttggatttgacggcggaactcggttcagaatttcctttttcaaataacacatggccatcggatattacttttttcatcaacggtaaagaaattgggacatggcgtagtctaggcgatttttctgatattcgcgggaaatacacgcctaaatgggtaccagataatgttaaccaatatggcgtgttgaaaacgttacgggtgacagatcacggtacttatttagacgggcaaccatttacggatatttgtttgcaagatttgccaactgaccatgagacctggacagtacgattcgaagttaaagaagaggccgaaaaggctggaggttgcacaatctttggacaaggatttggtaatcatgatcaaaatatcgagttgctagcctactacagttgatagaaatatccgaataacttttatactaaaagagttattcggatattttttgaaatcgcttacttaacatgctaatatgagttctaaactagaagaatggactgagagtagatggcacaaacggaatacgataaaatgatggcagaaaacttatatgatgtgaatgaccgtcaactggttgatgatcgttcacatgcgcgggatttatatgaaacacttaatcaaacttcctttcatgataaagaaaagttacagcaattgattaaacagttgtttggaacagttgggacgggaagtgaagtacggccgcggtttatttgcgattatggttataatatccacgttggtaataatttttttgccaattttgattgtattttattagatacttgcccaattacaattggtgataatgttttgttagcaccgcgtgtgcaaatttatacagccgcacatcctttggacatacagaaacgcacatcatggctgggttgtggcaaggcagtttcaattggcaataattgttggctagggggcaatgctgttgttttaccaggtgtgcatttgggaaataatgttattgttggcggcggtgccgtcgtcacgaagtcctttggccataatgtcgtaattgcgggaaatccggcccgagtgatcaagcacttaaaaggataaggagaaacataccatcggcaaaaaatgggatattaaattgttaacttactctagttaaaaataacgttttaccaagtacctgttatgattggtaaggaacacttaaatttgctatcctatagggtagacgttataaatataagcaaccgtggggtaattcaggttacgaaatataattggagaaagttatggaaaataaatatcaaagagtcaaagataccttgaaagaagctattctttcaggtaagtatccgattgatgaaaaattgccaaccgaaacggaattaatgaatcaatttaacgtttcacggtacacgattcgtcgggccgtcggggacttagaatcagaacattatatttaccgaattcagggtggtggcatgtttgttcaggattggcataaagactggtcaatcgatagcgatagtaaaatgataggcgtcatcacgactcatattgcggactatatttttcctcaaatcatttatggcattgatcagatgatctctgaggggggatattcgctactgctgggcaatacgcacaataatcatcaaaaagaacggaaaaaccttatcaacatgctgaatagtaaggtggccgggctgattattgaaccgacacaaagtgcgctaccaaatcctaatatggatctttatcaagagattaaagatgatgaaattccagtattgtttatcaatgctagttacccggagttggagtttccaacagtgacgactgatgatgctggcgcagagcgtaaaataattgattatttactagacatgggccatgagagtattctggggatttttcaggttgatgacatgcagggggttcatcggatggatggattcgttaaggcatatcaacagcatccagagatttcctataaaggtaatttggtgatgtatcaatcaggagatagttttgataagattactcagcgggtagcgtcggcgttagaaacaccggatcggccaacggcaattgcctgctataatgatcaattagcgatccaagtcttagattatttgaagagtaatggatttctagtaccacaggatatttctgttgtgggttttgataactatcaaatggcacaatatatgagtccaggaatcacaaccttaaatcacgaaaaggaagttatgggggaagatactgggaagatgatgctcaatcttttacaaaagaagcctgtcacatcaattatgtacgatcctcagctaattgtacgggaatctgttgcatctccaaaattattaggataattaattaaaggagcctatacactgtagaaacgcagtgtacaggctcctttttgtgtgcgcatactaaggattcaaacataagtgataggaataacggtatcgcttacaaaaaaatataccaaataaacgccgagataacagcatctaacgaattaattagtccgaacaacaaaaaaacaagttgatttatgcgtacaaatattataaactgtatttgttcaataaatgaaagcggttcataagattgtgattcctaaagcatgccggcgcagggagtcacgaattattgaaagggctttcgatagatgatgaatacttgggtaagcaattatttttgataaaccccttaatttaggaggaataaaattggataagaaaaagaatgtttccagtaagtttattttcttcttcggttcatttggtggtatcttgttcggttatgacattggtgttatgaccggagcactaccttttctgaagactgactggaatttaacaaatgcgtcattagttggttgggttacttctgctgtgatgttcggtgccatctttggtgctgcaattgctgggcagctagctgatcgacttggtcggcgacgaatgattctaatgtcgtctttggttttcgctattggttcaattctatgtggattttcacctaacaacgggacgttttacctgattggcatgagaatatttttaggactggctgttggtgcggcctctgctttggtaccagcctatatgtcagaaatggcaccggcacgattacgtgggagtttgtctgggattaatcaaacgatgattgtctctgggatgttgatctcatacattattgactttgttttaaaggatttaccagaaaatatttcttggcgtttaatgttagggctagctgctgttcctgcaattatcttatttgctggggttcttaagctgcctgaatcacctcgcttcttaatcaaggctaaccgtttagatgaagcacggcaggttttatcatttgttcgtaaaccagaagaagttgaacctgaagttaagtcaattcaagcaacggcacaaaatgaatcaagtaacatggctaaaacatcatgggcaaccttattcaatagcaaatatcgttacttagttattgctggggttggtgtggcagctttccagcaattccaaggcgccaacgcaatcttctactatattccattaattgttgaaaaggcaactggtagtgctgctagttctgcattgatgtggccaattgttcaaggggttctgttagttcttggttcactcttatatatctggattgctgaaaaattcaatcggcggaccttgttgactttaggtggtacagtgatggctttatccttcctgctaccagctgtaattaacagtttggtaccaaatgcaagtccaatgatgattgtggtcttcttatcaatttacgtggccttttactccttcacttgggcgccattaacttgggtgctggttggtgaagtcttcccgttggccgttcggggccgggcatctggtttagcatcatcctttaactggattggttcatgggccgttgggttgctcttcccaatcatgacggcttcaatgtcacaagaagcggtgtttgctgtcttcggtgttatctgtgtcttgggtgtgctcttcgttcgtttctgtgttccagaaacccgtggtcactcacttgaagaaatcgaagctgctggtactaaccgtggtaagaaagctgaaacggcgcaaaacaactagtatttttgaatgatttaggaggcataacgaaatgaacttagtcgaaacggcgcaagccattgaggcgggacaggtttccttagggattgaattaggctcaactcgaattaaagcggtattagtcaccgatgacttcaatacgattgcttccggtagttacgtttgggaaaatcggtttgaggatggtgtttggacctatccacttgaagaggtttggtccggtatccagcagagctatacacaaatggcggcggatgttcaaagcaaatatcatgctagcttgaagcatattaatgcgattggtgttagtgcaatgatgcacggctacttggcgttcgataagaacaatgagttgttagtgcctttccgaacttggcggaacaatattacgggccaatcggctgatgaattaaccaagctctttgatttcaatattccacaacggtggagtattgctcacttataccaagcagtcttgaatgatgaggaccatgttgccaaggttgatttcattacgacgttagccggttatgttacttggaaattgtctggcgagaaagtcttgggtgttggagacgcttcaggtgtcttcccaattgatgaaaaaactggtagttatgaccaagcaatgctagataagtttagcagtttagataatgttaagcggtatccatggcagattgagaatattctacccaacatcttaccagccggtaaaattgctggtaagctaaccgctggaggggctagcttattggatgccagtggcaaccttgaagcaggtagtgttatggcaccacctgaaggggatgctggtacagggatggttggaacgaacagtgttcgtaagcggactggtaatatttccgttgggacatcagctttctccatgaatgtcttggataaaccattgtcgaaggtttatcgcgatattgatatcgtgatgaccccagatggttcaccagttgccatggtccacgttaacaactgttcatctgatattaacgcttgggcaagcattttcagtgaatttgctgctcggctaggtgttgatctgaaaccggatcgactgtatgaaacgcttttcttggaatcaactaaagcagatgccaatgcgggtggattggtcaattatagttatcaatctggtgaaaacattactaagattcaagccggccggccattatttgttcgaacacctaacagcaagttttctctgccaaactttatgctgactcagctctatgctgcgtttgcaccactgcaaatcgggatggatattttggtcaacgaagaacacgtacaaactgacgtgatgattgcgcagggtggtttattccggacaccagtaattggtcaacaagtactggctaacgctttaaatatccccattacggttatgagtacggctggtgagggtggcccttgggggatggctgtcttggcggcttatgcccaacgtcaaacgagtgagaaccttgaagacttcttggatcaagaggtcttcaagaatcctgaaagtatgacgttgagtcctgaacctgctggggttgctggttatcaagagtttatcaagaattatcaagctggcttgccagtggaagctgccgctggcgaagctattagcgattaagagaagagaggttaattgaatgttagaagatttaaagcaagaagtctacgacgccaacatgcagttgcctgaattgggattggttacctttacttggggtaacgtttccggtattgatcgggacaaaggcctgtttgtcatcaaaccttctggggttgattacaatgacttgaagcctagcgacatggttgttgttaacttaaagggtgaagttgttgaaggggacatgaatccttccagtgacactccaacgcatacagtactttacaatgaattccctaatattgggggaattgttcatacgcattcaccttgggcagtgtcatttgccgctgctaagatggatattcccgcaatgaacacgacgcatgcggacacgttctatggtgatgtaccagctgctgatgccttaactaaggaagaaattgaagaagattacgaaggcaacacgggtaagaccatcgtgaagaccttcaaggaacgtggcattgattacgaagccgttcccgcttctttggttagtcaacacggtcccttcgcttgggggccaacgccagccaaagcagtttacaacgccaaggttttggaagtggttgccgaagaagactatcacactgctcaaatgacgcgtgctaaccgggaattgccacaatatctattggataagcattatctgcgtaagcatggcgccaacgcttactacggccaaaacaatgcccattctaaggatcatgcggcacgtcaataactctgttatccacatttaaaaccaaattatactaaaaggagtgctcaattatgttatcagttccagattatgaattttggtttgttaccggttcacaacacctttatggtgaagaacaattaaagtccgttgctaaggacgctcaagacatcgctgacaagttaaatgccagtggcaagttaccttataaagttgttttcaaggacgttatgacgacggccgaaagtatcactgacttcatgaaggaagttaactacaacgacaaggttgctggtgtgattacttggatgcacacattctccccagccaagaactggattcgcgggacggaattattgcaaaagccattgcttcacttggcaacgcaatacttgaacaacattccttatgctgacattgactttgattacatgaacttgaaccaaagtgcgcacggtgatcgtgagtatgcttacatcaatgcccgtctaaacatcaacaacaagattgtttacggctactggggtgatgaagacgttcaagaccaaatcgcacgttgggaagacgttgcagtggcctacaacgaaagctttaaggttaaagttgcccgctttggcgatactatgcgtaacgttgctgttacggaaggtgacaaggttgaagcacaaatcaagatgggctggacagttgactactatggtatcggtgatttagttgaagaaatcaacaaggtttctgacgctgacatcgacaaagagtacgctgatcttgaatccaagtacaccatggttcaaggggacaacgatgcggaaacttacaagcactccgttcgggttcaattacaacaataccttggaatcaagcgtttcttggaaaagggtggttacactgccttcaccacgaacttcgaagatctctggggaatggaacaattacctggcttggccgctcaattattaattcgtgacggttacggcttcggtgctgaaggtgattggaagaccgctgccttgggccgtgtgatgaagatcatgtctcacaatgatcggacagccttcatggaagactacaccttggatctacgtaagggccacgaagctattcttggttctcacatgttggaagtcgacccaacgattgcttccgacaagccacgggttgaagttcacccattggatattggtggtaaagctgacccagctcgtttggtcttcactggttctgaaggcgacgccattgacgtcaccgttgcggacttccgtgatggcttcaagatgattggctatgctgttgatgcgaacaagcctgaaggcgaaacacctaatttgccagttgctaagcaactttggacacctaaggttggtttgaagactggtgccttggaatggatgaaggccggcggtggtcaccacaccatgctttccttctccttaacggaagaacaaatggaagactttgctaccatggttggtatgacaaaggcgttcatcaagtaagctaaacatttaaaatggttgtggttgccggcgagcaatcacagccatttttttaacgaaaggtggtttaactaaaatggacaagagtgaaaaagaaaagatgattactggcgagctatttaacgtctacgatccggagctaattgcagagcggggagcggctcgacaacaggttgaagccttaaatgaattgggtgaacaggaccccgaaaaaagtcagcaactggttaaacgcctatttggggcaaccggcgatcaggttgaggttcacgcaacgtttcgctgtgactatggttataacatttatgtaggagaaaatttttttgccaactacgattgtacgatattagatgttgcccccattcggattggcaagcattgtttattgggtcccaaggtgcaaatttattcggtcaatcatcccgctgaaccagaactacgccggaatggcgcaatgggaatcggcaaaccggtgactttaggtgatgatgtgtgggttggtggcggcgcgattatttgtcccggtgtcactttagggaataatgtcattgtggctgctggtgcggttgtgacgaagtcatttgggagtaacgttgtgttgggcggcaatcccgcgcgggtcattaagccattaaagtaagggtaaacgaatacggacattaagaaagacctagccacttcagcgtatgaggtactgaagtggttaggccttttgaataatcaataagtgtttctaaaagagtgccatcgacgtgcatgtggcgcaggtcgttgggcgtgctttcttaaaaatgccgcttgatggtgcggagggatgacgacgtttagcttgggcttgggagccgacggtgtgggatgtttggtgggcaagataggtttatagacggtcatcgttgttgtcctcctcattgaatcagtgtgatctggctatgagaatgacaacagtataagctatgtacggccatggggcatgcttagcactagactttagcaagttaagcacctcaaacactcgaattggcagtttaataatggtggaaattaaaaagttgtgaccacccttaaagggtcacaactttttcgtgtacaggttgattgccgaatgattagtggagcaggccactaaaactcagccagccgcctagtcccaacaggccaatggccagcagcgtgaaaataccgacgagtgttgaggtatccgtatccagttgcttaattcgtggccaaaatttgaccaacatcaatagaatcaaggcgattccggttgcgagaattaagatccccgttaattctgtaccagtgaacatttatatctccccctttacaactttattataaccagttttgtggtgaaaggggaaataattcccgtggattcgggtgctatggtaaaatataatctaattagaccgttaagataatgtgagaggtgaccgaaatgattgatcgaattgaagctagtgcagatgccctatgggtcacaccggatgagactggtgccatgaaaattgggtttgccgataacgggcgtcaattggtgggaccggtgacggcaattgagtggctgattgcgctaggtccagttaaattgggaacgccatttatgattattcgcggtgaacaggaatctttgacgttacgcttaccctttagtggacgcgtgacaaaactgaatactcagctgaatcagcaacctgaacaattgaatcatcgggatgattcaattgcctggttactcgaattaattgatgaatagaaaaggagataacagcctatggaactcgactggcaggtgaaagaacccgtaaccagtttgaagcgatttttgactaatcagggtattagtcatcgggtctttagcgatttgaaacaacagggaacaattcgcgttaatgggcaggtgaccacaccggcagtcactttggcagtgggcgatcacgttgcggttacgtttccgccggagactgccgatgaggcggttgctgtcagtcacgagccgattaccgttttgtttgaaaatcgggattggctcgtggtggataaaccagctgggttaaatgtggtaccaggaccagccaatcgaacagataccttggttaatcggataaaaggatactgggaagcggaacacgccgagaatttagttcctcatattttaacgcgcttagatcggtttaccagtggcgttgtgtgggttgctcggcaccggttggccaacagtctagctagtcaattacaggcggcccatcaaattgataaacgctacttggcggttgtcagtggacgacttgaagcagaccatgcggtgattgatgcgccactagcgagtgatccgactggttataatcagatggtgtcaccgaccggtaaaccggcgcaaaccgagtattgggtgcaacagcgttttgcaacggcaaccgtggtggctgttaaattacatacaggtagaacccatcagattcgggctcattttgcgtcattaggccatcccttacttggcgatgccttatacgatgggcctgtgactggtatcaaccgtcaagcattgcaggctctttcactgacgttcaaagatccctttacagatgaacagcggcattttaccagtgaattaccggcagattggcatgccctaatacaccagttatcggaggagtgacacaggaatgacagaaaaagaacagttgacgtgtttagtggatggtgagccaatctcactggaaacgagtctacagttagcagagttggaagcgggattgcggaatcgcattaagcgtgactatccccaaagtaaggtgacagattatatctgtggtcaccatcttctaaaatatcggttggatcacgttgatgccatgatcaatgccgatttaaagcaaacgaagaagatcaatcataaattgactaaagccctgcaaagtgacgactatgacatcatcgatgttaacgaaagtctcactaatagcttaacgtttggtcagaaggtgtcggatgaagttgcgcgctttggcgggtcttggggcttcattttcatttttatgtttgttttactgggatggatgatcgtcaatgggctgcatttatttggtgtcgactttgacaattacccctttattctgttaaatttagttctgagttgtgtcgcggcgattcaggcacccatcatcatgatgagtcagaaccggtctgctgaccgggatcgcatgatggctgagaatgactatcacgtgaacctgaaatctgaacatgagttgcggttactgcatgctaaggttgatcatctagcgcagaatcaggtgccgcacaccatggaagtcgaacgatttcaactggaaattttaggcgaaattcgccaagaactcgctgagttgcggacagaaaaatcggccgcaaccacagcgacacgaagggagtctcaccatgaggacatggatcaccgctagtgtcttgttcctcgttggcctcatctttggtcagcgggtagctggacgggttcattcatagagtgcccggcaaatcctttgacaaacctgtaatcctccgttagtctggttaaagaactagaaatggaggattttttgtgataattcgtgaagctcgaccaacggatgcgcctcagatagccccgttgatgaacttgatctacgatgaaatggcgttaactgacctggaagacgttccaggccccgacttactgaaggtcatcacggcagcttaccgcaccaggacgtatttatccggtgcggcaactacggtggtggccgaggccaatggccaagtggttggggtagcgtttggttatcccggcgaaagggaagacattgtcgatgatgtgatgacgcgattagcagcgaaaagcgatgcgtttgatgaaccatttgatttagaatccgagacagcggctggcgaatggtatttggattcactggcggtctcgccggatcatcaagggcagggaatcggtcgccagttgttgcgggccttaccggtttatgcgcgtcgcgatcagcaagcggtgattgggttaaacgtcgacttagagaacccgggtgccatgcgtttatatgaacgcatgggctacgaggtgacggggacccaaatgattgggggccatgagtactaccacatgcaactggagattggtgatccagttcgtgtgactaactaaacacgtaaatgcgggctaggagcactgttcctagccttttatagtagtcttctttgtgatttaatgaacaaaccgttgtatactaagcgtaataaatctatgagaaggagtggatcagtaatgtttcgtgcgatgcgattggcaaatgaggcgttaacgcctgaacaaataaatacggtcttacagcggcgaacagcgggggtcttagcggtccacggggatgcgggttacccatatgccgtacctctcagttattactttgatggaacgcatttttactttcatggtgcgccagttggtcataaaatggcggccattcaacgggacaaccgggtttccttttgtgtagtcgatcgggatgtggtagcaccagcagcattgaccaatgagtttcgcagtgtgattgcttttggtcgagtcaccattgtgacggatcccaagcggaagcgggaattgatgcggcaatttgctttgcatctggcacctgattacgcccaaaaaattcatcaacatttagatcagggactggatcattttagtttattggaaatgacagtggcgcacatgaccggaaaagaagcggccaatctcgcacagtctcactgatctgaaaaaaagcgcggtggcgcttttttgtttattgttgcaaatacacttaaatgagcttatgctagaacttaatcagttatgagcgaggagtgtgacctgatggcgacaaaattaagagccgttactgaagctgatttgccagccttacagcaacttagtcgaacaacttttagtgacacgtttggggcggtgaatacggccgccaatttagcagtttatttagagcgggcatacagcttaccgcaattagcccgcgaactggctgagccgaccagtacgtttacctttatttatcaagatgagcagctggcggggtatttaaaattaaattggggagcgacacagtcagaagcgcagggggctgactgtctcgaaattcaacgaatttacgtactccctgcgtttaagcgacaaggattgggccgtcaattgttccaattagcgcggcaaacggccgagcaattgggaaaaacggcgatttggctgggcgtctgggaacataatgattcggcccgtgctttttatcagcagatgggattcgtcgttgttggtgaacatgttttccagttaggacattccacccagcgtgatttaattttgcgtaagacgctggtataatgtgagctatgacaattttaggaggctaaccaacgtgaaagataatttacaattaggtgacgcagaattcaatcaaatgctattggtattgaaagagcccgttactcaggctaaccataaagagttcaaattcttagatggtgagatgcaagagattgctcccgatatttgggcaatgccagcttacatgacggccgacgacgagtttacgatgttcttcttgacaacaaaattagcgtcaggtgaaacggtcgttacctttgccacgggtgaacaagcggatggtgactttcgcttgagtgaacccatggtcacgggtgctggggtcaataccttgtttgaacaccaaccagatcgggcaaaacgcgtgttgaagtttctaaatgatatttcgcgagctgacgagggtaactggcggatggttgaagactaacatactttcaacatgagggggcgatacggtagtgagtacgaaaaagataaacgtccccctgttactggcaccgtttatttcacgaatgggcgatgccctctacttatttgggttaaattggtttgtcgtacaggccactggtaatgcggctttgctgggcattattcaagcggttggcggggttgtcttatttttaggcgatctcttctgtggcgtcgttgtagataactttaatcgtaaatgggtcgtggtattggccgaactcgtgagtgtgttgggctgtattggggtggccctctggttagatcctcttcatctaactgccggcccattactaacgctaacggttattttagatattggattagcttttagcctgccagcagctaagtcaatgattcccgaattgatcgttctatccgctcgccagcggtttaatgccattagtaataccttacttgaccttgccaatattttggccccgttattaggtggctttttactgaccctccactggttaaatttgcggggttttttacttattaatggcctatcttttctcctatcattggggttatatctcagtattcgttatcctccgcgccactcaacgcaggcgacactgggaattaaagccagcctgctgaccggttggcggtatgtctggcaacggccaattctaattgaaacgattgctctgggtgggttgttaaatgtgatgtacgcggcctttaaactcgtgctcccgtatgatgttcaacacatctatgggggacagtcagcccgttacagttatttattgattgccatggcggtgggcggaattttaggtggcctgcggttgactttagctaaacgattaccgcgacaccagcagaattatggggatctgggtctgttagctggcatgctcttactggctggtgcttttcctaattattggatgttactggggagcagtgtggtcattggcttttgctatacgtgttttgatatccgagcgttgacgattacccaggagctaactgatccggcttacttgggtcgaatgtttggccttttatttttagcaatggatgcgtttcaacccttgggcagttttatttttgggtttgtgacggatgagttggggaatgcgaccttactgttagtcggtagttgtttcctaatcggtttagtgggcatttatcaaggctatcaacggcttgcccggcggtcacgatgattattaaatggtcttgacaagcaggcgtgagtctggctataatctctattaatatagtcctttaacattgtcccgtgaggcaatgaaggtacgacgtttctggcgcaagctgggcttaattggcgtacacgtttccttacgggacgggtgcgctttttttcatggacaaggaggaattgattatgcagcagccgtcacattatcgtaatcccgatgcgttgattgatatcgacgagcggcccggatggggccaatggttggggttatcactgcaacatttattttcaatgtttggttccaccgtgttggtgcccattttggtggggttaaatccaggcattgcgctgtttagctcaggggtgggcaccctcatgtatatcttaattacgcgaggaaagattccggcatacatgggctctagcttttcgttcatcatgcccatgattgccctgatgaaaaccacggggtatccggggattgctcagggaacgttggcggtgggactagtttatctgatcgttgctttagtcgtggcggctgtcggtccggactggattgatcgcgttctaccaccgattgtcgttggcccgatggtgatggtcatcggactatcactagccgggagtgcagcacaaaaggctacggttgatagtcaaggtacgtatcactggcagttctttgcggttgcgatgattaccttactcttaacgattggtttcaatttattcttgcggggctttttagccttagtgccaattctgttagggattgtgggtggctacctcgtggcggtgatatttggtctagtcaactttacaccagtgctacaggcgggctggtttcagttgcctaaatttgaaattccgggggtcagctattccttacatttttattggggtgcggtgctaagtttggcgcccattgcttttgtcaccatgacggaacacattggccacattaccgtgctcaacgagttgacccatcgtaacttcttccgtgatcctgggttgacgcacacgttagctggcgacggtgtggcttcaattatcgcgagttttgttggtgggccgcccgtcacgtcatatggcgaaaatgtgggtgtccttgccatcacccgcgtacacagtgtgtatgttctgattggcgcggcgacgtttgccgtcatcttcagttttgttggcaagttgagtgccttgatcgaaagtattcctaatccggtaattgggggaattagctttcttctatttggtgttattgcgtcaagtggtctgcgaattctgattgaaaaacaggtcgattttaatcagaaacgtaatctgatgattgcctcagcaattttggtcattgggattggggatgcttacctcaaaatcggtcaatatcaattctcaggcctagccgtggcggctgtcttaggcattatcttaaatctagtattgccccaagcagctcacaaataaaaaaagtcctcgctattgtgcggggacttttcggatattggaattagccaatttgccaatagcggagaagggccattgccatgatgccaatgacgacgaccatgagtaagcttttggtgaggaccccagcgatggtcgcgggaatggcggctaaacagttggcaacatttagcgtggctaactgaccagcgtgggcgatgaacaggctttgacaacatagggccgtcatgatcgtgatgggaacaaatgacaaaaagctcaccagccagcccggaatcgtcagttgtttgacaaaaataaaggggagcgttcgcgaaagaatcgtgacgagtccgcatcccaggatcacccataattcggttaggctgattgacattttttcatctccattccaaatagacatccggcaactgtggcgactaatagggcaaagttggcgctcatgaggccaatcatcaggtaataaatgagagcaacaaaccccatgacgaataattgcaggcgtattccgaggtgtttgtcactaatcaactggagatagacgagaccaataaacatggctgtcaaggcgaagtcaaaccccaagcggcttggattggcaatgagtccgcctagaatagccccaactagggttgctagtccccagactaaataggcaacaagattagctgccgattgccaagcaaagcttaattgtccatgggttttattttgtttattcatggctaaagcaaaggtttcatcagttaccagcgtaccaatcagtacattacgaattaaggattcatggcgaaaatactgggccaagctggtactcattagaatcattcgtgaattcactaggaaggtggaaataaagattgctgacagggggtcatgaattaagagcatgctggtgatgatgaattgggcggagccagcgtacacaataaatgacaggccagcaaccatcagtaaactcaagtgactcgtgtgggcaacaattccgaacgctaagcccacaccaatgtagccaaagacagtgggaagaacgtcacgaatgcccgctctaaaagttaggtctggacccataaataagccttctttccgttttctaattaaagtctaacctttagtttagccgtgtctccgggggcctgtaaacctgtaatttatttgtaaatatgccggctgaaaaaagttgagggaaaaggttgcatttcggtaaagagggttgtatgatactctcattgatgacgaacgaaagtgagggtatgggcgatgaagatgaacttaactgaactagcagcttcagcacacgttgatgctagccgcattgaggactacgtaaagagtgggctattaggtaaggaacattcgacgacggagttcgatgattcagatttgtactggatcgacatgattcaatgttttcaggataacgggacgtctttagacgacttatccggattaatgccacggtgccgcaagggccaatcgcagttaacccaggtacagtaattaaggtaatgaatgagtaaaatgggtgaagagaacggccggtgatgatgagtcccggctgttttttgtatgcatactgtgggataactaaaacggccggtcgagaagaaatcctcgatcggccgtttagtctattctgctttaacttgtttaatcagttgttgcatggcttgtgcttgataagcagcggcggcttgctgggtaatttgtttctgttgcgcagcagtcattgatgggttcttcatcatcgctgccattacggcttttttaacataagcggttgcagcggccttttgttttgcttgatagcttttagaactagctagtttctgcaatttcttagcttgtggggcacttaatacggtccagttcttgttgatgtaaatgatattgtgttccttcacgtattggtggccgttgtcagccaaaccaaaccagaacttcgctgtactatttttgtattcgcgataggtcttaatcgtgacaattcggttatgacccgttgtccgtttgaccgtgttactggtcgtgaccttagctcgagtatgattcgttttcttagccgaagcgctagtcttgtagacgtaaacgcggtgcttatcggctgttccaatcgattgatacagcatcatcggtagattcttggatggtgaggctgagtaaatccgttgcgttttagtttcagtgacgttgtgcataccgtagtggtcatggtcgttcttaacaatgaagaagatactagccacaacccctgcgactgccagaatagtcaaggtattcgcaaccacgcggttactgagataaacatagaagtaaaatgcgagaatcgcgcaaatgacaagtgtaacgataatcattaggcggcacctcccttagttgcagcttcatcggtactttgatcggttacgtgcgttgaacggttgctcccctttaagaagaaagccacgattaaagcaacgaaactaaagccgatagccacccagaaagcggcatgataaccggttagcgtggcattaatggccttatccgcgtagcttaatgggttagtggttaagacgtgtttggcagggatattattcttagtgacgttggtcaagacactcactagaatggcggtcccaacggaactagcaacttgtcgttgggtgttgttaacagcagtcccgtgactaatcagattcattggtaaggcattcatcccagcagttgtggctggcatcatgaccatggcaatcccgaacatccgaaccgcatacaagatgacgatgtataacgtcgaggtatccttagtaatccaagcgaatggtaaagtaccaatggttaagaggaacatccccatgattgctaagcgcttagcaccaaaacggtcaaatgcccgtccagtgatcgggctcataacccccatcatcagagcaccggccagtagggttaagccagagtgaaacgcggacatgcccttgacgatttgcaggtataaaggaatgaccatttcaacgcccaccatggccatcataacgacagaacttaagatcgcagaaaccgtaaactctttagacttgtaaacccggaagttcaggaatggatcgtccatcgttaattgacgccaaacaaagagcgccacaaagacaaagccaatgattaaggttgatagcactttggcactgccccaaccatcatcaccaacagaagagaagccgtaaagcatgctcccgaaaccaatcgttgaaagcagtacggaccagatgtccagcggtgctttcttagtctcgagcacgctacgcatgacccaaaaactggcgatgatgacgatggcaacaattggaataatcatgccgaacaaatcccgccaagttaggttatcaatgacccaccctgacagcgtgggaccaatggctggtgctaaaccgataacgataccggctagccccatggccgttccccgtttgttagcagggaagatggtgagcatcatggtctgaagtaatggcatggagaccccaaccccaacggcttggattagccgcccgattaatagcatcgggaagtttactgccgaccagcagataacagtcccaattaagaagatactcatagcagacatgtaaagtaccttggaactgatggtcgtgatcagccaagcactgatggggatcatgatcccgttaaccagtaagaaaccagtggttagccactgaacagttgatgtggaaacatcgaaagccttcatcaatgttggaaaggcagtacttaaaatagtttggttcagaacggtacaaaaggtcccaatcagcagaagtgcaacgagcaatccgcgattataggacttaccgttggtatcaatagcatttcccaaagttaattccctcttttactcaaaaattatttctggaataaatatacgcacattgaacctctttgtcaactagcttgacatactttttagaatatatatactgtttagagaaaagcgaacatgtttctaaaataattttatatttttcacaaacgctttcattgttatggccatcgcgattactatcgggatgaccgatagaatctaaggcaggtgctagtaagtggatgatgaacaaaagaaactatttaagaagctgccgacagatagtttagttctcggaattggtgacgttgcggcagcaacaggcgtctctcaaagccaattacgttattgggaacgcaaaggctacattcaaagtcaggcagtcaatgatggtggtaatcgaaagtttacctataagacactgattcaggttcagcagataaaattcttcctggatgatggttatacattggttggggccgttaaacaggccaagcggcggcgcgattattttgacaaactacgagacttttttaccagtcgctttgaacatttggaattggccgatgatgcagttgagattgatttaggggtatttgatccacaaccagatcaacgactagtggcagatcaggttggagatcactggcagtttcgattggttcctttagaataggacggtttatttgtttctcaggggtaacaatggtaatctgaagttacggaagagcaagttgtggttggcagacaaaaactttcgagaccaatcgatcttctggctggattggtggtttaatcatgttgttgacgtgttgtgaaaccaggcgaataaccatgagtagtagcgcgttatcttgcgcatggactacgttgaccaaatgtcagcgtaagcgatcgtaaacctaaaacgacgtgtttttggaaaattaagttctttgatttttctctcgccagtcactgcttccgtgaaccgttcaagttttgaaagttcttgaacggttttttttgtgcactattttatgaaaaatatttaagaaaatgaagaaaaaattagaagattgatcgactaaaaagactggtaattcagtttttaggccaccaatgaaaatttaggggcaaaaaagttatctatttcattgtattttgaagccaacgtgttaagataacaaaatcgcaaaaaacaaaaaccagaaggatggtgttatatatgctgttacgacaagcgacgatggctgacttaccacaaattgaatcgattatccgtgatggccgtgagttattggcggcccaagcgattgatcaatggcagggctcatatcccaacacgtcaatcttagttgacgacatccaccaagggtggacggttgtcttggaagaaaacaacgaaattttggggaccgcggccattattccgggagaagatcccacctatcaggaaattgaaggtcagtggctgaccaagcaagcgccatatttggcaattcatcgcgtagcagtatctagtcaccatcatggtcgtggcttagccggtgaattgttccaacggttattcgatcaaattgatcatgccgcaaacattgaaagtgttcggattgatacacatccccagaacatggccatgcaacacgttattaaaaagaatggttttagtgaaacagggacaattgatttaacagcggctggcttgccaggaacaaaagactttgcgtacgaacggttgacggtcaacgctaacccagcgcacgtggtggcaaccgctacagtcaagtaaataaaggcttcctatattattagatataactagggcttagttggcgtgctgactaagcccttttttgtggaatcaactcataaaccttttgtgaggggagccgaaacgagcctgttcttttgacctaaattctgcgataatagaaggtagtaagtcatggggggcggtttagttggaaaagagtttgactggtggccgatttttactcgtcaccatcttgaacgtcgttattacgatttttgaattgttaggtggcctgttgtctggaagtctatcactgctatcagatgcctttcataatttgggggatgccctgtccgttgtgatgagttacgtggctcatcgagtcggcggccggcaacagacacggcaaaatacatttgggtatcggcgagcagaaattttggcggcgttactgaatgcagccgtactcatcttagtctctttgttattggcggtcgaagcggttcgccgactacttcacccagaacccgtgaagggcgacattatgttgttggtcgcggtcgtcagtttcctggccaacctgttttcaacgatcttactgaatcacggggctcagcataacttaaatattcgggccacttatctacatttactgagtgacgcgctggcgtcagttggggtgatcattggggctattttgattaccatttggcagatcagttgggtggaccccttaattacggttttagtggccctctacattatttatgagtcttggccgatcattaagcaaacatttgatatcttaatggaagggtcaccagatttggactatgaagcgattgcccaagatatttgtcagttaccagaggtggacggtgtccatcatttgcacgcttggttaattgatgaaaacaacgtggttttttccgttcacgtcaatatggaaaacttgccgctatcaaagattgagccgatttatcggcaaatcgaggccttgctctgtcgtaaatatggggtaaaccacgtgacgatccaagcggagtgtcgacggggaaaagacgagtcgttattttatgatcaaaatgactggcggcacgaatagacttgcatgccaagctgtttcgcggtataaaggaaacactatctagatgaggtgaacaatgatgactccgatgaaggaggattatttaaaaattatttttgagctaggcggtcgccagaaaaaggtgtccaataagcaaattgcgattagtttgaatattgcggcaggttctgtaacggaaatggttaataagatggcggctgagggcttggcagaacatacgccttacgctggtatttccttgacgaaccgaggcattcggttagctgaagacttggtccgcaagcatcggatttgggaagactttttggtggagaagctgggctatgccttgccagacgttcatgatgaagctgaggtcttggaacacgtcacgagtcctaagttgatcgatgccttagacgacatgttggggaatcccacgcattgtccgcatggtggggttattccagatcgacaggggcattatcacgaagacagtcacacggttttaaacgacgctgccgatggcgagattgtgatcgttgatcgcttcattgacaaccacgatctgctaacctatttaggggatctgaagttggatattggtgatcagctgaaggtactgaagcatgatccctttgagggacctgtgaccgtgcaaaatttaacggataacgctgaactgatcgtgagctataaagcggcgcactatatttttgttaagtaacttttaaaagcctgacggtgctcaggcttttttgctatcaatgtagccgattagcgacggtaaactttttatttcgcaaccatccggtgtgccgtataatataaatcgtacgaagaaggcggggacggtaatggctaatcaaaaaaaacgcgatcagttaatcttgcatacggccttgacggctggacgcatcatgattgaaaatggctctgagattgaacgagtcgaagacacgatgacgcgcattgccagaaacgcaggcgcacaaactagtcaactttttgtgatgatcacgggaattttgatggcaatcaatggtgaggttggcgcacagattgaaccggttaaacggcgaacatttgacttggaaaagattgccgtcgtaaacgacctgtcgcggcgatttgctgatcgccgcattacccttcaacaatttgccgatcaactagatcatctcgatagcattagtcgttacttcccgttttggttacagttactggcggctgcgttggtcagcgggcctttagaggtggtctttcggcacaacctgccggacttctggattacctgtgtggtcgggttgctaggctggtgggtttattatgtactaaataaatttattcaaattcgatttttatccgagtttacggcatcagcagcaattggtctgttagctgttttggtggtgcatttgggattgggtaacagcgttgacgacattattattggtagcgtgatgccgttagttcccggtgttcctattaccaattcggtacgggatattttagcaggcaatttagtgagtggaccggcgcggggcgtagaggctttggtgagtgccgcagcaattggatttggtattgcaatggttttacaattcttgtaagtcaggagggtgccccatgacggttgttcaattcgttattgaagtagtgggaacgtatgtcgccacgatcgcttttggtattttgattaatattccccggcgcgcattgaattttggcggttggattggcgtattgggctatctcctataccggttcacggtgctggctggtggcggttatgtcattggtaacttattaggggctgtggcgatcggggtggcctcgctacaagctgcccgattgaagaagatgccgatgattctctttaacattccagcgttggtgccgctggttcccggcggtcaagcctaccaaatgattaagaattttgctttgggacataacgacacggcggtaagctttctactgcaggttgtgatgatttcgggcgccattgcgtttggctttttgctgtcggagttggttaatcgggttcagcaacgactgcttcggcatcaccgttagcgattaggaaattcttaataaaacggtctagcctagaaatctagtggtggggtggtatactcattgctaggggtttcccagaatcaggtaggatgaaaggaatagttgcacatgatgttatttaatcgggatcgggaccggccgtggaaattcacgctggcaaccgtattgtttctgatcgtggctgtttacataaaggcacagaatgcttacgttgaatttttagattcatcgatcgttgatgtcattcaaaaaaaccaaccggggtggaagacactgttttatcgcggtgtgacgagcttggcagaaccaaagctagatattgtttgggtgttcatcttggcatttttactgtggggctttaagttcaaggtgccagcactgtggtgtttagcaacgttggcgggtggcgatgtcattgctagcctcgttaaaaatgttgttcaacgcagccggcccacggctcacttagcaattgacgatggttatagttttcccagcggacatgtatttggcacctttttgttagtagcgatgatttgggtgattttaatcccaatgatttcgacgagctggaaagcgtggttggtacgcattgtcctgatcatttggttgttactggtcatgatttcccgggtttacttgaatgcccatttcccaacagatacgattggtgcagcgctgttagcctatttgtggttacaggttgctgaagggttgtatattcggttagcacctgttatgaaaaaatggccgttgctaaagaagtctgaaatttaaagtatagaattaaacaccaatagagctgcccagaatctgaatgattccggacagctctattttttgcggttaaatcatctaaaaggtaagatggttttgaggcttatttaaggtcttgtaaccattctgtcgctaggtctagccaatgtgctacgtggggcaaatcagtaccaagtttccaagctgtcaccgaattggctaatgctaggccgtgggggccattgtggaaaacgtgaagttcggtatctacgccctgagctagtgaagcttgggcataggctaaggtattttgaacggggaccagtggatcgttagccgttgcccaaatgaacgttgggacgttggttgaggtaacgtgttgatcagcggcaatctttgctggggagtcggtccacattgctagtgtcggggcatccgttgggaagccaagcttaggtgaaatgacggggtagccgagaataacagcctgaacctttaattgttctggagtggtgtgagcctgttgattaaagtcagcttcagaccaccagtcattaaagagagcagtgatatggccaccaacggaaaaaccggcgaccaccagtcggtggaggtctacgtgccaggtagtagcgtgggcgtgaatagcggcaacactttgcgccaattcaatcacgggattgggcaagaggggcgtcttttcactaatgaagctgtaacggaggaagaacgcttgatagccgcgggcgacccatgccaaggctaaatcctcagcctgttgctctggaatgtgggtataggaaccgccagggacgatgatcacggtcgggtaagttaccgaggaatcggcattttcccgcaagtagccttgtagataagctgtgggactattaggtagtgactgggtcaatattttcaattgcgaaacctcctaaaataagtcatgataaggatacaatcaattataacgcatcgtttggtcgatcggaaagcaggtaacgtatggaaagaatagcaacaacgtcgcgtttacgggtgcggccgttaacggaaagtgattttgaagagtaccgacggctattagccttgccagcggttgctgcggctaatggatcgcccagtgatgtagatcgtgctgtgatggcgcgctggtttgcggcagatcggcagagtccctttgcgtttgcagtaactgacttaaccacagcccggtttatgggcgtcattttattttatcaacatgacgatccggaggagaaaagtggcaatccgcagtacgacgtcggctatttccttgatccagttgattgggggcaaggtatcatgccggaagccctaaaagctagcttgcgtcttgtacaacgggcagcagtggtgacacagacagtgtgggccacgtgtttggcaactaatcggcgttcccaaggggtgttaaccaaattgggtttccaaacggtgacggctccctttgttccagagggactaccaggtgaggcggtacaaccagaactattgtggcgcttggatttgcctcaaaataaaaaaagtgaattctaatcgtaatttcatcttgcaatgtcacacagggatggtatactacaaactatcgaatagaagaggcgcgaccaacaagagttgctttccggagatgggtcacatcgtagaaagaaagttaaaggggcggttgccgaaatttacgcattttgaccggatgtgtgggttgggtcctggttgaacaaatcagggactgtcgcagtcaaataatcggctgcggggcgctttcaacgatattgacttggaatagtgatctgtccaactctctttcgcaaagcaacttttgtggaagagagttttttattgcaagtcgtttcgagaaggtccttctagtcaagaaggaggaaacaagatggaacaaagtatgacaaatgccacgaccagtgaagcttctgatcaggtaaagcggggattaaagacccgtcatgtttcgatgattgctttaggtgggtgtattggaactggccttttcgtcgccagtgggtcagcaatctcaaccgccggacctggcggtgcactcgtcgcatatgtggcgatgggattaatggtgtatttcttaatgaccagtctaggagaaatggcaactaatatgccaatctccgggtcatttgcagcttattccgccaagtatgttgatcctgcgttagggtttgccatgggctggaactattggttcaactgggcgattacggttgcagttgatatttctacggcagctctggtgatgaagttctggttaccaggaattcccggctggatttggagcctgattgcgctagtaattattttcgtgattaatgccctatcggttcaggcgtttggggaaactgaattctggatgtcattgattaaagttgtcaccatttttgtcttcttggcagttggcttgatgacgattgtcggtatcatgggtggtcatgcaactggacttgagaactttacgtacaaaaaggccccatttgttggtggttttccggctatcttgagtgttttcgtagttgctgggttctcctttcaaggaactgaactggtaggaatcacagctggcgagtcaaaagacccagctcacagtgtgcctaaggcgattaatcaggtattctggcggattattctattctacattttagctatctttgttattgccgccgttttgccttacactagccctgacttactcggttcttctgcgagtgatgttgccattagtccctttacattagttttccagcgggccggtttggcagccgctgcgggtgttatgaacgcggtcattttgacctcagtgctttcagccgctaattcggggatgtatgcttcaactcggatgctgtattccttgtctaaggaaggttatgcaccgaagttgtttgaacggacaggaaagaatggaattccttacccggcactatttgccacaaccattgttgcggctttgacttttatcagtagtattgccggtccacagatttatctgtggttggtggctgcaagtgggttgactgggtttattgcatggtttgggattgccttatcgcacttccgtttccgccgcgcattcacgaagcaaggccataagttgtctgaactgagctatcacgcaaagtggttcccaattgggccaattctggcgttgatcctgtgtgtggccgtgattgtcggtcaggatccacaatcattcttctcgggccattgggaacaagtactggtaacttacatcagcgtaccgctggttttggtgctgtacttgggttacaagcttaagaagcatactaagttgattccattggatcaggttgatgtgtcacccgttcataaggacggaaccttaaaagaatcggcaactgaagattaagaaaaataatgtgtgggcagataaactgaaataatattaacggcgtctcgttaggcttatgggctacgaggtgccgtttttaatgaattgggtaatgaaaaaatggccacgatatattgtcttttacgaagcaggttggtacaatatgtggtgttgaaattttggccgagaaatcggcgcgtcgttatttaaaggagagagattgcatgcttgtattatcgggaactatcggagccggcaaaacgagtctaactacgttgttagccgaacatttacacaaaccagccttttatgaatcagtggatgacaacaaaatcttgccactgttctaccagaaccctcagaagtatgcctttctattacaaatttactttcttaacaagcggttggatagcattaaggcagccaatgcggatgatgagacagttttggatcggtcgatcttcgaagactccttgttgtttcacttgaacgctgacctgggtcgagcaacgtctacggaagttgatatctatgactccttgctggccaatatgatgcaggaattgccagaagcgacgcataaaaagaacccagacttgttgatccacatcaatatttcgtttgaaacgatgttagaacggattaagaagcggggccgttcctttgagcaaatcgatcatgatccaagtctatatgaatattatcaacaattggatcaacggtatattgactggtataacgcctatgataagtcacctaagatgcaaattgatggtgatcaattagacttcgtagaagatccagcagcccggcaacaggtcttacacctaattgacgagaagattgcttcactttagtcgttgtctttgttaccaaaatgcggtatgatagcgtcaattaataaacacgaggtgcctatccagtagacggccagagaagcggggaaagctgcaagccgcaacgtcgaaaattccagcactaaaaaagtgggcgggtaatgccgcacggtgcagaccgttatcatgttcaagggtgtcattgcgtgcaatgacgaacttgggtggtaccgcgaaggtcttcgtcccatgtgacggaggccttttttgtatcatccgcaaattagagaggagttatttcagatgttagatttaaagttgattcgccaagaaccagacttcatcaaagaaaagttggcaacccgaggcgttgacccagccgatattgatgcactattggaacttgatgccaaacgtcgggaactaattgttaagagtgaaacgatgaaagcacaacgaaacacggtgtctgatgaaatttcacaattgaagcggaataaagaagatgctgacgacaagattaaggaaatgcgtcaggtgagtgctgatatcaaggatattgatgcgcaattggatacgttaaaggatcaagtccaagatgctgccgcgcatttgcctaatattcctaacgataatgttccagttggattaactgaggatgggagtgttgaactccgccaatggggtgagaagccaaatatggactttacgcccaaagcacactacgaaattggggaagatcttggcatcttagattttgaagctggcgctaaagtttctggtagtcggtatctgtattatctgggtgccggtgcgcggttggaacgggccgtgtacaactttttcttggatgagaataccaaggctggatttaaggaagtcttgccgccttatatcgtgaatgacgattcgatgtacggtacgggacaatttcctaagttcaaggaagatgtttaccaattaaaggatgaagccatgaccttgattccaacggccgaagtccccttagtgaactactatcgtgacgaagttattcctgaagaagaactgccagtttggtttacggccttgaccccagctttccggtctgaagccggtagtgccggtcgagatacgcgcggactaattcggttgcaccaattcaataaggttgagatggtgaagttctgtaaacctgaaaattcgtgggatgagttggaggccttaaccaagcatgctgagagtctcttacagaagttaggcttggcttaccatgttattaccttgacgactagtgatatgagctttaccgcggcgatgacgcacgatctggaagtctggttccccgaacaacagacttatcgtgaaatttcaagttgttcgaacaccacggacttccaagcacggcgcgcccacattcaatatcgtgatgagaatggtaaattacaatacgtgcatgcgttgaacggttccggtttggcggttggccgagcagttgctgcgattttggaaaattatcaaaatgctgatggttccgtcacaattccagatgttttagtgccttatatgggtggcttaactaagatcaccaagtaaagatagctaaatggatcaaaataattgtcatgacgtcgttaatcaggctgcgtcatggcaatttttgtttgctaagaaaggtggggggaccgataatttcacgatatacaaatttttttgcaaaaaaatgcaaaaaaggactagcttttttttcgctggtacgctacaatattaaatgttgttgagagagtagttattcagtccgcgaatatttattcaaaatatttcaaatttctggttgacaagttttcaacggcatggtaaattataatagttgtttcgaacgagagcggttaacgttttctgaaggactatggaggattagctcagttgggagagcgtctgccttacaagcagagggtcacaggttcgagccctgtatcctccatcaggacttaggtccttggcgttagttcgccaacgttgcaggtgtggcggaactggcagacgcgctagatttaggttctagtgtcttatgacgtgggggttcgagtcccttcacctgcattaactcaatattgcaaaatatttgaaaaagtattttgccgacttagctcagttggcagagcatctcactagtaatgaggaggtcggaggttcgaatcctctagtcggcatggtaacacaatttaattgccaatatgcggaagtagttcagtggtagaacatcaccttgccatggtgggggtcgcgggttcgaatcccgtcttccgctttgcccttttgccggggtggcggaattggcagacgcacaggacttaaaatcctgcggtcagtgatgaccgtaccggttcgatcccggtcctcggcatttaattaaatatttattatgcacccatagcgcaactggatagagtgtctgactacgaatcagaaggttgtaggttcgactcctactgggtgcatttttgttgctcatgattaggttcatgacatcatcgggaagtagctcagcttggtagagcacctggtttgggaccagggggtcgcaggttcgaatcctgtcttcccgataactgactaactgtcagcgagctatctcgggaagtagctcagcttggtagagcaccacgttcgggacgtgggggtcgcaagttcaaatcttgtcttcccgattttttattgcgaccgtccccaacagaagtgatgaaacgatcgactccttacgtaattgtttggatgtcggtcgtttttttgttatgatagtttaccagaacttatttggtccgggtgcagtctaatccgttgcattttgatggaaacttcgtataatattagtcagcattagtcaaataagtttcgctgaaggggggacggtaatggagaatcaaaatatttcggatattatcgagtcttacttgaagcaaatcttggctgagtcacaacaagttgagattcgccgggccgagattgccgatcaattcaacgtagtcccatcccagattaattatgtgattaagacccgttttacgattcaggacggttatgtggttcaaagtaaacgtggtggcggtggctacatccgaattgaaaaggtcaagctactagataatcttgacttcatcgattccttagttacagcggtgggtgatcagattacccgtcatgacagcctagcagtggtccgcagtctctttgaagctggtacgatcaatcggcgggaagccaacattatcttggcggcgattgataaggccgctgttgatactggtgaccgcaccttaaatgaaagaatacgggcgcaaattttaatttcaattttgaatcacttgcgctatgagagctaagaaagtgaggagtcgcaatggacaatttatttaccccaagtgctaagagcgtgctcgttttggcacaggaacaagcgaagtattttaagcaccaagcagttggtacagaacatttgctactcgcactgacaattgaaaagaatggcattgctaataaggtgttgcaacagttctcggttagtgaggacgacgtgcgtgaagagattgaacgtttcacgggctacggcacattagccaacacagataaggatagttatttaccctactcgcctaaggctaagacattgttggctttagctggtgatgaagctaaacgcttaggtgctgctaagattggtacggaacacctattattggcgttattgagtgacgaaaccattttgtcttctcgtattttgaagaatttaaacgttgaattaccagatgcacgcaaggtcgtgttgcggaagctcgggattgcggatacgcccaagcggcgtaatgacagccggacgcggcgagcaccccaaggtggcaccccaacgctggactcattagcccgaaatctaacggacgctgctaaagaggggcggatggatccaactgtcggccgcgataaagaagttaaacgggtgattcaaattctgagtcgacggacgaagaacaaccctgtcttaattggcgaacccggtgttgggaaaacggcgattgcggaaggcttagcccaacgtatcgtagctggcgatgtgccagaagatatgcaacagaagcgattaatgatgctagacatgggatcattggtggccgggacgaaatatcgtggtgaatttgaagatcgattaaagaaggtcatcgaagaaatttataacgatgggcaagttattctctttattgatgaattacacactttgattggtgctggtggtgctgaaggtgccattgatgcgtcgaacattttaaagccagccttggcccgtggtgaactacaaaccattggggcaacgacactggatgaatatcaaaagtatattgaatccgatgcggctttggaacgtcgatttgcaacggtgcaagtcaatgaaccaacacctagtgaagccctacagatcttgaaagggttgcgttcgcgttacgaagatcatcaccatgtgaatattacggacacggctctggaacaagcggtgaagctttcgggtcgctacatcagtgatcgtttcttgccagataaggcgattgatttgatggacgaagcctctgccaaggttcggattgatcagatggatcgaccaactgcagcctctaagcaggttcaagagttaaaagacctggcggcggaaaaggaaaccgctattgaggcgcaggactttgaacgagcggctaaactccgagcggaagaaatgaagcttcgagaaaaagtggctgcgcgtgaggctaaggctaaagcagcgagtgaggaagaaactcggcattatgccttagacgtgacgggtgaagacgtggccgatgtggttgctgagtggacgggagttcccgtaacacagttgaagcagacggatgccgatcgattggttaacctggaaaagatcttgcatcagcgggtcattggtcaatccgaggctgtttcggcagtgtctcgcgcaattcgccgagcacggtcaggcttaaaggatccaaatcggccaattgggtcgttcatgttcttaggaccaaccggtgttgggaagaccgagcttgccaaggcgttagctgaagccatgtttgggtccgaagataatatgatccgggtagacatgagtgagtatatggaaaagtactcaactagtcggctgattggttcagctcccggttacgtggggtatgacgaaggcggtcagttaaccgaaaaggttcggcaaaagccatattctgttgttctctttgatgaagttgaaaaggcccatccagatgtctttaacattttattgcaagtcttggacgatggctatttaaccgattctaagggtcgtaaggttgatttccgaaataccatcctgattatgacctctaacttgggtgcaactaagttacgggatgaaaagacggttggatttggtgctgaagacatggcgaatgattatcgggcgatggctggaactatccgggaaacgttgaagcaatcattccggccggaattcctaaaccggattgatgaaacggttatcttccattccttacaaaaggatgaacttcacgcaattgtgaagctgatggcacaacagattgtggctcgggttgcagaacaaaacatcaagctgaagattacaccagcagcgattgatgtggtagccaaagctggctttgatcctgaatatggtgcgcggccaattcggcgggcattacaaacgcaggttgaagataagctgagtgaagccttacttaatggtgaggttaaaacgggtgatcaagtcaccattggggcaaccaaaggtgaagtgacggttaatgttaaaacaactgatggtcctaaagccgttattaatgcttaactgctaaaatcgagcaattagttaataaaaagcacagcgggttactaagaatgattcagattcttggtaacccgtttttgtgccgttaactaggagcaatctatgccaagttctacattcggccgattaagttaatcgagtagggccaatataatagaagaaatcaaataagttgggataaataaaaggcgcttatcggtggaactcccgcctagctggtgataggtgactgtggtacacttactttaataagcgggatgaaagggtaaagatatgagaagagaagaacagttaaaccacacacgggcggccatcttaaaagctgctagagaacaatttttaacgcaaggatatcaggcaacgtcaacgcgagaaattgcccgtattgttggaattacgcaaccggcgttatatcatcactttagtgataaagaagtcatttttttagaggttattaagctggttggttctgaggtgcaacaaggattaaccgcagttaatgaacaattgcaaacggatttaacgaaagacccagtggcagcattgacggcggtgacggaggttttgactgctgtacatccgcgtgatgtcttcacggtgattcacagcagcttccggtttcttaaaccggccaatcagcgtcaactagggatgatcttcatgcaagattacctgcaaccgttgcagcatttctttgaactgggtgttgtaaccttgcagcctgggttggcggctaaggatgcggcgtcattttacctgacgagtttgagtcctttattcaatacctttcatcacgtggggccagcggatgccacacagcatgatcagactatcgccctgattaaattaatattatttggtgttgctaccaaaaagtgagcgtcaattattgacatttagtaatggatttagtattatatcatttgtatgcaactgtgaactgaaattgaacgtgccgatatattgtccggtgacgtttgttataagaagccaaaagcaaattgagtgatttgtttttggattttttttgccaaaaatccgaagaaaagtgcatttgtaatcaaaatgtaatatttcggtgaggccagtcacagaataaataggagaggtgaacaacttggcaggacacttagtgaaatacgggaaacaccgtacgcgccggagctattcgcgaatcaaggaagttcttgatttacctaacttgattgagattcaaaccaattcctataattggttccttgacgaaggtttacgcgatatgttcgacgacatcatgccaatcgaagattttcaaggaaacctttcgttagagtttgttgattatcagttactagaacccaaatacagcgtggatgaagcacgggaacatgatgccaactactcggcaccgctacacgtcaccctgcggttaaccaaccacgaaacgggtgaaatcaaatcacaagacgtcttctttggtgactttccattaatgacggcccaagggaccttcattattaacggggcggaacgggttattgtttctcaattagtccgttcaccaggggtttacttcaatgaagatacggataagaacggtcggacagtttacggtgccactgtgatccctaaccggggtgcatggctagaatttgaaactgatgcgaagaacgtttcttacgttcggattgaccggacgcggaagatcccaatgaccgaattagttcgggccttagggtttggttctgacgatgaaatcttagatatcttaggtgacaacgaaagcttgatgcagacgttggaaaaggatatccataagaacaccgatgactcacgtgtcgaagagtccttgaaggatatctacgaacgcttgcgtccaggtgaacctaagacggcggactcttcacggagtttgctgactgctcggttcttcgatcctaaacgctatgacatggcaccagttggtcgttacaagactaacaagaagctgagtttaaagacccgtttgctgggcttgaccttagctgaaacgttggctgatcctgataccggtgaaattattgccgctaaaggaacggtcgttgacaaggacgtgatgaagagcttagcaccattcttggatcaagatgatttcaagatggtgactttccaaccttctgacgaagccgttgtcacggaaccactaaaattacaaattatcaaagtacaatcaccagatgatccagaacaagaagttcctgtgattgggaatgggaacatcgatatcaagctgaagcacattcgtccagccgatattattgcatccatgaactacttctttgacttacaactggggattggtaacactgatgatattgaccacttggggaaccgacggattcgttccgttggtgaattactccaaaaccaattccggatcgggttatcccggatggaacgggttgttcgtgaacggatgtccattcaagatgctgcgacggtaacgccacaacaattgattaacattcgtcctgtcgtggcctcaattaaagaattctttgggtcttcacagttgtctcaattcatggatcagactaacccgttaggtgaattaacgcataaacggcgtctgtctgctttgggacctggtgggttaacgcgtgaccgggccggttatgaagtccgggacgtgcactatacccattatggtcggatgtgcccaattgaaacgcctgaagggcctaacattgggttgatcaacagtttgtccagctatgcccgggttaacaagtatgggttcatcgagacgccataccgtcgtgtttcttgggatacgcataaggttaccgataagatcgattacctgacagctgatgaagaagataactatgttgttgctcaggccaacacgccattaaatgatgatggttccttcaatacggatacgatcatggcccgtgcccaatctgaaaacattgaaaccagtgctgaccggattgactacatggatgtttcgcctaagcaagttgttgcggttgccacggcatgtattcctttcttggaaaacgatgactccaaccgggccctgatgggtgccaacatgcaacggcaagctgtgccattgttgaacccacatgcgccattaattggtactgggattgaatacaaagcggcccatgactcaggggttgctttgatcagtcaacatgatgggactgttgaatacgttgatgcacgtgaaattcgtgttcggcgtgaagatggtgccttagacacttacaagctcatgaagttccgccggtcaaacggtgggaagaactacaaccaacgcccaatcgttaaggtcggcgaccatgtcgataacgatgaagtcttggctgatggtccttccatggaaaatggggaattggctttgggtcaaaacccattagttgccttcatgacttggcaagggtacaacttcgaagatgccattgggatcaacgagcggttggttcgcgatgacgtttacacgtcgattcatattgaagaatacgaatcagaagcgcgtgatacgaagcttggacctgaagaaatgacgcgtgaaattcctaacgttggggaagatgccttgaagaacttggacgaagacgggattatccgtgttggtgccgaagttcaagatggggatatcttagttggtaaggtaacgcctaagggtgttactgaattatccgctgaggaacgactccttcatgccatctttggtgaaaaggcccgtgaagttcgggatacttctctgaaggtaccgcatggtggtggcgggatcatccaagatgtgaagatctttacccgtgaaaatggggacgaattgtcaccaggtgtcaacatgatggttcgggtctacatcgcgcaaaagcggaagatccaagttggggacaagatgtctggacgtcacggtaacaaggggacggtttcagtggttatccctgaagaagatatgccgtacatgccagatggtaccccaatcgacattatgttgagtcccatgggtgtgccttcccggatgaacatcgggcaagtgctcgaattgcatttggggatggctgctcgcaagctcggtgtgcacatggcaaccccagtctttgatggtgcccaagatacagatattgcggacgctgttaaggaagccgggatggctgctgacgccaagactgtcttatatgatggtcgaactggtgaaccgtttgataagcgggttgccgttggggtcatgcactacctgaagttggcccacatggttgatgacaagatgcacgcccgttctatcggaccttactcactggttacgcaacaaccccttggtgggaaagcgcaatttggtggtcagcgtttcggtgaaatggaagtttgggctttggaagcttatggtgccgcttatacgttgcaagaaatcttgacgtacaagtctgatgacgtggttggtcgggttaagacctacgaagccattgttaagggcgatccaattccaaagccaggtgttcctgaatccttccgcgtgttagtgaaggaactccaatccttagggctggacatgaaggtcttaaatggcgacaaagaagaaatcgaactccgtgatatggacgacgaagacgacgatgttgttaatgtggatgcgttgagcaagtacgcgcaacaacaggaagaacaacggaaagccgctgctcagactgatgaatccaagaccgcgccagcaacaaaaaatgaaagtcaaccgaatacacaagactaatttataagggaggtcgcttctttggtcgatgtcaataagttcgaaagcatgcagatcgggctggcttcacctgataagatccgtagctggtcttacggggaagttaaaaagcctgaaaccatcaactaccggacattaaagcctgaaaaagatgggctgttcgacgaacgtatctttggtcctaccaaggactgggaatgtgcctgtggaaagtacaagcgaatccgttacaagggtgtcgtttgtgaccgttgtggggtcgaagttacccgttctaaagttcgccgtgaacgaatgggtcatatcgaactcgcagccccagtgacccacatctggtactttaagggaattccaagtcgaatgggcttggttctcgacatgagccctcgagcactggaagaaattatttactttgcatcttacgtagtcttagatccaggtaacacgccactcgaaaagaagcaattgctttccgaacgtgattaccgtgacaagctgctggaatacggcagtgatgcctttaaggctgaaatgggtgcggaagccatcaagaagttattgatgagcgtagacctagataaagaagtcacagagttaaaagaagaattgaaggaagccactggtcaaaaacggacgcgagccgttcgtcgtttggacattttggaagcctttgtgatgtcgggtaaccgtcctgaatggatggttatggatgccattccggttattccacctgacttacggccaatggtacaacttgaaggtggacggttcgcaacgtctgacctgaacgacttgtaccggcgggttatcaaccggaacagtcggttgaagcggttgttggatttgaatgcacctggtattatcgttcaaaacgaaaagcggatgttacaagaagccgttgatgcgttgatcgataacggtcgtcgtggccgaccagttgctggcccaggtaaccggccactgaagtctctttcacacatgttgaaagggaagcaaggtcgtttccggcaaaacttgttagggaagcgggttgactactctggtcgttccgttattgacgttggtccttccctgaagtttaaccaaatgggtctgccagttccgatggctttggaattattccggccattcattatgaaggaattggttgctcgtggcttggcttctaacattaagaatgctaagcgacaaattgaccgtgaagatgatgatgtctttaacgtattggaagatgtcatcaaggaacacccagttctgttgaaccgggcccctacgcttcaccgtttagggattcaagcgtttgaaccggtcttggttagtggtaaagcaatgcggttgcatccattggcttgtgaagcttacaatgccgatttcgatggggaccaaatggctatccatgtgccattatctgatgaagcacaagcagaagctcgtttgctgatgcttgctgcgcaccatatcttggcccctgctagtggtaagccagttgttgcgccttctcaagatatggttattgggaactactacctgacaatggaagaagctaaccgtgaaggtgaaggcatgatctttacggatcttgacgaagcaatgttagcttaccgtaacgggattgtgcattggcatactcgggtcggtgtccaagtgacctcgatgccagataagccatttaccgatgaacaacgtagtaagattatggtgacgaccgttgggaagttaatcttcaacaacatcctgccaaagtctttcccatacttgaacgaaccaacgagcacgaacttgaatggttacgtccctgacaagtacttcttggaaccgggcgaggatattcatgattatctgcaaaatgcagaaatcattccaccatttaagaagggcttcttgagtgacatcattgcggccgtttaccaacaatacaaggtgacggcaacgtccgaactgttggaccggattaaggacttgggttacaacgagtcaacgaagtctgggttaacggttgggatggtcgatgtgaccgacttgaaagaaaagccagaaatcattgcggctgctcataaacaagtcagcacagtgacaaagcaattccggcgtgggttgattacggatcatgaacgttacgaacgggttattggtatctggaacgatgctaaggacgaaattcaaaacgccttgattcacagtttcgaccaacagaacccaatctttatgatgagtgattctggtgcccgggggaacatttctaactttacccaattggctgggatgcgtggcctgatggctgctcctagtggggatatcatggaattgccaatcacgtctaacttccgtgaagggctgactgtgatggaaatgttcatttcaacccatggggctcgtaaagggatgaccgatacagccttgaagactgccaactcaggttacctgacgcggcggttggttgatgtggcgcaagatgttattattcgggaaaaggattgtggaactgatcgtggtttgaagattcgggccatcactgatggtaacgaaatgatcgaaccattgtatgaccggattctagggcgttatactcaaaagacggtttacgatccacaaactggcgatgtcatcgtaccgaagaaccaaatgatcgttgaagatacggcacaacagattgttgatgctggtgttgaagaagtgacgattcgttcagccttcacttgtaacacggaacatggtgtttgtgaacactgttacggtcggaacatggcgactggtgatgaagtcgaagttggtgaagcagtcggaacggttgctgcccaatctatcggtgaaccagggactcaattgaccatgcggaacttccataccggtggtgttgccgggaacgaagatattacccaagggcttccccgggttcaagaattatttgaatctcggaaccctaaaggtaaagctgagattactgaagttactgggacggttgaatcaatcgaagaaaacccagctgaacggactaaggaaatcaccattaagggtgaagctgatacgcggagctacacgttgccaattacggcacggatgcgggtcagtgaaggagacttcattcaccgtggtggcgctttgaactatgggtctgttgatcctaaggaattgttgcgggttcgtgatgtcttgtcaactgagacgtacatcttgggtgaagtgcaacgggtttaccggatgcaaggtgtggccatcagtgataagcacgtggaaatcatggttcgtcagatgttacgtaaagttcggatcatggatccgggcgataccgatgtcttacctgggactttgatggatatccaagacttccgtcgggctaactatcagacgttgatcgatggtggcattgcggctaccgcccgtccagttatcttggggattacaaaggcggctttggaaactaacagtttcttatcagctgcttctttccaagaaacgactcgggtcttgaccgatgctgctattcggggcaagaacgatccattagttggtttgaaggaaaatgtcatcattgggaagattattcctgccgggactgggatgccagattaccgtcagatcaagcccaaagaagttggcggcacgtcaaccgaaggtgtttattccatcagcgacttagaaaagcaaatgcaagaagactcacaagcttagtgacaactaagcctaagaaaaaggactctcgtcagtggcgagggtccttttttacatagcattgttatgacgccatcagccaccagaacaatgcactgattaacaagtagggaatgaatgccagttgagttgttcgccggttgataattaaagctaaactagcggctaataataaccagtgggccatggcagttagtccccacatgagaccataactaagaaaaaactcgagatcgccattaccaatcgttggtacagaccaacgagaccataaccaattcatcaagccattaatgaagaccacaatcaaccaaacgactggggagtgtccccagagtgcgagactcaggccgatccaacttaaccaagccggaaatgtttgcgtgtgccagtcgtgaagggcggctaatccccagcaggctagccaactgatcggtagccacgtggccgtattcagtgtggtgaggagggtgccgcctaatacctcagccacgaacgttaccggaatgattggtgtttgacaagtggtgcagcgcccgcgtaatattaaataactccaaattgggatcaattgccaaggcttcagtggtgtttgacacgtttcgcagtgggagttgggatataaaagggactcttgccgcattcgccggtaggcccaagcggtaccaaaagagcctagacaactgccatagcagaacaagataatttgcatgggtgatcacctcaggggtaattccgtgaaaaacgttagaaagtttgcgagaaattggcggtgggatgattgacacagcatttctggcatggtattctattcaaggtgcttttcgcagacaggtctcgggtacacactaccggacatgctgactgacggcgggagggacacttcaattaacctgcccgtctaggtggctttttcttttatttgaaaatgaaccacctggatgtgtggacttaaaactctagaaagtataaggaaaggaggactatttagatgcctactatcaaccaattggtgcgtaaaggtcgtaaatctaaaagttctaaatcagatgccccagctttaaactacgggtataacagtttcaaaaaagctcaagttaagaatccagctcctcaaaagcgtggggttgctactcgtgtcggtaccatgacaccaaagaagcctaactcagctttacggaaatatgcacgtgtgcggttgtcaaacttaattgaagtgactgcttacattcctggtattggtcacaacttacaagaacatagtgttgtgcttatccggggcggccgggttaaggatttacctggggttcgttaccacatcatccgtggtgcgctcgatactgccggggttactgaccgtcgtcaaggtcgttccaagtatgggactaagaagcctaagggctagaccaagattattttcagctagttgcacggttgccgtcagctagctggtaacagcatttcaaggaggatatgaacaatgcctagaaaaggaaacgtacaaaagcgtgaagtccttcctgatccaatttacaattcaaagttggtcactcgtctgatcaaccacatgatgatggatgggaaacgtggaacttcaactaaaatcatttatggtgccttcgacatcattaagaatgaaactggtaacgatccagttgaaactttcgaagaagcaatgaagaacatcatgccagtcttggaagtcaaggctcgccgggttggtggatcaaactaccaagtcccaatcgaagttcgtccagatcgtcggacgactttaggtcttcgttggttagttcaatactcccgtttacgtggtgaacacacgatggttgaacgtcttgcacgtgaaatcatggatgccgctaacaacacgggtgctgctgttaagaagcgtgaagatacgcaccggatggctgatgctaaccgtgccttcgcacactaccgctggtaggagcaaccatcgccctgcgttactagcagtgtgataaaatgttagagcgatctgtgcaaacagctcgtctctagcttaagggagataatcctttaatcgagaggtggctactaaatcagtgtgatgatagtagccaccttttgccacaatctacgatcaaattgagaggagttacacattaatcatggctaatactcgtgaatttccgcttgagaagacgcgtaacatcggtatcatggcccacatcgatgccgggaagacgacgacgactgagcgtatcctgtattatactggtaaaatccacaagattggtgaaacccatgatggggcttcacaaatggactggatggaacaagaacaagaacgggggatcacgatcacttccgctgccactacggctgaatggaagggtcaccggatcaacatcatcgataccccaggacacgtggacttcactgttgaagttgaacgttccttacgggtgcttgatggtgccgtagccgtcttggatggtcaagcaggggttgaacctcaaactgaaacggtttggcgtcaagcttctgattttgatgttcctcgtatcgtgttcgttaacaagatggataagctgggtgccgacttcgacttctcagttaactctatccacgaacgtctgcaagctaacgccttggctttacaaatggctattggtgctgaagacgaattcgaaggggttgtcgacttagttgaaatgaaagcctacgtttatgataaagatgacttaggttcttcatgggatacggttgaaattcctgctgatatgaaggaagaagccgaaaagcggcatgaagccatgatcgaaagcgttgctgacgttgacgatgaaatcatggaaaagtaccttgaaggtgaagaaatcaccaaggacgaattgaaggctgctatccggcgggcaactttgaagctggacttgttcccagtcttcgctggttctgccttcaaggataaaggtgttcagatgttgatggatgccgttgtggactacttaccatccccattggatgttaagccatacaacgccactgatcctgatactgatgaagctatccaattacgtgctgatgatgatgcgccattcgctgccttggcatttaaggtggcaactgacccattcgttggtcgtttgacttacatccgggtttactccggtacgctggaagccggttcttacgtcttgaactcgacgaaggacaagcgtgaacgggttggtcgtttgctgcaaatgcattctaatcaccgtcaagaaattccagaagtcttctccggtgatatcgctggggccattggtttgaagaacaccacaactggtgattcattaaccgacccagatcacccattgcatttggaatctatggacttcccagatccagttatccaagttgctgtagaaccaaagacgaaggctgaccaagataagatgaacacggctttacaaaaactctctgaagaagatcctactttcaaggctgaaactaaccctgaaactggtgaaacgctgatttccgggatgggtgagttgcatttggacatcatcattgatcggatgaagcgtgaattcaaggttgaagccaacattggtgccccacaagttgcctaccgtgaagccttcacgaagtcaacgagcgttcaaggtaagtttgttcgccagtctggtggtaaaggtcaatatggtgatgtttggattgaattcacccctaacgaacgtggtaagggttacgaattcgaagacgccatcgttggtggggttgttcctcgtgaatttatcccttcagttgaccaaggtttgcaagaagccatggcaaatggtgtcttagctggctacccattagttgacgttaaggctaagctgtatgatggtagttaccatgatgtcgattctagtgaagcagccttcaaggttgccgcttcattggctttacggaatgccgttaagtctgccggccctgttatcttggaaccaatcatgaaagttgatatcttggttcctgaagaatacatgggcgatatcatgggccaagttaccgcacgtcgtggtaaggtcgatggtatggaagcacgtggtaacgcacaaatgatccactcttacgtaccactttcagaaatgtttggttacgcaacgacgttacgttctgcatcacaaggtcgtgggacatttaccatgacgtttgatcactacgaaccaacgcctaagagtgttcaagctgatattatcaagaagaatggcggtactccagtcgaagactagggtcttgtgcattcgtaaaagcgtcctaccaatttggtggggcgttttttgtcggcatcaaaaaggaaaaagtaatgtaaaaatgatgagttaacagagcgtggcgtaatgtcgtataataaatatggtgtgcatgatttagattggagagtgagttatggaagacttatttgaacgtgcgccgattccaagagcctactttaagttggcattgccggtcgtgctgagcatggttgccagcatgatctataatcttgctgatacgttttttgtttcgcaaacccagaatacgaatctagtggcaggggttgcgctatgtacgccgttgttctcattattgatcgctattggcgatatctttggcttgggcggcagctcgctgatatcccggttgctaggtgaaaaggcctttcagactggaagtcgagttagtagtttttgcctttatggagcggtggtctttggtctattgaccactattttattattggcttttgaacggccaattcttcatttattaggcgcaacgacggcgacttatgcctatgccgctcagttttatcggattatggcgttgggagctatgccgattattgtgtcaatcgttccgggtaatctgattcgcacggaagggtttgccacacaatcgatgattggaacgatggttgggactgtaataacaattatcttagatccaattctcatcttctcacttggcatggaagccgccggggcagccttagccacagtaatcggctatatgatttcggccagtgtcttggtctacttaacttggcgctattgtcaggttgtttcagtagatgtgcggttaagtcgcattgatgggcacttacttcgtcaggttctattcatcggtattccaggatcgatcaccaacctcatgcaagcttttggcacagctgttttaaatcgatatcttgtggattacggcccaacccgggtcgctgctatggggattgttttgaaggtctatatgattattatgctagtgatggtgggctttgcatttggagcgcaacccttgattggatacacatttggtgcgaagaatagggcgcgttttaaacaaattctgcactttgacttgctggtcgaggtcgtctatgccttagtatttgctgtcattctgatgatctttgcgccgcaactaatggcattattcctccataatccagcagtcattcagacggggacctacatgttacgcgcttttctcgtaacaacgccctttgttggagccgtcctcgtatacacaacggtctttcagagtacggggaaggctagtggggcttttatcatgtctatcgctcggcaaggtgttgttttttacgtaatggtggttctaggagcccagttatttggttaccatggcgttatctgggcccaaccagtggcggatgttctaacttgtgggttagggtggttactgacaaagctactattaaataggaaatcatccgttaattaatcttatttgccagaattcaaattgatttaggtcaaatctcgtccactacttccaaaaaaattcaaggaattccgtgaaatcccttgtcaggcgccactttatttagtatgatagtcaagtgctgtatttccctgtgtttttttgtgcccaggggggtcgcgccgaaagtttaagcgatgatgtggaaggttgcgacacacccggctgctttgccacgagggtatggcggtaaatttccacggagttagtcttatttttaaaatagacgaaggagggaacacaatggcaaaacaaaaaattcggatccggttgaaggcatacgaacatcgtatcctcgatcaatcagcggacaagatcgttgaaacggcaaagagaactggtgccggcatctcaggcccaatcccattaccaactgaacggacgatctacacggttctgcgttcaccacataagttcaaggactcacgtgaacaatttgaaatgcggacgcacaagcgtttaattgatatcgttaacccaacgccaaagacagtcgactcattaatgaagcttgacttgcctagtggtgttgacatcgaaatcaagttataatttctagcaacaaaataatacattaaaatcggaggtgtactcatgaccacaaaaggaatcttagggaaaaaggtcgggatgacgcaagtcttcactgatgctggtgaattaatccccgtgactgttgtcgaagcaacgccaaacgttgtgttgcaagttaagacaatggaaaacgacggttacaatgccatccaacttggttaccaagacaagcgtgaagtactcagcaacaagcccgaacaaggtcatgtagcaaaagcaaacacgactcctaagcgcttcattcgtgaattcacagatgttgagctgggagattacaaggtagcagacgaagttaaggttgataccttccaagcaggcgacatcgtggatgtcactggtgtcactaaaggtcatggataccaaggtaacattcataaagatggtcaaagccgtggccctatggcccatggttctcgttaccaccgtcgtccaggttctctgggtgccatcattaaccgggtattccctggtatgaagcttccaggccggatgggtaacaagcaagtgactatccaaaacctcgtgatcgttaaggctgacgttgaaaacaacgtgctgttgatcaagggtaacgtgccaggtgctaacaagtcactcgttactgttaagagtgctgttcgcccaccacgtcctaagcaatctgaaaaataaaacggaagggaggataattaaatgacaagcgtagcattatacaaacaagatggtagccaaaacggcaacgttgaattgaacgctgatatcttcggcgttgaacctaacgaaaatgtcgtattcgacacgattttgatgcaacgagcttccttacgccaaggaacacacgccgttaaaaaccggagtgctgttcgtggtggtggtaagaagccatggcgtcaaaagggtactggtcgtgcccgtcaaggttccatccgttcaccacaatgggttggtggtggtgtcgtctttggccctacccctcgctcatacagttaccgccttcctaagaaggttagccgtttagcacttaagtcagttctttctcaaaaggttctagacgaaagctttgtcgtcgttgacggtttagcattcgacgcacctaagaccaaagaatttgctgcagtgttggctggtttgaacgtcacaacgaagacgttggttgtccttgaagacgacaacgttactgctgctttagcagcccgtaacttaacaaacgttaaggttatccctgccaagggcttaaatgttcttgacatcgctgatgcggacaagttagtgattacccaaccagctctttctcaagtagaggaggtgctcgcataatggaatcacgtgacattattttacgcccagttgttaccgaagcaacgatggcaactatggacgacaagcgttacacctttgacgttgatgtacgagcaaccaagacacaagtcaagcatgccattgaagacatctttgatgttaaggtcgttaaggtcaatgttatgaatttgaaaggtaagaagaagcgtcaaggacgttacgaaggctacactaagaagcgtcgtaaggccattgtcagcttatctgccgactcaaaagaaatcaagttattcaacgaagaataaaatctcagatataggagggaaataacgtggcgattaagaaatacaaaccaacaagcaatggtcgtcgtaacatgacgagcttggtttacaaagacgtcatcactaagacgactcctgaaaagtcattgcttgattcacaaagccattccgctggccgtaacaacgctggtaagatgactgtccgtcaccgtggcggtggtaacaagcgtcaataccggatcatcgatttcaagcggatcaaggatgacgttcctgcaacggttaaggcaatcgaatatgatcctaaccggacagcaaacatcgcattgttagtttatgctgacggtgttaagtcttacatcattgctcctaagggcttaaaggttggcgacaaggttcaatctggtcccgaagctgatatcaagactggtaatgcattaccattgaagaacatcccatttgggacagttattcacaacatcgaattgaagcctggtaagggtggccaattggtccgttctgctggtacttcagctcaattgttaggtaaagctaacgatgaaaagtacgtgttagttcgtttatcttccggtgaagttcggatggttttgagcgttaaccgtgcgacaatcggtgccgttggtaacgaagaacatgaattggttaacgttggtaaagccggccgtactcgttgggctggtcaacgtcctcacgttcgtggttcagttatgaaccctaacgatcacccacatggtggtggtgaaggtaaagcacctgttgggttaccatctcctctttctccatggggtaagaagacagttggtaagaagacccgttcgaagaagaacaagactgagaagttcattgttcgtcatcgtaaaggttctaagatgtaagcttccggttatccggaagtcaagagaccaggtgatcatcgtgtttagcgatgcgccacaagtagaggaggtttcataatgggtcgtagtttgaaaaaaggacctttcgccgatgcgcacttgctgaagaagattgatgcgcaaaaggattccgaaaagaagaccgtcattaagacttggtcccgtcggtcgactattttccctagctttattggttacaccattgctgtttatgatggacggaagcacgtaccagtttacgttcaagaagacatggtaggccacaagcttggcgaattcgtaccaacccggactttccgtggtcatggtggcgacgataaaaaaactcgttgataaggaggattaactaatggctgaacaagttacatcagcacaagcgactgctaaaacagttcggattgctgctcgcaaagtccgccttgtcatcgatcttatccgcggcaagagcgtcgctgaagcactagctattttgcagttcacaccgcgtggtgcttcaccggttgtggcaaaggtattgaactctgcagttgcaaacgcagaaaataattttgacttagatcgtcaagatctagttgttagcgaagcctatgtgaacgaaggaccaaccctcaagcggttccgtcctcgtgccaaaggttctgcttcaccaatcaacaagcgtacgagtcacattacggttgttgtatctgaaaaagaggagggataacgcgtgggtcaaaaagtaaatccaaccggattacgggtcggtattattcgcgactgggaagctaagtggtatgctgaaaaggatttcgctgcttacctgaaggaagaccttcaaatccgtaaattcatcgaaaagcgtctggttgacgcttctgtatctactgttgagattgaacgggctgcaaaccgcgtcaacatctcaatccacactgctaagccagggatggttattggtaagggtggttccgaagtcgaaaatctccgtaaggaattaaacgacttaactggcaagcgtgtccacatcaacatcgtggaaatcaagaagccagatttagatgccaaattggtcggcgaaaacattgctcgtcaattggaaggccgtgttgctttccgtcgcgctatgcgtgggacgatgcaacggacaatgcgttctggtgccaagggtatcaagacgcaagtcgctggtcggttgaacggtgctgatatgtcccgtgtcgaaagctatgctgaaggtacggttccattgcatacgttacgtgctgacatcgattatgcatgggtagaagctcacacaacttacggttctctgggtgttaagacttggatctaccgtggcgaaattctgcctgaaaagaaacaatctaacggacaaggagggaaatagcatgctggtacctaagcgagtaaagttccgtcgtgtccaccgtggtaagctacgtggcgaagccaagggtggcaagagtgttgctttcggcgactacggtttgcaggctttagattcacattggatctctaaccgtcaaatcgaagctgctcgtgttgcaatcactcgttacatgaagcgtggtgggaaagtttggatcaagattttccctcacaaatcctacactgctaaaggtgttggggtccggatgggtaatggtaaaggtacgccagatggctgggtagccccagttaagcgtggtaaggttatgtttgaagttggcggcgtttctgaagaagtcgctcgcgaagccttacgccttgcagccatgaaacttcccgttcgcacgaaggttttatcccgagaggaagtaggtggcgaatctaatgaagactaaagaaatcaacgaattaaccactgctgaaatgctcgataaagaaaagagctacaaggacgaattatttaacctgcgtttccaattagctactggtcaattggaaaacaccgcacggttgaagcaggttcgtaagaacattgcgcggttgaagaccgctcttcgccaacaagaactgaacaagtagaatacgataaaaaggaggtcacgaatacatgagtgatgcacgtaataaccgtaaggtctaccgcggtcgcgttgtttcagataagatggacaagacgattacggttgtcgtagaaacgacaaaaactgatgctcgctatggcaagcgtgtcaagtactccaagaagtacaaggcacatgatgaaaatggtgaagcccacactggcgacattgttgaaattatggaaactcggccattgtctgcaaccaagcggttccgcttagtcgacattgttgaaaaagcagtaatcatttaggtgtcgtttttatcgtattctgaactagaactgaagggaggacactagctgtgatccaacaagaaagtcgcttaaaggttgccgataactccggcgcccgggaaatcctgacgatcaaggttctgggtggctccaagcgtcgctacgccggaattggtgatattatcgttgctactgtcaaacaagcaacgccaggtggcgttgttaaaaagggtgatgttgtaaaggccgttgtcgtacggacgaagtctcgtgtacgtcgtaacgacggttcatacatcagctttgatgagaatgctgcagtgctgattaaagacgacaagagcccacaggggactcggatctttggcccagttgctcgtgaactacgtgacaacgactacatgaagatcatctcattagcacccgaagtactgtaatcaagaaacgtttaacaaggaggtgcccacaggaatgcttattaaaactggtgacaaggtccgcgtgatcgccggcaaagacaaaggaaaagaaggaactgtttccaaagtcttgaatgccaagaaccgtgtgatcgtccaaggtgtcaatatgattaagaagcaccaaaaggcttcgcaaacgaatcctcaaggcggcattatcgatattgaagcaccaattcatgcatccaacgttatgctcatcgatccttcgaacaacgaaccaacccggcttggcgttcgagtagaagatggtcacaaagtgcgtttcgctaagaagtccggcgaaaccatcgacaaataatcgttgaaaggaggaacatcatttcatgtcagctcgtttaaaagaaaagtacgttagtgaaattacaccagctttggtggaaaagttcagctacagttctgttatgcaaacgccgaagatcgaaaagatcgtcttgaacatgggtgttggtgatgctgtttccaacgctaagaaccttgacgaagccgttgaagaacttgggttgatttctggtcaaaagccattggttactaaggccaagaagtcaattgcaaccttccgtcttcgtgaaggcatgtcaatcggtgctaaggttaccctccgcggtgaccggatgtacgaattcctggacaaattaatcaacgtatcattaccacgtgttcgtgacttccatggtgttagttctcgggcctttgatggtcgcggtaactacactctgggtgttcgtgaacaattgattttcccagaaattaactttgataacgttaaccgtgttcgtggtttggacattgttatcgttacaacggctaacactgatgaagagtcacgtgaattgttgactcaattcggtatgccgttcgcacactaataaaggaggttcacacaattggctaagaaatcacaaattgctaagaacaagcgtcctgcgaagttttctacacaagcatatactcgttgcgaacgttgtggacgtccacactctgtttatcaaaagttccacctttgccgtatctgcctacgcgaacttgcccacaagggtcaaattcctggtatgaagaaggctagctggtaaaacgaattttaaacaaagggagggtaaacgttaatgtccatgactgatcctattgcagacttcttgacgcggatccgtaacgccaacatggtgcgtcacgaatcactcgaagtacctgcatctaaaattaaacgcgacatcgctgaaatcctgaagcgcgaaggtttcatccgcaacgttgaatacatcgatgatgacaagcaaggtatcatccgcgtattcctcaagtacggtaaggataaccaacgtgttatcagtggtttgaagcgtatttcaaagcccggcttacgttcatacgttaaggccgatgctgtaccaaaggtattaaacggtttgggtatcgctattatctccacctctgaaggggtagttactgataaagaagcgcgcgccaagaaaatcggtggcgaagttctcgcctacgtttggtaaaacttttaagaagataggaggtgccttaagtgagtcgtattggttataaaactgtcaacgtcccagccggcgttgaagttaaacgtgatggtgatcaagttacggttaagggtcctaagggtgaattaacccggacgttctcatccgtcatctcaatgaagattagtgacggtgccgttgattttgatcgcccagataacaacaacaagacgcgggcccttcatgggacgcaacgggctaacttgaacaacatggttgaaggtgttgtcagtggctttgcgaagaccttgaagttggtcggtgttggttaccgtgttcaagccaagggtaagaccttgatcttgagtgttggttactccaaccctgttgaaatggcgattccagaaaccttagaggttaaggttcctgataacacgaccatcaacatttccggtattagcaagcaagaagtcggtgactttgctgctgaagttcgtgccgttcgttcaccagaaccttacaagggtaagggtatccgttacgaaaacgaatatgttcggattcgtgaaggtaaaactggtaagtaacatcgcagcttaatgctgataattttacaaagaggtgactattttgattacgaaaccagataagaacaagacacgtcaaaagcgtcatattcgtgttcgcaacaaaatttctgggactgctgaacgcccacgcttaaacgttttccgctctaacaaaaacatctacgctcaagtcattgatgacgtagcgggtgtcacgcttgttagtgcctcgacgttagatagcgaagtagctggcgataacaagactgaccaagccaaaggtgttggtcagttgattgctaagcgcgctattgaaaagaaaattaccaatgtagtgttcgatcgtggcggttacttataccacggccgtgttcaagcacttgcagaagctgctcgcgaagccgggcttaaattttaacagtaaggaggaataaccacacatggcaaaatttattgatcctgacaagttagaacttgaagacaatgttgttgctatcaaccggattactaaggttgttaaaggtggccgtcgtcttcggttcgctgcacttgttatcgtcggcgataagaacggtcacgttggctttggtactggtaaagcacaagaagttccagaagctattcgtaaggccgttgaagccgctcgtaagaacctgatcgaagtaccaatcgtgggaacgaccattcctcatgaagtactcggtacgtttggtgggggcaagatcatgctcaagccagctgctgaaggttctggggtaaccgctggtggtgccgttcgttccgtcatggaattagccggtgttgccgacgttacttcaaagcgtttgggttctaacacgccagtcaacgcagttcgggccacttttgatggcttgactcagttgaagcgtgctgaagaagttgccgctctccgtggtgtctctcttcaacacttagctgaataaggaggggtattaaaatggctcaattaaaagttactttaattcatagtgcggctcaccgcctccctaaacagcggaagatcgtggaagctttaggtttgaagcgagttaacagctctgttttacaaccagataacgaagcaacccgcggtgcgcttttccaaatcgcacatttgattaaggttgaagaagttaagtaagtctcatatcattaaataaggaggtgcgcaatagcatgaagttgaatgaactaaaacctgctgaaggctcacggaaggttcgtaaccgagttggccgtggtgattcttctggtaacggtaagactgctggtcgtggccaaaaaggtcaaaaggctcgtagcaagactcgtttgggctttgaaggtggccaaatgccattgtaccgtcggattccaaagcgtgggtttaccaacattaaccgtaaggaatttgctgtcgtaaacttgtccgcattgaacgtcttcgatgatggcgcagaagtaactccagctgccttggttgaagctggcatcgttaaaaacgaaaaagccggtattaagatcttgggtaacggtgagttatcaaagaagttgacggtcaaggccgctaagttctctaaatcagctgctgaagctatcgaagctgctggtggtaaaactgaggtgatttaatgctatcaagcttgaaaaacgcctttaagattaaagacattcgtaataagattctctttactctattggttttgattgtctttcggttgggtacttatattaccgtccccggcattaacgcaaaggcacttcaaagcgttgcgtcttctggattggttagtattttagataccttcagtggtggtgggttatcaaactactccatcttcgcgatgggggtttcaccttacatcactgcacaaatcgttattcaattgctacaaatggacatcgttccgcgcttcgttgagtggagtaagcaaggggacgttggtcgacggaaattgaatcaagcaacacggtacttagcaattgcgttagcatttgttcagtccatcgggatcacggctggtttcagtgctttaagttcactgaaattagttcaaaatccgagtgtcgagacatatctttccattgggttaatcttaaccggtggaacgatgttgaccacttggatgggtgatatgatcaccgatcggggcttgggtaacgggatttcaatgatcatctttgcggggatcattgcccggacaccaaaatctgtttatcaactctatcaaacttatttcgtcgatgtttcgtcaagcggttggtggaagagtggtctgtttattcttgggttaatcgtgttagttctaattattgtgaccttcgttacgtgggttcaacaagcggaacgccgggtgcctattcaatatacacgccgcgtgtctggttcgccagatagtagctacttaccgttgaaggttaatgttgcgggggttatccccgtcatcttcgcgagttcgtttattgccacgccacagactattctgatggcgttccaaaacacccactctcaagatgcatggtaccaaacgttgacggacgtctttaacatgcagacgctcgatggtgctattttgtacactgttctgatcgttgtgttcacgttcttctatgcgttcgtgcaagttaacccagaaaagttagcggagaacctgcaaaagcaggggagctatattcctggtgtttggcctggtcacgaaacgcaatcgtacgtttccagtttgttgatgcgtctcagcactgttggggctctcttcttaggattcgtatctttaattccgttattagcccagaacctttggaacttagatgagtcaattggtttaggtggtaccagcctcttaatcgtggttggggttgccattgaaacgatgcgacaagttgacggattgatgatgaagcgcgaatacgttggctttatccaagatccagaaccagcttaatgagtttccagcgggtgtgttgatctaattggcacacctgcttgtgtttttcgggaaaatttcgaagaaggagcatgaacatgacagcaatgaatttaatcctcatgggtttaccgggcgccggtaagggtacccaagccgaaaagattatcaatgagttccatttgccacatatttccacgggagatatcttccgtgaggcaatgaagaacgaaactgaaatgggcttggctgccaagaaatttatcgacaaaggtgaattggtgccggacgaagtgacgaacggtatcgttcgtgatcggttagctcaagatgataccaaagatgggttcatgttagatggattcccccggtcaattgttcaggctgaagcgttagatacgtttggacctgaacttgaccggaccatcaacgccgtgattaatattcacgtcgaaccagaagtcttggtagaacgcctttctggtcgttacatttgccgtaactgtggcgcaacttaccacaagttatacaagcgacctaaagttgcgggtacgtgtgatgtctgtggtagtcatgacttctatcaacgtgaagatgataagcctgaaacagttaagaatcggttagcagttaatctgaaaatgaatacgccgctggttgattactacacgaaaaagggtttattatttacggttgatggtgaccgtgacattgatgacgtctatgtcgacatcgaaaagatcctgaagaacctgtaggaagtcgcttagttcttgcgtctaagcatgaattatggtaagcttattcaggtttagcctgtaaatggcgcgctgtcgcgattcacaggtgctaggtggggtccaattgtggattctaccgcttttacgtgtggttaacacacaaataaaagggaggtactttcgtggcgaaaagcgatgtcatcgaagtcgaaggtaaagttaccgaaacattgcctaacgcgatgtttcgggtcgaattagaaaacggtcatgagattctcgctcacgtttccggtaagattcggatgcactacatccggattctgcctggtgaccgagtaactgttgaaatgtcaccgtatgacttgtctaagggccggatcacttatcgctttaagtagcggccgggacagatgtaggagggatattcatgaaagtaagaccatcagttaagccaatgtgcgaacactgcaaggttatcaagcgtaagggccgagtaatggttatttgctcagctaaccctaagcataaacaacgccagggtaagtaattcaatattataggaggtgcacctaaatgccacgtattgctggagtggatttaccacgtgataagcgaatcgcttacggtttgacttacatttttggaattggaattaacacggctcacaagattgttgctgatgccggtgttcctgaagacgttcgggttcgtgatttaacacccgatcaagaagacaaggttcgtgccgaagtcgacaagtacaaggtcgaaggtgacttacgtcgtgaagttagcctgaacatcaagaacttgcaagaaattggttcttaccgtggaatgcgtcaccgtcgcggtttacctgttcgcggtcaacacaccaagaataacgcccgcactcggaagggtaaagctgtttcgattgccgggaagaagaagtaaaggagggttaacactttatggctactagaaaaactagtcgcaaacgtcgggtgaaaaagaacattgaagccggggttgcacatatccatgctacgtttaacaacactttggtcatgattactgacgttcaagggaacgcgatcgcttggtcatcagccggtgccttaggtttcaagggtagtcggaagtcaacaccatttgctgctcaaatggctgctgaagccgctgctaaagcatcacaagaacacggaattaagtccgttgaagttgctgttaagggtcctggttcaggacgtgaatctgcaattcgggccatccaagctgctgggatcgaaatcacggctattcgtgacgttaccccagtgcctcataatgggactcgtcctccaaagcgccgtcgggtttaacgtgagcgtttcattaatgagggcaaccttcatgatgggattgacttataggagctcaacgcggtttgaaaggggtaaacgataagaatgattgaatttgaaaagcctaacattcataaaattgacgaaagtaacaactacggtaagtttattgtcgaaccgttggaacgtggttacgggacaacgctaggaaattccttacggcggatcttactttcttcattacctggtgcagctgttaccagcattcaaatcgacggggttctgcatgaattttcgactgtcgaaggtgtcgttgaagatgtcacgcaaatcatcttaaatgttaagaagattgcgttgaagcttaatggctctgatgatcaggaagaaacgatggagatcaacgttaagggtcctgctcaaatcaccgctggtgatattgttgccggagccgacgttgatatcttgaacccagatctgtacattgcaacagttgcggatggtgcaacgttccatatgcggatgacagctgataagggccggggctatgtttctgctgacgagaacaaaactcgcaacaccgacatgccaattggcgttttagctgtggattctatttacaccccaatcgaacgggttaactaccaagtagagaatgcacgggttggccaacgagctgactacgataaattgaccctggatgtttggacaaacggttcaattaatccaagcgaagccattgctctggctgctaagatcttgactgaacatctggcaatgtttgttgatttgacggacgaagctaagaatgcagaaatcatggttgaaaaagaagaaacgcataaggaaaagatgcttgagatgaccatcgaagagctcgacttatccgttcgttcttataactgtttgaagcgtgctggtatcaacacggttcaagaattgaacaataagaccgaagcagacatgatgaaggttcgtaacttgggtcgcaagtcccttgaagaagttaaggctaagttagctgacttaggtttgtcacttcggaaggaagactaattttagacactcaaaggagggtttctggttatgagttaccgtaaattacaacggactagttctcaacgtcgtgccttgttacgcgatttgaccactagtttaatcttgaacggccgcatcgaaacgactgaagcacgcgctaaggaagttcgcaagacggctgaccaaatgattaccttgggtaagcaaggcgacttgcacgcccggcgtcaagctgctgcgttcattcgtaacgtagttgctgatgttaaagaagacggcgatgatgtggttgttaccagcgcattgcaaaaggtcttcagcgaattagcacctaagtatgctgatcgtaagggtggttacacgcggattatgaagacaatgcctcgtcgtggcgatggtgctgctatggctatcttggaattcgttgactaatcagtcattggttacagggagtaatcgcgtccctaaacgcggtcaataagtttcaaattaatcactaggactatgtggtatagagcgttatgatgatgggaattccccgagtctagcttgaatgggggcgaaagcctcagcgccgctagtttgttagtgatttttttatacccttttttacctggtggggattgcgggggttcgcggttttataaaactttggtataattactggtgactttgctgagggagacggtgtaagatgacagaaaatatcattagtgtggatcacttaacctatcaatacgatgagaatcaggcacccgcattgactgatgtgagttttaccgttcacgctggcgagtggttggcaattgtcggccataatgggagtggtaagtcaacgctggctaaatcattagatggattattgccgtttacccaaggcagtgtgaccgttggcggaatcacgctaacgccggaaactgtctggcaggtgcgggagcaaattggcatgattttccagaatccagacaatcagttcgttggggccacggttgaggacgatgtggcttttggacttgagaatcgtcaaatttcgcgtgatgaaatggttccgcgagtacaagctgcattagcccaggtaggtatgaccagttttgcccagcgagaacccagttctttatccgggggccagaaacaacgggtagcattagctgggattgtggcaattgcgcccaaaattctaattttagacgaagcaacgagcatgttagatcctcagggtcgtattgaaatgctagcaattgtgcgccagctacgtcagcaacagaatctaacggttatttcgattactcacgatattgatgaggcggctagtgccgatcgggttttggtgattgatgatggtcggctagtagacgaggcggttccatcacaaatctttgagcgcggtacccaactcgttgagatgggattagatctaccctttactgaaaaattaaaagcggctttacgtcagcggggaattacaccaccgacaacgtatcaaaccgcggcggaaatggaggaatggctgtggcaatcgctttcgaacacgtaacttatacttatcaagcgggtacgccaatggcccatactgcgttgacggacgtttcattgacggttcccgatcgcggctatctcgcaattatcggtcatacgggtagtggtaaatcaaccctaattcagcaactgaatgccttgttaaagccgacgagtggcaccatcaaaattgatgaatttacgattaccccggagacaaccaatgcggccttgaaaccactgcgtcagcatgttggtatggtttttcaatttcccgaaaatcagttgtttgaagagactgtccgacaagacattgcctttggtcctaagaacttcggtatggccgatgccgatgcgctggcgttagctgatgagatgttaacgactgtcgggttggatcagagttatgcagagcggtcaccgtttgagttatccggtggtcagatgcggcgggtggccattgctggcgtcttagccatgcagccaaaagtgttggttttggatgaaccgaccgctgggttggacccccaaggtcgccaggaaatgatgcgattatttgcccgattgcatcaagaacaaggcttaaccattgtattagtgacgcatcaaatggaggatgttgcccagtatgccgagcaagttgcggtgatgcatgaaggtcgcctcatgaaatttggaaccccagctgatgtgtttagtaatcgtgagtggctccaagaccaccagttggatgtgccacaagcggcacaatttgctcgccgattacgtgatcggggattaacctttcctaaacagcccttaacggccgatcaattagccgactatctagcccagcagtgggctcaacggggggcagatcatgtctaattttatctttgggcggtatttaccgttggattcagtggttcatcgattagatccccgagcgaaattaatgctgagcttttgctatattattgttgttttcttggctaacaatatctggagttatgcgattctcattgcttttacagtaggcgctattctagcgtctaaaatcagccttggattcttcttgaagggaattcgcccattgctttggttaatcgtctttacggtcgtgttacagctcttattcagtccagctgggggacacacgtatttccactgggcctttattaatatcacgcaagatggattgattaacgctggctatatttttgttcgctttctcttaattatcatgatgtcgacgttattaacactatcgactcagccactagacattgccaccgggctggcatcattgatgaaaccattacggtgggtgaaagtgcccgttgataccttggcgatgatgctatcgattgccttgcgatttgtacccacgctaatggacgaggccactaagattatgaatgcccagcgtgctcgaggcgttgattttggggaagggggcttgttcaagcaagccaagtccttaattccgctaatggtgcctttatttatgagtgcgtttaatcgtgctgaggatttgtcgacagcgatggaagcgcgggggtatcaagatagtgaacaccggagtcagtaccgaatcttaacttggcaacggcgtgataccgtcacttggctattatttttacttggatttgtgtcgattttaatttttcgtcattggtaggaggaacagatgcaacgttataaagtcactttaatgtatgacgggaccaatttcgctgggttccagcggcaacccaataagcgtactgtggagagtacactgaccggtgtggtcaataaaatggccaaacaacctgatccggcaattgtgatttatggttctggacgaactgacgcaggcgtccatgctttggcgcaggtggttcatttcgactttccctttctcatccctgcggataacatgcgcaagggcttaaacagcatgttaccgatggatatggaggtcttaaaggttgagaaggtcgccttgaccttccatgcacgttatgatgtctctggtaaacggtatcagtaccgcatggacatgggcgaattccggaatccctttaagcgaaactatacgggtcattggaagtttccagtcgatctggcaaagatcaatgttgccttggctgatctggtaggtgaacatgactatacgagttttgttgcctcgggtgcccaaacgcggacattcgtgcggactatctatgaagccacttgccacattgatgaggccaatcatgagttagtttttgaattctacgggaatggctttatgtacaaccaggtccggattatggtgggcgtgttagtcgaaattgggtcgggcacccgaccggttcatgatgttttacgcttgtatgaggtcaaggatcgtaagcaggcgcggcggacggtgccggcggccggactgtacttgaaacacgtctattatcagggggaagatccgcaacatccgacaaaattaccgcaacatcagcgataatttaagttcaagggacaaacaatcattgactttatgggaaaaactttgtatcatagtcgttggtattgtttgccccacgataagccccggaaagtttacttggtgtcagacaaacacagatttatggaggaatttaacgtgcgtacaacttatatggcaaaacctaacgacgttgaccgcaaatggtacatcgtcgacgcaaccgatgttagtttaggtcggcttgcttcagtcgttgcttcaatcttacgtggtaagaacaagccaacgttcacccctaacgtggacactggcgataacgttatcgtgatcaacgctgaaaaagttgctttaactggccgtaaggcgtctaacaagatttattaccaccatactggcttcgccggtggtttgaagtcacggactgctggtaacttccgggatgaaaacccagaaaaattgatcgaaacttctgtccaaggcatgcttcctaagaactccttaggtcaccaaatggcattgaagcttcacgtgtatgctggtgcagaccacaagcacgaagctcaaaagccagaagtattagacatcactaacctaatctaaggaggaaaccaaattggcacaagttcaatatcgcggcactggccgtcgtaaaaactcctctgctcgtgtacgtttagtacccggctcaggtaaaattgttatgaacaacaaggcaatcgaagactacattccatttgcaagtattcgtgaagttgtcttacaaccattcaacgttacggaaacgcttggtaactacgatgcattagttactgtgcgtggtggcggtttctccggtcaagccggcgcaactcgtcatgggattgctcgggcattgctcgaagttgacccagatttccgtggcccattgaagcgcgctggtctgttgacccgtgacgctcgtatgaaagaacggaagaagccaggtcttaagaaggcccgtaaagcttcacaattctccaagcgttaatatttcgatattacgattggcaaaatcctcaccagcgatggtggggatttttttgtgaattgatttaaatatccggtccaggtaacgtcgcaatacaacttaggtgatcaccgtgtatctgccagtcagtgacggttgacggtaaaatgagatgatctcctgctcgtaatgggtaaggctgttcggcaatggtgagggttcccgtaccgtttagaacggaaactaacgtaaagtcagttgcggcttggtgaaaagtatgggttccgttcaagtcccatttaacaacagtaaaagcgggagcttgaacgaaattcgtctgcataaaatgatggtcgcttgttgtggtcactgtcagtatgggatcgcggtggggaacttgaatcgtgtcaatagcctgtttcaggtggagccgacgtttatgatgagtgtgtgtgtccactcgatcgaaatcgtaaagccgatacgttgtgtctgaactttgctgcgtttccaagaccatggtgccagcgcctaacgcatggacggttccggctggaacataaaagaaatctccggttttaattggtatccggcgaaatagggcctgccagttccccgtgtgaatccacgctgccaattgtgatcgcgtctgagcatggtggccgtaatagagttgggcgtctggctcagcgtgaatgacgtaccaacactcagtttttcctagttcgtgttcatgcactcgcgcataggagtcatcggggtgaacctgaaccgagagatcctgttgggcatctaggattttggtcaacaacggaaaaggctgttgcgtatcgcggtggccgaacagttcggggtgagcgtgccaaacggctgcgagtctttgcccctgatagcggccgttcttaatcgtcgataatccgtggggatgaccactaattccccagcactcaccggtgtggtcggagaaaatgggatagttaaaccgggatctcagctgagaaccgccccagattttttcgtggaaaacgggttgaagtaataagggtgctggcataaaagcatctcctctaacttttttggttaatcgcttctgacaacttgagtgtagaaaattaacactaatattgcaagcgctttctaccggggctaaaatctgattttcagttggataagtgttgtgttccgttcatctttggcttaagctgaattgagatgaatagaagaggaacggagactcatggaaaaaattaagcagtcacaattattcgatacgctttctaaaaaaatggtctggggctttgtcttcttgattacgattggtacagtgcttttgagcctaccagtcgcgaccaatggcatgcgggggacttcctttattgatacagtctttacggcgacctcagcgacctgtattaccgggttaacggtcgttaatacggcggaacactggtcaatttttggtcaggtaatcattttaggattggctgaaattggtgccttagggtacatgacctttgcggtattgttatttaatctcatgcggcgcaacctggacctgtcaacgcaattgatggttaaagagtcgctaaacttagaaaatttaagtgatactaaaagcgtaatgacctatgtcgtcggcttgtcggcattatttcagattggtgggagtctactactagcagttgactttgtgccccgctatggctgggtgcgggggctgtacatctcggtctaccatgcggtcatgtccttttgtaacgccggctttgatgtctttggggacagtctaatgcgctttcgaaatgattcctatctgctactagttaccattattttgattattggtggcggattagggttcttggtctggcgcgatctgctgttatttcacgaacgcaaacggctaacgctcaattctaagctgacattgacaaccaccggcgctttgtttgttattggctttttgttgttactggttacggagcgcaatctatcgatcctacctgcgcatacttcatggtttaaccgaacgatcaatacgctatttttgagtgtgaccccccggacggctgggttgattaccgtgccaacgaatagtctgcaatcagggagtatttttctgattatgatcttaatgtttgttggtgggacgcctgggtctactgctggtgggattaagaccacgacgttcggtgtgttgatgctccaaagcattgcccaattgcgcgggaaaaaagacgttgaatttagtcgacggcgctttagtgctagtaatattaaccgcgcattactgttgatctttttggccagcatcgtcatggttgtggccacgttgattctgacgcaaactgagaaaattcctaagggctttggtctggagtacatcctgtttgaagtgttatctgcctttggaacggtgggcttaagtctgggattgacgccgcatctaaccgtgattggtaagttggtcattatgttattgatgttcatcggtcgggtgggcattttcacatcgctatattcactgtctaagcggcaaaccacagttaacaagattcgttatcctgaagaaaatgtcttgattggttaggaggtatcattcatgaagaaaagttttgcagtcttaggtctcgggcgatttggacagagcgtcgttcagacactggcagaagaacaccaagatgtgctagccgtggacgtaaaagaagaacccgtcaatgaaatgatggatattgccacccaaacattaatcgcagatacgcgggatgaagatgtcttacgcgggctaaatatcgatacctttgattacgtgattgtgggaattggtaacaatatggaggccagcattctgactaccatgttagccaaagagttgggggctaagaaggtgattgctaaggcagaaaccagtgaccatggccgggtgctccaacgcgtgggggccgatcaggtgacttatccagaacgggatatggggcatgggattgttcgcaagctactgtccaatcatattttgaattttattgacctcagtgataagtacacgttggctgaagttgtgattacggacccgcactttgtcgatcaggatctggttgccttgaacctgcggcagcggttcgacttgacggtaattgcgattcagcatgaagggaagatcaacatctccccacaacccaccgatgttgttcagttgcatgacgtattaacggtggtcggaccgattgaaaatgtagaagcattggatgaatcactgaagaaataaatggcttagccagtgattcaaggttgttgcaaattaaaaaatggtgtacagtagttgttgaaaactgaatatgatttcttcggggcagggtgaaattcccgaccgacggtgacaacttaaagttgaagtccgtgacccacgtttaacgtggttgacccagtgtgagtctgggaccgacagtatagtctggatgggagaagaaacgaacgctaatgtcgtacttctgtgcgcacttttttaagtgtgaactcgtatgagatcttatttagcttactattaaatggggccccgcatgtttaactgcggggcccttttttcgtgaggtgaatgagaattgttggaacaatcgtttatgcaacaagccgtcatagcggcccgccggggttctgggcatacttggaccaatccattggtgggggccgtgttcgttaagcatgggaaaatcttatcggtgggctatcatcatcggtatggtcagcggcacgcagagattgatgcgttggcccagctccagcgaccgcaacaggcgcaaggcgcgaccttatatgtcaccttggagccatgtagccattttggtaaaacaccgccgtgtgctgatcgcttgattgaagtgggagttggtcgggtagtgattggacaacgcgatcctaatccattagttgctggccgcggcatttctaagctacgtgcagcggggattcctgtgagtgttttggattcaaccacggcgctgaacccggcttacaatttttattatcagcatcatcgaccccaagtgactgtaaagtatgctatgtcactagacggtaaggttaatcaggcggaagcccaacgaacctatttgacaggagcagctgcgatggctgatagtcaacagctacgacgacagcaacaagctattttgattggtgagcggacgctaactatcgatcatccgcgattaaccattcgcgatgcgataacagatgaaccagtgccaattcggatggtggtgcttcatgacattgaacatatcgataccagtcaacccttgtttaaggcgccggggcccatttggttgttgaccacccacccagcaacgcgtcaattaccagagcaggttcgcgtttttacccgaacaacgtggtcaccagcagcgattacagcattgtgttatcagcaaggaattcaagcacttttagttgaaggcggcagtcatttacaggcagctttcgtgcgagatgacttggcggatcaattagtcatttatctcagtccgttgttaattggtggtgcgggactaccggctgtgtacgcccctgattggcccagtcccaaacgggcttacacaccgccggtaacgacgcttttaggaaatgatgtcaagctgacaactaggaggcaacgtaaatgttcacaggaataattacagatcaaggttacattcgacaaataaataaaacagccacgggagcacagctcgttattcaaacgacacgggctcatcagacacgacacgtcggggacagcatcgccgtgaacgggatctgtctcactttaaccgcagtgactgacgaagcatttatcgttgttgcaatggctgaaaccttgcagcgtacgacactgggaacttggcagactggtatgcaggtcaatctggaagctgctttacgagcagatcaaggattggatggacatatcgttcaggggcacgttgacaccacagcgaccttacgagcaagtcataccgaaggggtcgcagtccggttgacctttgatgtatcagctgatcaagctccttacttggttgaaaagggtgctgtggccttggatggtgttagtttaacggttacggcagttactcgtcagacggttcaggtagcgctgattccctatacgttggcacatacgagtcttggtcatctacagtgcggtgatcaggtgaatgtagagacagatattttggggaagtacgtggttcgtcagtaccagttaggggggatgactgatgactagtcgagttgaggatgccttgacagcgttaaagcgtggtcagttagttatcgtagcagatgctgaagatcgagaagctgagggagacttagtgggattggcagaattggttacaccggagacagtcaatcaaatggtgacacatgctcggggattattgtgtgcgcccatggcaccagaaattgcacaacggttgtcgttgctaccaatgctgccgcacagtagcgatgcttttcagacggcatttacgagtagcctagatgcgcggagtaccagcacggggatttctgccattgaccgcgccgcaacgattcatcagttagcggcgacaaccagcacatgggatgatttttatcaccccggacatctctttcctttgattgcacgagccaatggtgtcttagaacgtgagggacatacggaagcagccgttgatttggctcgtttatgtggggtgacgccagttacttatatttgcgagattctcaagaaaaatggtcagatggctcgccgtaaggatctaaaagcattggcggaaggactgaaaattccatttattacgatttcagagattaaggcttatcgcgtagcccagaccgtttcaccaatctcacgggtgaaactcccgacagcgtatggtgagttcagcctacaggattttgagaatggcgatgagcaaccagatctcttactgacctatggtgatgtgacggggcagaaatccttattattacgcgttcatagtgaatgcttgacgggggatgtgtttggttcgcaacgttgtgattgtggtgcccagctgcaagagtcaatgcggcgaattgcggctgccggtcgtggtgctattttgtatttacgtcaggaaggacgtggcattggcttaatcaataagttacgtgcttataccttacaagaccagggagccgatacggtagaagcgaatgaacaacttggcttacctgccgatgcgcgacgttacgaacgggccgcggctattttacacgctcagggactgacacgggttcgcctactgaccaataatcctgataaggtgaaacaattatcccaagcaggcatcacgattactcagcgtgagcctctagaagtgggggttacccggacaaatcgggattatctactaacaaagaaacataagttccatcatatcttaaatgaggtgacagataatgactgagattttaggcttaccgataacgcgacccgttaaggtgggaattgttgtcgcagattttaatgacttggtaaccaccagattactggccagtgcgcagcaggcgttgcgacaggcggggataccagaagaaaatattctagtcgtccaagtaccgggtgcgatggaattaccgcgggtgacgcggcggctgagtgaaacgggggttattgacggtgttattaccctaggtgcggtggttcaaggggaaacggatcactacacctatgtttgtcagcaaagcgctgctgggctggctcaggcttcgttgacaggacctattccggtgatgtttggtgtactgatgacggctaatatggatcaagcattgaatcgtgcgggtggaaaagggggaaataaaggtcgagaatgtgcacaggcactacttcaagtattaagcgtggagcaacagttatcggagctacgttgatctagtaaatcataggaacacattaaaaagccatctaatttctcactaagagaagctagatggctttctgtttaattgtcagactaatcccagattattaaaggattagttggtggtttttacagcaaatgaatattagcagcttcacactggtcgatcatggcttggggccataaggcggcttggacttcgcccacgtgcgccttccctaatagcagcatacatagccgcgactgaccaatgccgccaccgatggtaaaaggcacttcttcatgtaggaccatctggtggtaaggtaggctcagtcgatcttccgcgtcagcaatctttaattgacgctgcatggactcggcatccacgcgaatacccatactagagatttcaatggcctgcttcaatggttcataccagaagagaatatcgccgtttaattgccagtcgtcgtagtcaggagcccgaccatcatggcgcttaccactcttgagggctcccccaatttgcattaagaaaacacagcccaattccttggtgatggcgttttcgcgttcccgaggggtcagatcagggaagcgatcttcgagttcctgagtcgtgatgaaatgaatttcgtcaggtaagtgatgcacggcttcggggaacttgtaccaaacctcgtgttccatgtgcttgataactttaaagatttgccgaacggtttgtttcagggtatcgagcgtccgttcttccttggtgatcaccttttcccagtcccattgatcgacatacgccgaatggaagttatcgagatcttcgtctttacggatggcgttcatgttggtgtagaggccttcgtggaggttaaaaccatagcgttttaaagcgactcgcttccatttagccaaggagtggacgatttcaatctgtgaatcgcccatgtcttgcatggtaaaggacacgggttgttcaatcccgttcagattatcattgagacccgttgatttttcgacaaacataggtgcggatagacgggacaaattcagttgggcaccgaattcatcttggaaggtttctcgaatgtagcgaatggcacgttgcgtgtctttgactgataattttggatcgtatgaatctggaatgattaaatgcatcgtccttactccttttcaatttaaatttaagacaaaaagaaaagtctcccgtccctagatatctagggacgaaagacttttcgcggtaccacccaagttgtttatgcaacgataaaccaactcaatcagagtacaaacatactccccgatggtaacgtatcggtgacggctcgccctactatgacccgggtcatttcaggtagcaactaagaaagggttattccgtaagatccacactgattgggtttacactaagtcccaactcactggcaggttgaccaaacgtacttgtctttcctccgttttttatcttgtggtgctaatattagcacctttttgagatttgtaaaccctaagattaaaaaatcatggcgaattatcaaaaattgactgggagttttaagcgccctatatagtaaaaaaagatcaaagaattatttagtcttttaggggattggtggcatcatcttggggaaattgggagatgaattgggcaacgcaactattgctgaggccgggttttgtgggagaatctattgacttttagcagaaaccaaattaaactattgtaattaatctaatcaaaatctcatttaacgtgaaaggcggtggcgtcttgaaatggccacaacgactctttattaagaaacaagtccaaacggatttatatcgaaaaactggattggaaaagaccctaacagcatttagtctgaccacgatgggaattggcgcaattgttgggtcagggattttcatcacgcctggattaattgcggctaattatacaggtcctggggtgatgttatcctacctgattgccgtggtcgtttgtgcgatggcggcgttgtgttattcggagttttcttcaacgattccgttagcgggcagtgcatatacctatgtgtacgctgtttttggtgaatttgtggcgtggattttaggttgggccttaatatccgagtatctgtttgcagtttcctcggtggcggtgagctggtcgtcgtactttcagaatctcttagccgggtttggtctaaagctaccagccttcttccaagcggcggccggtacggctggcgtcaaaggtgggggaattgatgtggttgctttaatcatcacgatgctggtagcgtggctattgtccaagggaattcgggaatcggcgcggattaataacattatggtggttgtgaagattttagtcattttgttatttatcggaatcgccatcttttatgtgaaaccggcaaactataagccatttctgccgtttggaaccagtgggatctttaaaggagctgcggtagccttttatgcctatattggtttcgatgcggtgtcgacggcgagtgaagaggtcaagaatcccaaacgtaatatgccaattgggattattagttcactgctggttgcggcggtgctgtatattagtctttctgctgtgttggtcggggtggtacactacacaaaattaaacgtggctgatccggtggctttagccttaacgttggtgcaccagaactgggcttcgggaattatttcatttggggccattgtggggatgacaacggtgttaatcgtgatgtcgtatggcggaacgcggttattatttgctattagccgagatggtctcttaccggcagcgttgaaacgtttgaaccccaagacacacgttccggtggctaacacctggatttttggcgtggtcgccagtgtctttgcggcgttgattccgattgataagattgccgaattggtaaatatcggcacgttatcagcatttgcgatggtttcgttggggattgtcttcttgcggcatgatgaacgatttaaaaatttggatacagcttttaaggtgccatggtacccatatttaccgattgcctcatttctcgcctgtgtttacctgatgacgcaacttcaagcctttacttgggcggcttttggcgtgtgggtggtattgggcttaatcgtctacgttagctacggttaccggcatagtcaggtacgggctaaaacatcacggtagcgtttccatttcgtggtacactaagtttaattcttgcgagagggatgacgtgatgcgttatttagccagttcaagtttagatattcggcaaaatttagcgattgaaacgtatttgatggaacatgccgatttaacggagcccatcttatacttctatattaattcgccgtgtattattgtggggcgttaccaaaatgttttagcggagattaatcagcagtacgttcaggaccatcagattattttgacccggcggacatccggtggtggggcagtttatgatgacctaggcaatgtgagttttagtttcattactcgtgatgacggtgatgctgtggggaattttaaacgcttcacggacccggtgattaaggcccttcatcgtatgggggcaactggggcagccatgacgggacgtaatgatttaacgattgatggcaagaagttctcgggtaacgcgatgcatgctgaacagggacggatgttttctcatggtaccttgatgtatgacgtggatcagacgcagattgaacgggcgttgcgggtgccggcggataaattggcctctaagggaatcaagtcggtgcgtagccgagtgaccaacttgaagccgtactttgacgcggcctatcagaatctgacgattgaagactttcgggataccttggctaaagaaattctggaagtggacgatttatccgcggctaaacattatgagttgagttcaacggatcgggcaggaattcaggcgctagcggaccagtattttaataactgggactggatttatggtaaggatccggcgtattcattaacgcggcgccaacattttgctggcggaacggttgagtttgacttggatgttgtccaagggcagattcaagccatccaaatccatggcgatttctttggtcaattaccaattgccgcggtgacgacgcaattaacgggaatcccgtatacgccagcggcagttcagaaggtttttgaccagatagatgtgccagcgtattttggccggatttcggcaccggagcttgtacaactgctaacccaacagccgcaagcttagacgtggtggaatcaactgcgattaatgacgctgattggtgagtactcttggttttttcttaaggttggtcgggaattaggaagtgttaaggctgggcctctataatggttaagtcgatcacagaaacacagggaataagaatgagcgtctggtagtgtgacaggcgagctgaaagggtggctaaccaaaccatggaaatggaaaagcggcaacgaccgcgccgaaagaaacattatgtgcgcaattttttcttgctgttggtcctggtgctaattgccgggggcacagcgtatggcatgaaaaaatatcagagtattaaaaatgcagtggataccacgtatcaggcttcgggagccaagaagttgcgaaatgttaatgaagtactatcggccaagaaaccggtgtcgattctcttaatggggaccgatacaggggcgttgggccgaacatttgccggtcgaacggatagtatgatggtggtcacgattaatcccaaaactaataagaccacgattaccagtattccacgagataccgcagtaaatattccgggttacaccagctatggtgtctcgaagattaacgccgcgtacgcttatggtaaatccaagacggcgatcaccaccgtgcagaagatgctgaacatcccgatcgacttttacgccattatcaacatgggcgggatggaaaagattattgatgaggttggcggcgtgacgttgaagccaacgctgagtttcagctatgggggctacacgttcaaaaagggtgtaaagacccatatgaatgggaaaaaggcgttagcatactcacgaatgcgtgatgatgatccgttaggggattatggacgacagacacgacaacgtaaggtcattatggccttgttgaataagtcgaactcaatctcatcactgttaaatgaggactttattagttcactgtcgaagcagacccagacggatttgacctttaatgacctgacggcactggcaaccaactaccgtaaggccacgcaacatattaagacgacgcatttgcaaggaactagcgagacaatcgagagtcaaagtatggaggtcgcctcaaaatccgaactacaacgcgttaccaactatattcgtaaagctctgggattgagtcacaaagcaacaggcgcgatcgcccaaatggatagtacgagttcaacagcaactacggacacaaccggtggggctggtgatactggcggtccaggtggcggatactaaagctaaacgaaatgaaggttcacttgtcatgcaacatgtgataagtgagccttttttgcatgctgtttaacttgttaaaacacgaactaaaagtacctaatttgttataatgttaagatttttacccaaaaagcctttatttttgataaaaagcccgctatactatcataagtataaaaaaattaatgttgataaaagttatcatcgaaaaataaacttacacgcgatggtagtaggaattgaatatcaaaatatgtatagggatggcgaataagttcacctaatattagtagattacaagctcatagtggtaaagaaactatgaaattgtttggcacggtgctgcaaagaaagggaacgtggacgtttatattagtgccggtatgttgaacatggcaaaaaaacaaggatttaacgtattggcacaaatctgcttactaccattaggcgctgtgggtggtgccattggtattggattagcacggcctccggcaagggatttgctaaggggcgcgtattccacttcaaaggtggtaagtataaatcatggtcatatcaataaagagaatacttttagtgttgtttagcactttggttggcgtatttgcggcaatcgattttaagtgtgctttggaaatgagaattattttggctgtcgcgttttcaattgtaaatattttttcgtctttgtatacgttgtcgcattggagagagttacgtgaagatcgttatagtcaatcgcaatactttttaatgttcatagtaatggaggctgctttgtgggtatttacggcactagttcctagtggcctgaccggtatcgtttcgtggctttggctggcagccattaatctctgttttttcggtattttggtgatcattgcaattttctatgagagactttggagaaaacgttagataaaattaactgaggtcatcaccgtgggttgcgatgacggccccttttggtgggagttagccggtttcagcaaacaccgtaacggtagtgagttgatgaaatggaggtaaatggtagtaacatgaagattaggttacgtaactatcttatatgctatgtgacaatcgagatcatggcatatattttacctgtgttgtggccaacagttttcagttttaattggtcgagtttaaagcgcatgtttattggtttgctagttgctattgttgttattgaagtttttgagtatatttcaacgaagagaaagtagcttctgtaataaggcttagcattaatctgagccactaaaggggaatagtctaaatgaaaactaactcgcgttggacggaagctctagctaatcagtacagtacttctacgctaaaaaaaattccgtatgtgatgataattgttttattaatatgcatcgctttgatgttagtgggccgtgcttcttggggattcagcctgttaacgttagattttttcatgctggcagactatttaacggttaaattggcgcaaaagaatatcaatgttatcttcagtattttattgggaacgctaatttctgtcatagtcactgggatagttatattaggtttgggtttgttgtttaaatggtgattgcaggacaaaacacattcttaatctgaccatcagaccgtataaaatatctgctgataggcgtctctgcctattcgttaagtcttaagctacaggtgtatcactgatacagcaggctatttgggatgatagctcactcagagtctgattcttagtaagcggttaagcttgaaccagcattcgatagcggatacaatgagactataaaaagtgacgactgatttggacagtcgccacaagttcgcaagtctagtgcggtattatggggagctacttcttttagaagtggcttttttgattatccgataggctctagccaaattgactatcgctaaggataacacgtaggccgccattgcgaacccccgcccctaatacctttctcactaatagagtcatgttcaatcgccccctagtctagaatatgggaggacgtaaccgactaccttgctgagccagtcgccgggtagctaatcccggtcactggctgtggctttaatctagccgacagcacccttgatgtagatatatattgcgctaactagttggtcattaatacgattaaaataagaccggtcttctcagaaatctactttccgaaaagaccgatcttatttgggattaattacttttcttttggctgagaccagtaatgtgcccgggtcaacaggtcacgtgaacggtcatcggcggggacgaaaccacggttgaataggtgcttgaagtacatcatgttatagatagaaccccagagaacacgaagtagaaagcttaatgctgacgtatactggactaattgtgcttcaccactaacactcatcaatagaagcatctggactccgagttcaacacccatcatacataggaagttataccaatcagcccggaaaatactagggaaggcatcaaataaaaatgacgtccacgaaaacccaaccttagcgatccgcatgtttcccgtctcaggattcacgacggtcgcgtagttcggtggcaacggaaatccttgtggaccgtcgccgttattattctgatcgtcattgaagcccttgaaaggatcttgcatgtcatttgccaactttcttaaaattcggtcattaatcgttaaataaaagtctaacacgaaacagcgtgtctgcctattaatctattgacgacgcgttaatttaacgactgcttcacagcgggccgtttggggcatcatgtcaacggactggatatattcaacccgatagtcagctgtcaggtcaaccagatctttagccagcgtcgatgggttgcaggaaacgtagaccagcttacttggccgaatggcaagaatggtttcaattaacgtagcatctaagccggtacgcggtggatcaaccacgatggcgtcgggccggaagcccgccatgacccatttaggcaatagatcttcagctgtgccaacttcatagtgcgcattggtaatcccattagccgcggcgttagcgttcgcatcatcgacggcttcgggaataatttccattccgcgaacctcggcagcgacatcggctaatgacagcccgatcgtgccgataccagcgtaggcatcaacgacagtttgcccgggttgtaagtcgagggctttcttggcctcatcatagaggacttccgtttgtgccggattgagttgtagaaaggctcgcgctgacagtttgaaggtcaggtcgcccagcttttccgtaattgcctcggcaccagccaagtggcgcgtatcatcgccccagaccaatgaggtttcaccaggattaatgttttgcatcactgaggttacttggggcagctcattagcaatgcgctccagcaattcgcgtttatgcgggagcttaggcgagttggtgatgaagaccaattgcacgtcgtcggtatgtgccgcggcccgcacgaccaaagttttgacaatccctgatttttgttcttcatcgtagatcggcatatcaaggtcttgcagcatcgcgaccaccgctcgcatgacggtcatggtgacgggcatttggacggagcaggttggtaggtcgattaaatcatgactccgttcagcgtataagccggcttcgacttgaccctcggcgttacggcgaacttggaattgggctttgttgcggtagccataagggtctttcattcccaaggttggccgcaagtcataactgtgaaagccctcgggttggtaacgttccagagcctgagcgaccacgtctcgtttaaaggccagctgggctgggtaatccaaatgttccagttcaaagccgccgacttgatcggcgtaactgtcgcggggttccactcggtgggggctggttttacggattcggtgaactttagcccgcaaataacgggtagccacactggtcacctcgaccacggcttcttcgttggttaaagcaccgggaacaaaaacggccatccgtttgtagtaaccgatcccctcaccgttaatgcccatgcgcttgatggttagcgggaagcgttgaccaacctcgacttgcacccgttccgtttgccgggcacgtcgttggtcttgatggggccgttgattgcggtcacgatggtaaccgcgatggttcttagattcataatttgccatattttctcctaaacttgatgacatctcttagacaagactgttgtgtccgctgactaacgccatgagggacacaataccgtcgcctattatatcaaactttactggtattcgggagttcggcagtttttggtattttagaagtcgcttccataggcaaaaactggcgagttcggtacaattaaggggatcgtttaatttaagggaggggtcgttgtgagcttgctagagcttcaccatgttgggtatcgcgttggagataccccgattttgcaagacgtaaacctcaagattgataaacaagaatgggtgaccattgccggcccatcaggtagtggcaagtccacgctggtccggattatcgcatcgttactaagtaagaccagcggtgagctacagtttgcggggcagccgattgaaagttatgatcccatcgcctatcgacggcgggtctcgtatgcctttcagcagcccacactatttggcgaaacggtggccgataatctggcctttccatatcagattcgccaagcaccatttgaccaacagcgggcggtcaccgcgctggaatatgtgggattgggtgaggccgatctaacgaaacacgtgaccgacctatccgggggacagcgccagcgaatcgcactgttacgaaacgtgatgatttatcccgaagtgctcattttagatgaagttacggcgggattagatgccgaaaataaaacgtttgtgtggaatatgattcagcattttaaccaagatgaccacttaacgattatcgcgattacccacgaccaaagcgaaattgaatcggctaaacgcttggtgacgattgagaatggtcagattgtcggaggtgtccaatgaacttagcagtgaataatcaatctttgttgttagcactcgggttagtcgtgattgccttagccattggttggaaggaaaagctgggcattgatcgcgacatgattatcggggttgtccgggctgtcattcaactctttgtggtcggctatttgctgaagtcggtttttcgggttaataatctgtggctgacgctcattttaattttaattattatttttaatgccggctacaatgccaagcaacgtagcaacgggattccgcgagccttgccgatttcaattgcggcgatttttctgagtacgggcgtcacactaggcgttcttatgttggcgggggccattcggttcattccagcgcagatgatccccatctctgggatgatcgcgtcgaactcaatggtggcgattggcctgtgctatcgcaacttgaacgcccaattcaagcaagaacggcaagccgttttagagaagttggcgttgggggcagacctaaaggacgcgtcacgagatattttgcgtgacagtattaaaacgggcatgcaacccacaattgattcggccaaaacggtgggaatcgttagtctaccggggatgatgtcgggcctgatttttgccggagttgaccccgtgcgggcgattaagtaccagattatggtgaccttcatgctaatgtcagccaccagtattggctcggtgttagcgtgttattgggcctacaaaggcttctacaatgagcgtaaacagttgattaattaggaaaaattcaggaggtaatgtgctatgacacaacgaaaagtagcgttggtaaccggagcttcttccgggattggaaatgcgattgctcggagcctgcaccgcaatggcgtgcaggtatatgccggtgcgcgacgggtgagccggatgaatgacttagatgacctcggtattaccacgttggccttggacgtaacggatccggcgagtgtcgagcatgtcgttgaccggattgttggcgagactggtcgggtggatattctcgttaataatgccgggtatggtctgatgggtgccctggaagatgtgccaatggatcaagcgcaggcccagtttgacgtgaacctatttggtgcggcgcggttgattcaatcggtgctccccatgatgcggcaacaacacagcggtcggatcattaacattacctctgtggatgggaagattgcccaaccactagctagctggtatgttgcttccaaattcgctctagaaggcctatccgatgccttacggttggaattatttcctttggggattgacaccatcgtgattgaaccgggggcgattcagtcagaatgggctgacattgcagctaaccatttacgtgaaacgtcagcggtggggccctataaaccaacagccgatcgggccgctgcgattttacaagcggtcaagcgcttttctagtaaaccacaggtgattgcgcgattggtcgatcgagcggcactatcacggcggcccaagactcgttaccatgcgggggctggtagtcaggcagtcgtcgcccggcgcttcctatccgataagaccatcgatcggttgtggtggttaatcggtgaagcaacgcaacgcattaaacgttaagctaagtttgattgccgttgcggcaaaaactgttatactaaaaataaccaaaacactaggggtgtccacaaatgggctgagatatggcaacgccatgatcccttagaacctgtcaagttcagacttgcggagggaacgtgtcgtggcacccaaatgaattatagtcgggccaccggtttctctttgtgagtacaccggtggcctttttatggcctaacgaataaagtcaagtggcgttgaccctgttaactagcgggtcattcagcggaaccggggccgtcataaatcacctgactggcagattatccggctcattttgctggtacagtccaagtgcttggtgacgcagatgctcgcaaagaaaaggggaggaccttaccatgaaattagctttacttgatgacctacggacccagaacccaattgtctttaacatctccaactttgtcacggtgcaggatgtggcgaacggccttaatgcgttaggggcgtcgccgattatgtccgaagaaccagccgaagccggtgaaatggtgggcttggctggtggcgtgtgcttgaacctgggagcatttacgcaagctcagattcaacaaattcggacggtcggccaacaagctaacgcccagcataagccgctagtgattgatcccgttgcagttggggccgtgcggtatcgtaagcaagtggccacggggcttttggcggatttccatcccgatgtcgtccggggaaacgctggggaaattgcggcgctagccgatatttcatggcaagctaaggggatcgatgccggggaaggtgcgggagatcttgtggcgattgcccaagcctgtgcccagaagctggattgcgtcgtgatcttatcggggccaacggatattattaccgatggtacgcgggtggtgaaggtcctgaatggcacgccattgttccaagtacacgtggggtctggtgatatgctgtcgagtattgtggcggctttctgtgccgtgacaccggacacctttgaagcggcgcaaacggcttgcttggtctttgcggcgattggccaacgggtcgtacaagcggtgcctgacgttggtgcgggcagtttcacggtgcatttattagatgctttacaatccacaacggtggctcaaattgaagccgttgcggcttatgaataatctcttggaagggaagtagcatgatggcaaatgaatttccacaaacgttaaccatcgccgggactgatagtggcggtggcgccggtatcatggcggatctcaaaaccatgcaggcgtgtcaagtcttcggtgcggcggttgtcgtcgctgtaacggcgcaaaatacacttggggtgcaggactttatggccctgccacaaaaattaattgatgaacaatttgcgtcgttagcggccgatttaaaaattcgagcgtgcaaaacaggcatgctggctgatgcggcacacgttcatggcgtcgtggaaaacctcaagaagtatgattttggtttattgacggtcgatcccgtgatgattgccaaaggtggcgcggctctgctggctgatgacgcggtgacgaccgtacgtgatgaactggtgccattggccgatgtgttgacgcccaatttaccagaagcggaacgactgacggggctaacaattaccgataatcgggggatggaagcggcggccatggccttacaagatctcggcgctaagaatgttgtgattaagggtggtcatgaagcaacgcccgatcaagcgagtgactttgtcttactggtagacggccgttcattttggttatcggctgcgcggatggataccgtgcgcacacacgggacaggtgatacactgtcatcttgcattaccgcagcgctggctaagggcgaagactttgaaacggcgatccgtatagctaaagacttcgtaaccgcagcgattgccaatccaattgcggtgggcaacggtcacggaccactgaatcactgggcttataatcaaggaggcgcggaataatgtcagtaacgtttgaaccaggtctgttacgggcctactttgtagcggggagtcaagatgttccggggcaggatttgcgagatgtcctagcgaaaatgttggcagctggaattaccgcctttcaattccgggataaggcgacgagtaccttgacaccggaacaacgcctagctttgggccgggacttacgggcacagtgtcgggtagccaacgtgccttttattgtagatgatgacgtagagcttgcattggcacttgatgccgatgggattcacgtcgggcaaagcgctcaacgggttcaacaggtcattcaggccgttgctggccgcaatattttcgttgggctgtcgtgttcgacgatggctgaagtaacggcggcgaatgccattgccggaattgattacattggcagcggtccaatttttccaaccatctctaaagctgatgccgatccagtggtggggactgccggcctgcaaaagttggtggcccagtcccgggtccccgtagtcgccatcggcggggttacggtcgattctttaccggccattgcggaaacgggtgccgccggtgtggccgtgattaccttactgacgcacagtcacgatgttgatgctgatacggcggcgatgcgtcaagctttcagtaaataatttaatcgctaaagtgattgtcggccgaccttaaaaggggtatgcttcgagtatatccgcaaaggggaggaatccaatgagctttttggagttaaaggacattcataagtcctattatatgaataaagtcgcgttcccagttttaaagggaattaatttacagtttgaacgcggcgagtttgtgtcgattttaggtgagtctggtggggggaagaccaccctgatgaatatcatcggggggttagatgcccagtatgagggggacgtcttactcaatgggcgttccgttcgggacatctcggctaagcagttagacgcttatcggcgacaaacgattggctttgttttttaaaactttaatttgattagtcacttgagtattttggataacgtgttggtgtccttacagatgacgggcctcagtcgcaaggaacagcgtgaacgcgcggtacaattgctggaccgggtggggttaaaggaacatatccacaagcaccccaatcagttgtctggtgggcaaaagcagcgggtggcgatcgctagagccttagcctcagacccagatatcatcattgctgatgaaccaacgggggctttggattcccaaaacacgcaagaaattttgaccttgatggatcagattgcggcggatggcaagttagtcatctgtgtgacccactcccaagaagtggcggatcacggcacccggatcgttcacatggccgatggggtgattgaccatgatacacggttaaaggacccgttcctggtgaaagagcacgcggcgttaccagccaagcacctgagctttacggcgatggtcaagatggcgttgaagcatatgcgctataatttaaagcgaaatttgttaattatctttggcgcctcgattgggatttttagcgttattttgatgttgggcttaggtcgtggggtcaaaggctacatgaaccacgaaatctattcgcaaattaaacccacggcggttcaagtcgctcaaaatacggatagtcaggacccgaagaagctcgcggtgacacagagtgatctcagtcgcctgcagaagctgagtcacgtcaaaaaagttcagctcggctactatggtagtaatgtgcaagtgcaacggggcaacgctagtgcgacggctcaggtgatgcagaccacgaccgaccagatgctggctaagagcatcaaaaaagggcaacgaccagcgactggcgaagtcgttttagggaaagactttgcgcagaaattcaacaaaaaacacccgtaccgattaatcggcaagtcagtaaagatttcgattacgggaatgaacaagcagcatttacccgttgtgatgactaaatcactaaaggtcagtggggtttctgatggtagcgccggacaggtgcaaaccaatttgaccacggttcggcaattgtatgcggctaagaagttaaccttccatgccaactttgcgacagtggttattgataacctccagaatgtgacgagtgttcaggacaaaatcaagacactcaaagcaagcaacggtaagaagcagtatcaattgaccggcgcgggcgcgttggtttcaacgttgaacacctatatccaattggccttctacgtattggcggcgattgccggcatttcactgctgggttccgcgattatgattattgtcgtgttatacatcagtgtttcagagcggaccaaagaaattgggattctccgggcattgggagttcgccggaaagacattcgccgattattcttgtcggaagcctttttcttgggcctattctccagtgtgctagctctgatcttcacggaactggtcgcatactttgccaacaacgtggcgacgaagtacattggctacagcatcattgagatcaccagtaattatatgattttcggcattttcgtggcgattatcatcagtttgctggctgctttagctccggctgggcaggcttctaaacttgatccaattgaatcattggcctatgaataaacaacaaagaggcgtcattccgagttatgtgcgggatgatgcctcttttatttgaatcaatcgtaacctgtgaactatttattgctggtaataaggcgcttgtaacaaataggcgtacgtgtaacgtgatttcgagtaatagaaaacaggacccacggccgtgtttaagtgcggcacatctgggtcctgcttttaagttgaggaagttagttgactagggctaacttcacaagttcattctaccacgccaacgagataaaagctattacaaaaaagtaacgtttgatgctaatttcactgatagttaaaaaacgtgctaatagtttaaatattaatctggttttgttgagaattatttggtagatacgaccgctaagtagtggattagtacaaattattaaaaataattttgagaaatacaggcttgtaaatacgaactcatgttcgtataataagaacaagcactgaaggggggactgatgttatggattactcgcaggagccgcatggtctattctttatgatcgacaataaatcattttatgccagcgttgaaagcgtggagcggggattgaatccgctagagtccgtcatcgtggtgatgtctgaggccgataatactggcagtgggttggtgttggccgcctcgccgatggctaagaagctgttcggcattagtaacgtgtcacgccagtatgaggtgccacgggacccccgtattttagtcgtgccaccgcgaatgaatctctatattcggaaaaatttgctaatcaaccggattttccgggactatgttgcggatgctgatttgtttccctattccattgatgaatcaatcttagatatgaccaagtcgtggcatttgtttggggagacaccggaagcggttgctcgcctgattcaggtgcggattcgccaggaattggggttgtacaccacggtaggtattggggagaatccgacgcaggctaaattagccctggatctacaggccaaacacgatcatgagctgattggtcggttaacctataccgactttcccgaacacatttggccgataacggatctgaccaaggtgtggagcatcggtcaccgcacggccacccacctcaatcgattaggcattcacagtatgggagacctggcgcacgttaatccctatgcgttgcaacaggagatgggggttattggtgggcaactcttcgctttgtcctggggcattgaccgcagtcagttagcacagatccaccccgccaaggaaaagagctggagtaactcgcaggttctaccacgagactatcatcaacagcaggccatcgaactggtcttacgtgagattgcccaacaggtgattgcccggatgcggcatcaccatcagcagaccgcctgtgtcagcttgtccgtgggttttgcttgggatggcaaagccgatgatgggcgcagtggcctgcaccatacgcgccggattgaaccgaccgataacgcccaaaccattatccgggaattggtgacgttatttcgtgagtattggtcgggccaagccgtccgcaatctggccgtagggttatcgcgtttgagtgccagcggtcatgttcaattggatttatttcaaaatccgcagcgccagcttaaagatgatcgcttcgaccgtctcattgatgagttacgcgaccgatttggaacgactgccgtcattccggctagtagcctgctacctggcgggacgatgttgagtcgcgctgcactggtaggcggacataacggggggaatagctatgattgatgaacaggctgaaacgaaactgatcctaacccgattggccccattatttacggcgcagtggcattgccagtatcggattgacgtgatcaataatccttatggtgcggcgattaatttcttcttggacattcgccgaacgcatcatcgggagcgctcaatcccgctccacacagtagccacgcaggacttagaagtgttggagcgtattgtgtggggtattcgacaagaaacggcactgaccttaaattttgtgaactttggtcacgtgcgctggccgcacagtcagcgctggattcactaaggatgggactgatatgttaaaaaaacaaccgaatgatcaactcgccacccagtttttccaacgcgattatcaagaccgcggcatgttgaaatgggggggattttacttgtcggaccatacgagtgcactgcgtaaaatgcatgccgccgaacagcaggaagccgcgcaaccccgtcagtccgtggcaatgattagtgaacgcttggcgctggcctggcggacacatcgccacgtgcatgttcaactcaatgtattggatgctaaccaggcagttgcggtcctcgatggaaccgtggccggggtagctgatgaccagattatggtgcagttgcccgcgggtaactatcaccaactagccttgacggcaattcgttgcgtcacggtggcggctcattaaacacaaacggcgtgcatgacactgcagttgtgtcatgcacgccgttatcggagattgagttatggttgtgactcaggcgggatcaagcccgcctcggggccagtataccatggtcactggtgtttgtttaggccgcctgaccggtcttattttaaggaattagcgcaattaaaaaggcgaacatctccagtggaccactcaccggagatgttcgtctttattatacgttagaaagtggcgtgtgtcgtctgcattaactcggcccctttgttaactaggaggtaaccggaaccgttgctcgtgaactgtaagccttcaaattcacgctgaccgttcaagttcgtcccctcaacttggctggctttgagcttacccagctggctgacgggcacagaagcgagactactatcggaaacgaagtagagtcggttccgcttggcgttgtaagccatcgattggggcttggttcccggtgcgtaccgcaagccttgcatgactaaatgaaaatgaacggacttggcgctgatggttccttgataaatcttaaccgcgcccttaggagcccagccaccgtttgagtaggtgaagaagtaggcttttccgtgcttatcaaaggtcagattagagcccatcggcaccgtatttttcagggtgaaattgaccttggtgcttggcttcaatgtcttggtcgatacctgctgcacgttagatttcacggcgccgggcttaccgataaaccacagttggccattcttagggttgcgggcaagagattgaccgtggccggtattaaagagtggaccaacagtcacattttttaagatggccttgtccgttgcggttaacttaccaacagaatggtcgtaagttgcacgccgtagggcatccatatgcgtgctggtaatgccaaagtgacgcagagcccctagattgtagcgaacaatacggccggttgtactctgactgctggtcgtgatgagttcatagagtgtattgccgttgggggtcagcacttcactttgggggttgccccagtcagctgaccgctgataggtcacgggtaagaagacgtcggacttaaaagtaacggctttgcccttagtgctactgatttgggttggactggtctgaaaaatattggtgtagctctgttgaaaggcgtagcgcttaacgaataaattccggttcttcacggtcttataccgcttaacgttgtatgccgctagggcgttaccatgttgagtcgtggtcttggcgtgggcacttaaggctggcccacccactaataaagcagcgattgtcgctgcaagtaaccaatgtcgagtttggatcatgtgtgttctcctccagtaagtaaactgtcataacatatctatttatagcacaaatcactttatatgtaagcgaaaacatcaaaaaaataaacagttaaatcgtaaaatacctcacgttttggataatttatcaaatatggtaaatgggggtcaacgcgccggcgctgggtatttggtgggtaatctaccggaaaaagacggtaaaaaaccggccgtttgctgaaaaaaaccgcattaggcgcacggataaccttccggtaaagtggagagtgttccatggccatggatcatcatgtaacgaaaggatgagccatattggagacgactcaggcagccgcctaccgctttttgtatcaaggagaccacgaaacaattctatatgcggcgttaaagcgcctgcatattggccgcaatcacacagactatgaggattacttacaggaggcccgccttctgttccccgagatctatgccgctttccccgaggacccggaagccaagccgcaccactttttggcctacgcccagcagaagctctattgggccttactggaccgcttgcgccgtgaattacgcctgcaagaccgtcaagctgtgggtgaccagggggaattactaacaaccgtggccagtgacgaggatattttggatgcgatcggtcaagctgattttcgggaatacctgttaaaggtgattggcggtgccggcagcacgggagaatggcggtatctggttggtaccatgattgaccaattatcccccgatgagattgccgcacgccacgcggtgaaccgcgccacggtctttcgttggcgccgttcggtcgtgcgccgactggtacaggctttgacgcccccagataaattttaattaaaaagattggcaaaacgtgcgactttttccggcggaatttcgttagtaagagtgtaagggttggccaatcacttactaataacgatccacgagaggagtttcactatgcaaaccaactggcagaagaccaccatcacgtttatcctcggcaccgacgaccagccggccaagatcacgttacaacacgcgatcgcgaccccggatgcgaagcaagtcgcggccttcggtgggtatctggcggggctgacggggttaccattccgcaccgcgctggtcgccactcacaatgctgttgcctaattcagaaaggatgggattaaatgaaaacattggaattaagctttaagggctccgacatgcgggtgaagcatttacgcttgaagtacgtgaacacggagcttacggcggatgacgtgacggcggtgatgaaccagatggctaaagccaagttgttcgtaaaggatggcgttaatctgtacgccgatccactacgggccgatgtggttgagaccaccaagacgaccttaatggccgttgataccgcaccaaccgcttaaccgtttgggacttaacgcaacgagtcaagaacggctagtagcatcaagtaacgcgtaattaacaaaaaatcggtactggcagcggattaaagctgcgagtaccgatttttgggtgtcattagttaatgtggggatgttctaggactttatccggataagttgtggttacgtagtccgtaatcgccgcaatcatcttggcggttgagggcgctttggcctgttcggagttcacgacaaggcagatggtgcggtagaagcgtgtatcaaatggatagacgttcacgttgcccgacagacgttctagtgccagttcggggagaatccccatgcccatgccggcttcgaccatggctaagatggattggtcgtcaatcgagaagcgtaacgcgttgggccggatctggtaatggtcgagggccgccttcgtatccttatcgtagtcgccgcgttgcagaataaaattctggtcgactagatcggcggccgtgaccgtcgtgcggttggctgggataaagtcgcggggcgtgatgcagtagatttcatccttaactagcggtaacacggttagcttttcggccacggggagcgcagagagtccgaggtccagacgtccggtcttaacggcagcggcaatgtcgctgaacccggcttgaaccaagttgatatcaatctgtgggtaagtttgtttgaactgctgaatgatgggggggagccaagtgatgcagacggaagaaaaggcgcccaaccgtacggaaccagcattcaacccgttgatattggcagcagcctgttggagccgatcttcggcgttaatcacgccctgaatcaagggcaggatgctttgaccgtccggggtcagctcaacgccggtgcggttacgaatgaagaggggaaaccccaattctttttccaactgattgacggaatggctaatggctgacggggtgacattcagtgtctgcgccgcccgatagaaggtttgttcttgaacgatggcctgaaagacgcggtaggcaaaaggtaacatgagtgggcacctccgaaagatgaatgagattcaacttgatggaatctgattgaatagaaataagtgctcttagtttagcataaatttggcgcaacagccgaaaagaattggtgtttagttgggttagggtgctgaatcagttatgctataaccgaaaaagccagtggcggtggtcgctggagcgttaactggggatggaatgggacaatgaaaggtgtgatcacatgacgattcgattagcgaaacgggtgaacttggcggtaccgtcagcgatgagtggcttgtatccggctaacctgagcgcagatgccgtctcatttgcggccggacaacctaacgaacggtattttccaacggtggctatgaaacgggccattgatcaggcgttgaatcagggcggacaggatctcttccagtaccatgatgttctaggcaatccggaacttcgaacacaattggcggcgcggattgcccgcaccggtggagtatccgtcacgcaggataatgtcgtcttgacggttggtggtcaacagggactagaagtcatcgctaagacggtcttgaaccccggcgatgatgttatcgtggaaggaccctgctacttcggcgcgctgggcgcatttgacctgtgcgaaccaacttaccatacggtgccgttgcaggcggatggcgtggatctcgaacagttagaggctacgctcaagcaatatccggaaacgaagctgttctacacggtgccagactaccagaatccgactggggtgacgatgagtgtggctaagcgacaacgcttagtggcgttagccaatcaatatgatttcgtaattctggaagattcgccgtaccgggatctgggctatacaggggcgccactgccgacaatcaagcatttcgatacgcaggggcgggtcgtctttctctccagcttctcgaaaatgttggtgcctggtcttcgggtgggctggttggtggcggacggtgatctgttggcgggaattcagaagatgttactggctagtaatctgggcgcggcaagtgtcgtgcaggaatccttggctaactatatgaaggaaaatgatctagatgcgcacatggtggagctgaaaaaccactatcatgagcagcatgatgccatgatggcagcgattcagaagtatgtaccggatgttgtgaccgtgacgcacccgaccggtggcttctattattgggtgacgttaccgcagggtgtcgatacgacggcggttttagctaatattgcggcaccacaagcccacgtgacgtatattccctcggccaacttctatccgcaacacgatgtgcataatggcttgcgcctgagttatagtggcgtgaccccggcacagattgatgcggggatgcgccgactgggacaggtgctagagacggcgattaaacgggcccagccagtaccagaagcataatatagaagaaaagggcaaacaaaaaggccggcgagaacatttcgccggcctttaccttaaagaagttaatcgtttccgttctccgtggaagcgatcactttaaggtaactatttccagttgccaaaaagcatcaccccctttcatttgatgcctgtagtatggacccatcggaagataaatgcaagtaaacttacttaccttaaccccgctttaaatgtgatcgtcaataatgattgccaacgttgaggaataagcggttacaaaggctttaagcaggttagcggtattttagttatgtaacaataacattacaggacacccataattatttcaatccaacgacaatcagagcgtaatccttgtatctccttaaggaaatcgctatacttatcttcgtagttaggggatagctgatcgggtccgctgatgttatcgaataaatttcttaacaaaagcgctaacttcggttatactattcttgcttgataaattacatattttatgtttggaggaagaaagattatgcaatcaagtttaaagaaatctctttacttgggccttgcagctttaagctttgctggcgttgctgccgtttcaacgactgcttcagctaagtcatacgctactgctggtgcctataccacattaaagtccgacgctactactcgtaacgttgaagcaactggtactaacgctttatacacgaagccaggtactgttaagggtgctaaggttgtcgcttctaaggctactatggctaagttggcttcatcaaagaagtcagctgactacttccgtgcctacggtgtcaagaccactaaccgtggttcagtttactaccgtgttgtaacgatggacggcaagtaccgtggttacgtttatggtggtacttctgatgctgcctttgctggtggtatcaagtccgctgataccacgactactgcttctatgccttctaagacgaccggctaccatttagctaacgctaacaagaacggcctctggacagcgcctaagaatacgcaatacaaggctaagagtattagcttgtacagtgccaacaagacggatacgtttacggtatctaaggctgaaactaagacccgtgaaggtagcttgtactactacgtaactgatgataatgataactcaattgccggttggatctacgctggtaagggttacaatgctagtgcaacgactcaaagcctcggcggactgtcattaacggcagaagatgctgtggccactgaaaacaacagtgtgacagttaactatcttggtgctaatggtaactcagtaggtacgaagacgtttgttacggctgttaagaatacgaagaaagacgccaaggttaattctgataagaacattaacaatcaaactttagctgactttattaatgatgcgacgaacacgcctgctggatacaaggtatctagcactaatgttgatacgattgccggtgctgctgtttatggtgggactgttcgggttaacgtttacaaggcagcaacgtcaacgattgccttctatttgccatctgctaatggtgtagatgctggtgcacagttgaatgccgctgacttttctaagggtaagccatctattaccagcgaacaagctaaggcgttgactggtgatgctaatgataatgttgtaactggtggaaagaccgtaacggatgggttctttacaacactttactctaagttattaacagctagttcagatacgacagttaatggtacgccggttactaagggacaaacttattacgtaacctacacctacagtgatagcaagacggctaccgccaatgctaatgtgaagtttggtagtacaattaaggctgtattcgatgcccagacaactattgctactaaattaccagatgctgctggtgtgaacaatggcaatacgactaattactaaaattagtgattattgaatactaattttctagacaattgtttggagataaaagtgcccaatggcttgtaaaagccactgggtattttttgttaatataggttttatgatataacagtcatataaaggaaaacgcggtgaattaataaatgataaaattgaaaaatattactatattaataatgaaaccttcccaactaggataaatcggctacctgtcgtataattcttagtgagaaaagaatttagaacactttaatgaatatatacatataataaaaaagtttttactgtgaaaatagcaagaaaggaaacgacaatgttagataagcagagtgtgcggctactgattaagtttatcggcacaatgagtttggcattaataatgctgacgatcccgcagttaacagcgcaagctgccacaaccgattctgataccacactaactgaccaagagttcgaacggcaaattacagccgacgttaaccccgaccgtccaattagagaggtatttcctgatccagtaatagctagtcacttcattgatagttataatcactacgttcattcacccgcgggccagaaggttacgctggacgccaattatcaagcagcaatggcgcaggcaagtaatgctttgctatatatgaatattccggagaaggtccatgattggaccggggtcaagctaatggccaggaatattgccattatctcgaatcagggtgatggatttgataagaaggccctgattttttatcaagcgtttgagacgggcaattcaattaatttttctaactgtggcattacccaatcgacatttgacgggttccttgattatatgcgtgaacaccacataaccggtattcagggaaactttgaatataaccatatttctgatttttcgcggttatcgaatattgttgtgaatgataataactacccagaaggctatggcttttatggcttctttggtgctggtcaaacgaaaggccatataacctatgaaggaccgggggcaccgattaaagtagtgggcaatacggcaacagttgcggttgatgacttccaacagatgatgacgttgggctcgccgaccagtacgattccagttgattggcaagatggcgataatccggtaaatcacacctattgggccatcgacagtgaccttacgcggcaaatgtacgatccaatcagtcacggcaccgcgttgaagaaagccgagttgaaccatacgtttcccggggagacaccggacttaagcgatgtggaccatatgaccagttggcggcaaagtgattttgaccgctttgcgcgagactacatgacgcatgccggttactatttagtgagcaatacggggtggcgtggtagattggatgcgccgccacccattgcgtcgagtaagatgtacctgcgttcactggctgatcggttgcaacttaaattgccggcgatggtcgagaattatcccgagcgggttacgttgaccaatattggcagtgaccagcagtcaataacgattaagggggattatcggaacgagggctcaattgtgacggcctttaatacggcggttgacgtgccactggttcatgagaaccaaccctcctcagggtactcgacagaaagtgctcagtcaacaccctcttcaaagccggatgacgtgactaagcccagctatgtggtgaagaaggggcaagcggtatcggggataaagaaacttggtttgtatcgtcaggcgacctttacagcgaagaatcggcgggtattttaccctcggcagtcacgtgaaaaacgcccccaatttgtcgtgacagggtatgccacgtctagggccggccgtttgcggtatcgggtgcgcgatgtgaatcatcatagtcgaacggctgggctaaaggggtacgttaccacgcggccccagtacgtgacgaatacgtactacaagcgaaacccgcagcgaattcgggttatcaatccgcagggggttaatgcctatcgccgggttaagttaactggcaagatgcggcactataaacggggaacgattttgaaagtgaagcgtctggaaccgtatcacctgacgactcgccttgtattgacgaatgggcagtatgtgacggcgaataagacgttggtgatgaagcggtggtaaatacagactaaaaataggtaatgttggaatgatccagtcttggacagagatgtcggggattaagtgagctaaaatggtcatattgattgccaatcaaaaaagtcgtccacaaatggacgactttttgtttgctctaaggcaatcgcaattccataggcagatcatcgggcacaatatccagatgctgacagatagtcgtgagaatatccgttgcgcgggttaagatggtgagattctttaggtgcagccgaaaggcaatcttgcgttgcagccaagtcggtacggggagctgaccggattccatgtgccagtaggccatcggtgacacattcaacaacgcactaactgccgttaccgatcgatcctcgacctgggttcggatacagcgcaagacgtctgcgtaggtgtgtttggccaatgggtcgggatttgtgattagcggtaccacctgggtgctgtctggccaaggccgatctggtaaataattgggtgcttcatacgtacggtatcgttggatggtcatgtggacaatggcttcgggtaaattcgcggccgcagatagcatgatcagctggtcaacggttagttgataacaagaacaaattaaggtcagcgtgtcaccgtcagcgacagtaatatggtcggcttcgagttctaaaaggtaccaaaccggaacgtcaatgtcctttagcacggcctctggcgtcgcatcagcggccaaaacatggcgcagtgctttaaggatggtgcctaaactgtgagggggtgtccgcataaagagcctcctaatcattttggcccagtatagcaagttattatgggatagatgtgaaaaattcatgagattttccgaattatcacaaaataaataaattaataattcgtattttaatcaaaaaacgtgtttggcagacatagttttatctgaaataggttgcgccaataaagcgatcgttgaattaattagacaatacgtccttcttgctattattcgtgttttgtgagaatctatagccgaatcagagagtgatagatggtaattgaatgagggtgaggggatgtcaaccgcgtgtttgaacggattaacggcgacgtatcgccaacaagtggtggcaacgaatacggttgattttacgaagttgcaaccacaagatgtggatcggttagtgccaacgaatcaactggatattgactggtcggcagtcatttttattaagaattgtcggcgacgtaaagctattgccgataccgtagtttggacggagcaaggtggtttttatcgaacgcgtcagtcgccccgagcactaatcaatcaagtagtcgagacgagcctcgtgcagtggctagacatacgggccatggtggattatctagaattgagtggaccattgccctacgtgatggggcgaatcatgttagtctctacggagcgaccggccgatggtaatcagaccagttgggttggctgttggagtgtgagccacatgaatccgaccactcgccagcatcaagtgagtttgctgttaacaaatggaatgacgatgattattcgcgatacggtgtcacgtttgcgtaagaagatcgctgaagcacatcagattttagtatttcagcaggcaaaccaagcatacgcgacgtatcagtaccagcccatctcggacgtctaccgaccgtttaatcaggagccattggccttttgtcattatcgagattggcggttggttagcggtgttttacgtaaggcaggctattcactaccggatgaagtcattaaacaactggtcaccgaaatttatcggggagattggcacccacgacatttagatgacgaatgggtgtcgtcacagtattgacggtagttggtatccgtgggagaagtcaaaaaattaacaaaataatattaaattcgcccgacatataatttgtttataatatagtcgtaaatatatgttagtatgaatattgtaagtgcgttagggattaacctttttaacccagaacgaactaattcgcacgaggactatgttagacgccttgacggaacataggccgttgagatgtcacgaggaggaagagaatcatgatggaagcgaaaaaattagcggtggacgttgaacggattcaccagctgaattcgctcttacggcccttcatcaaacggccaagtgttggcgataccatcacgtttgaacagtaccggattttacatgaactggttgctgaaaagattagtaccagtgagttatcccggcggttaaacgtaggtcaatccatggtatcaattcaaatcagtcggttattaaatggtggattcattaaagatgaaaccttgccgacagatcggcgctatcacgtctttcagatcacgactcaggggcgacgggttgaagaacacgttaacggtgccctagaagttgaattaccggagttaatgaagcaggtcaatacgatcttgaaataacgaaatagctgtgatgaaccgttattagcgacagacaaagaggacccccaagaattggttaaaattcttgagggccctctttgagattaataacgagttttacgcttattcagcggcttctaattcttctgctggttctttgagtggattacccgcctcgtcaactaattgcagttcactcaagcgaataacaaccaggtcgccgaaagagtcaatcttatcggtttccttcttggtgagttggttaggttcaaccttaaccaaggccgcatgttcgtagatcttagtaatggttccgtaaaatgagtcagagaagagttcagtcttcttacaaaagacccgattattttcgtgtaatgccattggcgatcgtcccccataaaagtaatttataacagagtaaaggtcatgggccgaaatgtcaagaagtttccactaaaaatattgtatctgtgtaaaagattgtgggtctggtttaataagcgaataagtaaactagttgtgtcgcagctgatcaatcttagattgcgtcgcaaaattttgtaataattcgttttgcttggtgacttgagtggcaaattccgtaagaaaattaatgtctagatcgcgcaggggacgctgttgctgagcggcaatgaggaggtcgtcaatttgttggttcaaggactgactggtttgttgcaatacggcaaaagcgggaatggcagtgattccggttgaggtgaaggtcgacgtaacagtcggggtaccggttgtggtgatcgatgtcgttgacactggttgcattttttcaggtgttgccgtgctggcatcgaagtaataatagacttcgcgcggttttaacgcagctttcttaatacgatgatcaattgaaggcgcggctgagacggcccccatgacgacggttgtggcgaagcctaattcacctaacatctggcgtaacttgaccgcccgaattccgcgaatccctggaaatttttctgccgagacggcctcggtttcgtgttcatcttgtagccaagtgataatttgctggcgaatctttgccgcttgactgtttttagtatttgccatgtccatgccctccatacgcgttttaatgattaattaagttgttattaattattgaaacatgtttattgtggtagtgacaagggccaatggagaaaataacaaatttcttaggacttttacccgccactaatcttttcaagataagtatggtacaatcagggtacatagaggaataattctggtgatactgcccattacgggtggccaggctaacatcactgtgcgcatgagggttaatcattgggggtcttccctgtggttgtcttagtcgcggcggagtttcggaccctttgattgagcaaatgccgatatcgaggaagaggcgcgctggcgacccttcctttttgtttatcatcagtgcgtcggtggcagttctaatcaatataggagtgaacaattttgcatatctttagagatgaaaacggggttcggctggtcgtatcccaccagctcggacattacgccgtccatttcacgaactacgccccagaacaggaattcgttaattacgaattaaaacgagatcggcacggccgttatcatctaaacattgagaaaacgaacctgacagaactggatcaaccagtctttaagcaggaattggtttttggtgacttaggtgacagcttaacgcccattgccggcgtgacgctgatgctgatctagttcaggagacaagttaagaatacgagagtctgagacaaaagcctcaggctctttttgcgttcgcgaatatcgggtgctgaagtgagcatcaaaagtggtttaacttgataaatgtaattgtaggagttacagtatagatgttcatttaaactgaaggggtgcttgtgatgacaaatgttttagtattaggggctaacggtaagattgcgaagctagctacagtgcaactattaaataatcctgacaatcaacttaccttgttcttgcgtaaggcacaacggctggcaggggctgccggtccccgagtgaaggttgtggaaggcgatgctagtcaagttgctgatttgacagcggcgatggctgatattgatgttgtgtacgcaaacttagctggtcggaacattgaagacgaggcgcaagcagtggtcactgccatgcaggctagtcacgtacaacggttaatttggatctcaacgctgggcatttatgatgaagttccgggcaactacggcaagtggaatcatcagatgttagatggcggttacttggaaacttatgcggccgcggcgaaggtaatcgaagccagtgatttagcctataccattatccggccagcatggttgacgaaccacgatgagatcaactatgagacgacccaaaagggtgaaccattcaagggcaccgaggtctcacgcaagagtattgcagccctggtggcaaaactagtcactgatccaacgcaagcggtacgggcttcgctgggcgtcaataagcccaacaccgatggggataagccagcttggtactaaacaccggtacgtcggcgtttggcggttatttcttaaattaaggattcaaaaagagtgcaatgtcagtgatttcgcggtataactaacgtgtgtgttgagtagactccacacgacctgtgttcaggcttttattatctttggaatcaatttactgagctcattctgtgaaacttttcctccaaacaagaaccatggatttgcctggaattgattcatatatcgtcaaataccgtcgacagttagcctgtcggcggtatttttatggccaatgaaaaccggtcaaatttagaacataatttggtgtattttggttgcaaacgcttacagtcggtgttattataatagtgcggaaaggtcataaaggttgtgaccgagttccatgagttagtattagatgtaagtgtttgtaaccactgatttccgttttgcacgtaagtcagatttaccagcaagtttaagattctgaaagacagatagatgacaactccgataaaccttctaacgagctctggtagttttaggtaacagaatcagattttcagttttacaattgaatagtgttttgaaacatcatgcttcttgtaagcaagtgttgatagacttgaaacagttccaggcagttaactagagttcggatgttgcgtcggcaagaccatgtgaggatttcaagaagaatcgttaaaatgtggccggttagatgtaatgagggaattaagatttacaagtaacacgctgaaaacggcagccagaaattgtcaatgaatgaatgtagtggttgtggcagctcagcgagagaaatgttctagttatgaggcgattaagaattagcaagaaaacgaaacgggaattttgcacgactcacaacagcctttccgcgagttagcagacttcaagttattcgcaactcaacttgaagtctgtttttatgtcgcgactactcttgttgtttggcataactcagctttagctgttttagttggtacataatcggttgggtggtttgttagaaacttacctaacttagtggtcttctgccacgtcgttgttctttgaaattaggatatttgtcgaaagtaaatccttttagcaagaaaacagaatattcaaagatgttctgaataggccggcccctacaggtggttcagggtgataatgttcggaaatagactttttacgttttccttaaatcgaccatttacagggcggctgggaaaaggtatattattactagaccgaaaaatacttgggggatttttacctaaatgtttatcgaaggagtgagcaacggtggcatttcatcgcattttcgtggttgattttgcgggagtcggattgggcgaagcgcctgatgcgaaccgctttcaatcagttggcgccgatacactggggcatgtggcagttagttggccagataaactaaatcttccaacattacagcaacttgggcttggtaatattcgggttgaccatcctattccgggagttgagccaattgaccagcccagtggcttctatggacgcttgcacgttcaagcacaagacaaccgacgagctactggattacgcgagatgtgggactttaccggtgagaaccggacagagaccgtgtttgctagtctaccagcggcggggtatgccgtgagtttagcgggaccattcctgagttatctgcaaacgcagagtgcggcgcaacgcttccaaatcggtagtaatcaagatgcatttcgcgtgctgtatgatcgtttgtatcaaccagcgtccggcttggcttatgtggtgctcccagacttccggtttgcgggcgagcagcaagatgttcatgcatttgctgaggcgttgactagtgccgatcattatctggcccaggttcaacatgacttgggagccaacgatcttttgatcgtgacggccacacatgctgatgatccgactgttagtgcaacgccaacacgcgagtatttaccgttattagcttattcgccatcgcggccagttgggcacgccttaggcattcggcggacattagcggacgttggtgcaaccgtccttgagaacttcggtttggcaggtcatgctgccggacatagctttttaaatgagattacacaatagaaacttgaacgagccttgaagggaggtgagggggcatcaagattgagatactggcttggggttgcaaaggtcagcgagagacaacggatagtttcatcagatattatttaccgtttaaattcaccatttaccgttggctgtcgttgaaattccaaacaagtagatcgataatcgttcgttcgtaacagaagttatgcgatacataatttctgcagccacatcgtgtcaacttttgtatggcaagtggccatacatcaaagaataatatcggaaagaggtattttgaccaatgctagtcgcagtcaatgttttaggggtaattgtttacctcgcaatcgctttcttattctctaagaataagaagatgatcaactggaaatcaactggaattgtcttagttattaacttgattttggcttggttctttaccagcttctccattggacaagacatcgttaagggtgccgctgatggattcaactggttagtccaagtggcttaccaaggaatcgtgttcgccttaccaaactgggtaaccccagaatttggtgggacggcgaagtccatgaactttattacaagttctcttcttccaatcctgttagttgtgccaatgtttgatatcctgacttacatcggggttctaccttggatcatcaaatgggttggtcgtggcctttccttcgttaccgggcaacctaagtttgaatcattcttctctgttgaaatgatgttcttagggaacacggaagctttggccgtttctcaattacaattgaagagcatgcgtaaggaacgtaacttaacgctggctatgatgtccatgtcatgtatcacggcttcgattttaggggcttatacgcaaatggttcctggtcaattcgttttgacggccgttccaattaacatcttgaacgccatcatcgttaccaacatgctgaacccagtagaagtgacacctgaagaagacacgattgctaaaatcggtggttctagtgccgttgctgctgaagaaggcgaagttgaagacgatggtaagaaagaaccattcttctcattcttgggtgactccatcttgggtgccggccgtttgatcttaatcattgctgccaacgttatcgccttcgttgctttagctgcgttgatcgataagattttggcactcttcaacccatggttatctttggaacacatcttagggatcatcatgttcccatttgcttggttaatgggtctgaacgtccacgacgctttcggctttgcccaatacatggggactaagttagttacgaacgaattcgttgttatgggtaagatttcatctaccattaacaccggtgctttctctgcccactaccgggcaatcttgacggtcttcttgacttcattcgctaacttctcaacaactgggatgattatcggttgtttcaagggtatcgtcgatcgtgaaaacaacgaacttatttctaagaacgttggctacatgctcctttccgggatcctggtttccttgctatcagccggaatcgttggcttgtttgtttggtaaaaataatcgcctcatgttagcatgagactaacggtagcccaggggcgttgttcctgggctatccgtgtcgctagggtatgttaaactagtgattgactgacgggagaaccagtcagtccgtacgggtgccgaccttcctgaacggaagtgaaacccagccgaacgggtgaaagcgtccggttgcaaagcccgtgaagtctgtgtatcgattgatgatacaccgaaagatagggatttttatggataagcaacaatcgcaagtggacttagccaataagttgacgctaagagaagctttgcggcataaggatgtcgtccgcaacgaactgattgctggggtaactggcttcttcgccatctcatacatcattattgttaacccgttgattctgaaagatgcggggattccaactgatttgagtgtatttgcgaccatcttttcttcagtgattgggtgtctgatcatggctttttgggccaatgcaccgatcattctgacgccagggatgggggttaacgccttctttacctacaccattgtggtgaacatgggactcagttggcaagaagcgttgggtattgcagccgtggccagttttgtctatatgctgattgcctttacgaaggtgtcgacaattttatcggaggcaattccagagtcgctgaagagcgggattaccgctgggattgggttgtttttggttgagatcggtctcgaaaaggctggcttaattgtggctggcaagtcgtcactgatcgtcttaggcgatttgaccaaacccactccgttgttggccttgtttggactagtgctcagcttaatcttgtatattcgcaaggttaaagggaacttcttcattgccattattgccaccagtttgttggcatttttccttggcgtgaaggatagtgatacgccgagtgtcgacttagcgcggctgggacagtatcacaagatcgcttttcaaaacgatttttcccatttgctgagtacgccatttattctggcagccttctcgatgactatgattttggtatttgagtcgatgggccttctacaaggcttattgccgaaccaaaagaagtttaagaagacttttgagggcagttcggtgacgaccttcctgtccagtttcttggggaccagtccaacggtagcagcagccgaaagtgcttctggtatcgaaagtggtggccgcacggggattatggcactaaccgccgccgtgttgttcgccttgtcgctgatctttgtgcccctcttggcctacgtgccgtctgctgccattgcacctgtgattgttattacgggggcgttaatgatggcagccatcggtaacatcaagatggccgatttttccgaatggtttccagccttcttgattattgtgctgattccatttaccaatagtatttccactgggttagcctttggttttgtgtgctacccgattatgaaactcgcgttagggaaggggaaagacctgacctggccagtttacttactgggcgtcttgttcctatgtgacttggtctttagtgccatgttataagcggaacttttcgctgggtaaaaacgtaagcggttttaccgcacgttaattcaaaattatttgggaggaaattacaatgacaattaaaattattatggatactgatcctgggattgatgacgcagctgctttgacgatggcgatcaacgatcctaagttagacctgaagttaatcaccacggtggcgggaaacgtgacggttgataagacgaccatcaatgcccaaaagatcgttcggttcttcaatgccgacattcccgtggcagctggtgctgaacaaccccttttcaaagactttgaagatgctgctcggattcatggggcctctggaatgccaggttatgaatttccaacggacttaccacggcctttgaacaagacggctgttgaagctctccatgatgaaatcatggcaagctctgacccagtaacgttggtcccaacgggttcatacaccaacattgccttgctcttctcagaatatccagaagtaaagagtcatattgaccgaatcgttgccatgggtggtgccttgggcaaagggaacatgaccagtgccgctgaatttaacgtcttcactgatccagatgccgctgctattgtgtacaagtctggtgtgccaattgtgatggttggtttggacattacgatgaaggcgctcttgactcacgaaagcatcgaagaattaccaaagattagtgaaacgggtaagatgcttcacgatattatcgtcaatgatggtgataacagtgacgatggcattgcgatgcatgatgtgaacacgatcttctacttgttgcacccagaagccatcaagacggaagatatgtggattgacgttgtcactgacggcccagcaattggggaaacggtcggtgatatccgcggtgcttaccacaatggtaagaccaacgccaaggtttcaacagatattgacgcggtagctttcaacaagtggttccttgaagaagttcgcgcaattaagaactaaatagattgaacaaaaaggccagcaacggcgatgttgctggtctttttgtatgagtaaatctgcgaaaattttacataactaagggtgattctatacgaaaacgatacatttccctgctatgatgaggataaataggggaagaagatgatcacatgtcagtagcagattgggaaaccttaatgttgttagttgtggtctggttaccaatgatttgggtggggcggccacctaagcggcatgggtagccatcaagggggcagtataccgcccacttttatgcgaaaaattgtaaaaaatttacaagatgttgacagagataacatcaataatttacatgaatccgctatgctagaacctaacttagtaatagtcgagaactattgccgggggcgcttccggtgaggggtctcgagtgatgggggcatgggggatgaatcgatttacaattgttcacatatcggacattgatttgacgatggatgataatcagcgattggcgacacagccgttacagcggatttttgacgatcttgaagatcatcaagtagcggccgacttaatcgtacttagtggtgacttactgattggtggtgaccagcaggggtatcggcaattacaccagtatttacaacaacaagaacgccgattacaagtggcgattcaagtgatgctaggtgatcgtgatgatcgggaagcctttaatcggggatatttagcagtcgcacatcagccgtattatgccgataaacaagtgcatcagaacatggatttttatttcttagattctaagtgggaattaaataaatcggctgggtggctggatcgaccacagttggactggttaaataagaatttgcatttagccccgcggcgacgggccttcattttcctgcaccatccactagatgcgccggctctacgcgatatgcgttacaccttgttgcagaacaaccgggaattgttggcgattctacatggacataatattgggggaatctttaccgggcacctgcattttgatgccaattacgtagtggatagcgttgttccggttaccgtaactggatcggcagcaacctatatcaattgtcaagatccgtaccagcacgatgtgtatacaggaaccacttacaatgtgattactattcagcgcgggattgccagtgtcattacccatccgctggccctcgggcagacagtcattcagacgattcccgtcaaccgcactggctttgttaaacatcgcccccgcgctataccagttcgccgaccactgccttaggtaacgggattggcgaccaatctaaaaagaattcagtataggcgatgccccgtcaaccaacgggtatcgctatttttgcgtagttgttattggaataggcgtttcatgtggccctaattttcggtataataggaaacgttagtgcgagcgttcagttgcgtttcgccggtaagtaaggtaaagtatactcaaacgtgaaacaattgtgtttcacagaaacgaactgggagatattgcatgaatccagaagaatttcgggccgcgctcgctgcgcaaggcatcgatttaaccgcaacacaggaacaacaattcgcggattactaccaatttttggtggccacgaatgagcacgttaatttaaccacgatcactgcggagccagacgtctatttgaaacatttttacgactcgttgacccccgctttttacgtctctgcattacgaacagagcctttaacgctctgcgacgttggtgccggtgccggctttccgtcattacccttgaagatcgtctttccccaattacaggtaaccattgtggattccctgaacaagcggattacgttcttaaatgaactggcggcaaagcttaacttgacgggagtggcatttcatcatgcgcgagctgaagaatttggtggcaagcgtgctgctaaccgtgaaggctttgacttagtgacggcgcgggccgtggcgcggatgtcagtgttgagtgagctgtgtcttcccctagttaaggtcgggggccaatttgtcgctttgaaggccgcacagacagaaaatgaattggcggttagccaaaaggccatcacgacattaggtggcaagttgcaagccgatgaggcctttaacctgcctgtttcaaatgatccgcggcatatcgtcgtgattgataaggttaagacaacgccaaagcggtatccacgtaaggcgggtacaccaaataaagaaccattagaagattaatgggatgggggtaagataattgccattttcattatttggaaataatcgggataaggcggcacgacaaccagcacatcctgtgaaacagactgtggtgatgattccaatcgcccagatcattcctaaccgattccaaccccggcaacggtttgacgcaacggcgattacggagctggcccaaaccattcaggaacacgggttgttacaacccattgtgttacgtgaatatgagccggagcattacgaaatcatcgctggtgaacgtcggtttcgagcagtttctagcctgaaatgggaaaccgttccggcaatcgttgaaaaaatgaacgatgacgagacggcttccatggccctgattgaaaacctccaacgcgaggaacttacggccattgaagaagcgcacgcttatcaacaattgatgacgttaaaccagctgacccaatcccaactggcccagggtattggtaagagccaaggctttgtggctaataagttgcggttgttgaagctagcggaaccagtccgaacggcgatcttgaaccgggacatttcagaacggcacggtcgcgccttgctggcactctcgacagaccaacaagaggccatgttgcagacaattgtaacggatcacctaacggttaaagaaaccgaagccttaattgccaaaggtcaccagcaaccaaaacgacggcgtaaagtgacgaagcacagtgtgtctggtgatacgcgggtggccgtgaatacgattcgtcagtcggtgaagatggtgacggacgcgggcatgacgctaacaaccaaagaagaagagacggcggacggttaccgcattatcattgacattcccaaagaaagttagaggtggaacgacatatgggctatatcattgcattggccaatcaaaagggcggcgtgggtaaaaccacgaccggcgtaaatttaggggcagctttggcctccgcgggcaagcgggtcttgctagttgatacggatgcgcaaggaaacgcgactagcggtgtgggtattcaaaaagcaacgatcgaacgggaaatctatgatgttttagtcaacgaaacgccgattaaagaggccattttgcaaacggaacatcctgatttggatatcgtgccagccactatccaactctccggtgcggaaatcgaattgacgccaatgatggcacgggagacgcgcttgaaagcggctctcgatgaggtgcgggatcaatacgattacatattaatcgattgcccaccatcgttgggcctgctgacgatcaacgcgtttaccgcagcagattccattttaattccagtgcaaagtgagtactacgctttggaaggactgacccagttgttgaacacggtcaagttggtccaaaagcacttcaatcgtaacttgaagattgaaggggtcttgctaacgctgtacgatgcccggactaatttggggaagcaagttaacgaagaggttaagaagtatttccaaaacaaggtctatgcgacgatcattccgcgtaacgttcagttagcggaggcgccgagtcatgggatgccgatcattgactatgcgccaaaatctaaaggtgctgaagtttactctgaactcgcaaaggaagtgctagctgcccatggcaaataagaaagagaaaagtttaggacgggggattgacgccctgtttgctgaaaatggggtggataccgccgaagaaaatgtagtggatttgaccttggccgatattcggcccaatccataccaaccccggcagaagtttgatcaaaaggggctgaatgatttggcagcttccattgaaaaaaccggtgttttccagccaataatcgttcggcaaccggataagacgttagaacgctacgaaattttagctggtgaacggcgtttccgggcatctaaattagctggcaagaccacgattccgggcattgttcgtgacattacggaagagcaaatgatggaaatcgccgtcttggaaaacctccaacgggaagatttgaccccattagaagaagccgaggcctatgataccttaatgactaagctgacgttgactcaagcccaagtctctgaacgactgggtaagagtcgtccctacatcgctaattacttgcggttactggggctgcctaaggcggttaaggatatgttgcagcacaacgagttatctatgggacaagcccgaacattgctatccttgaaagataagacgaagctggtggctttggctaaacgtgccgttgagcaaggtatgacggtgcgcgccttagaagctgaggttagcaaattaaacggtgccgcgaagaaattggccaagaaaccggcgaagaaaaagtcgccattcttgcggtcaacggaaaaccaattgcaagaacgctttggcacgcaagtctctatcaacgagagccaaggtaaagaccaacaaggtcgcattgagattgaatatttatccaacgatgatttgaatcggattttggacctattggatatccacttagattaacggacattggaggaaagcatatgtacgatttaggtgatttggttgaaatgaagaagccccacccatgtggtaccaaccgctgggagattacccgaatgggcgcggatattaagattaagtgtaccaactgcggccatgtcgttatgctgtcacgccgtgaatttgagaaaaaattgaaaaaggtgctggttaaggccgacgccaataatggaaagagtgaataattgttatgtcattaactgcaggaatcgttgggctgcctaacgtcggtaagtccacgttatttaacgccatcacgaaggccggcgccgaaatggccaactacccattcgcaacgatcgatccaaatgtgggcatggtcgaagtgcctgataaccggttggatcggattcaagaactgatcccagcgaaaaaagtcgtaccaaccacctttgaatttacggatattgccgggatcgtcaagggggccagcaagggtgaaggactgggtaaccagttcttggaaaacattcgccaagtggacgccatcgttcacgttgtccgggcctttgatgacgacaacattacccacgtctctggtaaaattgatcccatcgatgatattgaaaccattaatttggaacttggcttgtctgacttagaagccgttaacaaacggttggctaaggttgaacgggctgctaaggggagtgacaaggaagctaaggctgaattggccgttttgcaaaagattaagccgattctcgaagccggtggtgccgtgcggacaattgactttgacgaagaagaaatgaagatcgtcaagggcttgttcttactgacatccaagccagtcttgtacgtggctaacattgccgaagacgacatggctgatcccgaagactctaagtactttgggttaatcaaggactatgcggctaaggaaggcgccgaggccattgctgtggccgctgaagctgaagaagaaattgcacagttagatgatgacgagaagcaagacttcttggaagctgaaggcgtcgaagaacccggcttgaaccggctaattcgggcgtcatatcatctcttaggcttacaaacgttcttcacggctggtggtaaggaaacgcgggcgtggacgtttaaaacggggactaaggcccctcaagcggctggtattattcactccgacttcgaacgaggcttcattcgtgccgaagtcatggcctttgcggatttggatcaatttgaatccgaagcagcggtgaaggaagccggtaaactccgagttgaagggaaagactacgtgatggaagacggcgatatcgtcgaattccgattcaacgtttagaagggaattcaagagtaatgagtgataacaagcagacgccacggaatgcgggcgtccaccaaagtcgcaatacagtagcggttaacgagcgggcagctttcgataatgttggactgaccaagcggaacgccgattacatgtatcgctttaacaaggcactagagaagacgaagttgacgccagaaaagaaagccaaggccgtccaagagatggtcgatgaattggttgaaggtcaaaagagcgggaagaccgccaagaacctttatggggatgttgcggatcgcgttcaatttgtcgttgaaggcccgaaagttcaaggaaccggtgtggtctttggcggccccaattattggccgaacatgatctataacgccttgacgttcttcatgattttcaacctgatgtttgggttaatgtatctcttcagtccgaagctgatgacgactagtcaaccagtggggattaccgccattacggtgagtgctttggtagctggatttatcttgccaatcatgccacggctatttgatcctaaagttaagcacaaatacaatggttggattcgcaccgtgttcgtattactgggcttcgtggtctggatggcgctgttctatctagcccagatgttgccaaacgtcatcaacccagtgctgatgccatggccaagcattatcttgggcgtgctatcaattgccgcgatgatgtggattcgccggacctacaaaatccggggcggcttctttggttaattaaacaatactggtggaataccagtgagcgagcgtggtgcttagggcgcccgctcgtttttctttattgagaaaaggggtgtgtcgatgacagtcgtattagtggttgccattatgatttactttattcgagaccagtttgagtatagtccggttcatcggttgacgttcttattggtccccttgtttacgtgttatatgtttatgaaggcctttgtgtggacaccgttaaatggcggcatattggtgttactggtgctctttgctgcatgggtgagtcactatcaggcgaaagctacgcagattcgtgaggaacatcgtcccgtgtcttattttcaagatgcgacgggacatgaggtgcccatctatcgcaaacgcgtgacgagccagggcggacacggttatttacggggctgggtgctcgtgattatcgcacaagtgattattgaggccacgtacctccatgagaccataacaactcataagatttgggaagtggtctgggaagaagttctggctgacctattaacaccttaccgatttgtcacgtctggcgcccataccagttggattttatgggcattgactggcttcacgagtttgggatatacgttatggttatcgcaccagtttcccaaggttcgtcaagcggtgtttggcgctaaggatgattaaaaatctgcttaacgatttataggcctaggtaacttaaacactaatagttcgatgagaaaccttgaccatcgcagtttagactggtaaattaagaaacaatatctcccaggattcctaaccgagcctgagactaactaagaggagcgagatcaactatgtctaattgggacacgaagtttgctaaagaaggattcacttttgatgatgttttactaatacctgccgaaagtcacgttttgccgaatgaagtcgatctgagtacccaattagcgcctaacttaaagttgaacgttccatttttaagtgcctccatggataccgtcacggagacgaagatggccacgacaatggcccgtaacgggggcctcggggtcattcacaagaacatgagtgctgatgatcaggcgaagatggtagctgctgtgaaagctatcgaaaacgatgccagccagtatcctaacgcagcggttgatgccaacaaccacttgttggtggcggcagctgtcggcgtgacatcggacacctttgatcgggccagtgctttattaaatgccggtgcggatgcgattattattgataccgcccatggccattccgccggggtattgcgtaaagttgctgagattcgtcaccagcttccagatgctacattgattgcgggcaacgtggccacgggcgaaggaacacgggccctgtttgaagccggtgttgatgttgtgaaagtgggtatcggtcctggttccatctgtaccacgcgggtagttgccggtgtcggtgtgccgcaattaacagcaatctatgacgctgcccaggtggctcgtgaatttggcaagccgattattgccgatggtgggatgaagtattctggcgatatcgttaaggcgttagctgctggtggtaacgccgtgatgtttgggtcaatgttctccggaacagacgaagcccctggcgacatcatcgaagacggcggcaagaagtacaagacgtaccgtggcatggggagtttggcttccatgtctcatggttcagccgaccgatacttccaaggcggcgttaacgaagccaacaagttggtaccggaaggaatcgaagcccgcgtcgaatacaagggaagcgtcaatgacattatcttccaaatggtcggtggcttgcgttccggaatgggttatacggggagtgccacgattcaagacttgattgataacgcgcagtttgtgcggatttcaaatgccgggttgattgaatctcacccgcatgatgtgcaaattaccaaggctgcacctaattacaaataaagttgttggagccggtttagacttgaccaaaaattagtatccaacagttctgccgtcccgtaactcgcaaagttacagtgggcggctttttatttgtgattgttgatgggggggtcatggctcaacatgaacgatgagatatgacttggcgtgttcccgttaaatagtgtaaaattaaggaatggtaaagtggcttacagccacctaaaggttcgggttttccgaccgcagaccagcgttgatttgttaaactagatttaaacctaccgggaaagaccgctagtgaagttgcctagctggtaaaggagactagcacttatgaaaattttagttgttgatgatgataaagaaattgcccaattgttggaaatttacattaaaaacgaagggtacgaacccattacggcttacaatgggaaagaagccctaaccaagttacacacgacgcctgatattgcactgatgattttagacattatgatgcctgaaatgagtgggattgaagtggtgaaggaagttcgtaaagactcacagattccgattttaattctgtcggcgaagaccggggatatggataagattcaagggttaatcacgggggctgatgactacgtaaccaagccatttaatccacttgaagtgatggcgcgggtgaagtcgttgttacggcgaagccaagatcaagtaacggatgatagtccagacattttggatattgggacgctcacaattaacaaggactcgcatgaggttaagacaattgcggggctgacgatttcgctgacggccttagaatttgggattttgtacttgttggcgagtcaccccaaccgggtcttttccgctgatgagattttcgaacgggtttggcggcaagaaagtattgtgtcggcgaagactgtcatggttcacgtgagtcatttacgggataagattgaagaggccacgaacggcgaaaaggttattcagaccgtttggggcgtgggttacaagatcgaatcacattaagcaacgaggggtagataggagtcaacatggtcaaacgacagcaagcgcaattgaataaatggcagggggcccacatatgaagttaaccacgcgcgaaaagagtgccctatttatggaaggcgtcgtgacggtgattctcttgctgatgatcaatttggctttgttggtaatgatcagccaagccatcgagagtaatcccggtttgcgggacggaatctttattatcaaacgttcagttgtgttcggtcccaatcatttccaactctggagctgggagaatgttttcattagcttcttaggactagctgacatcctggtcgtttggtggcggttgattcggcgctaccggcaaatgcaattacaccacatcattgatgaattgcattatattgccagtggccattttgaccaccgggtgccgtttcgggtgactggcgacgtgcaacgggtagtggattcggtgaacgcactggtagattcagttattcactcgatggatgaagaacgggcgattgagaagtcgaaggacgaattaatcacgaacgtgagtcatgatatccggacgccgttaacctcaattattggctacttagggctgattgaggataagcagtatcattcacaagcggatctcttaaaatacacgcacacagcctttttgaaatctaagcaaatgaaatcattggtggaagacctctttgaatacacgaaggtgcggcagactgatacgccgttgagtctaaccaatattgatctggcagcgatgctggaacagctagcagctagttttgaattagaggctcaaaaaaaggggatgacgattggggctagcagtacgcccagtgtgttgatgatggaagctgaccctgaaaagttagtccggattttcaataatctagtggctaatgccttgaagtacggtgatgggggcaagcaaattaacctgattgccaaacaaattaatgacaatgaactggaagtccgggtcacgaacgatgggcctaaaattcctaaagagtctttatcgatgatttttgaacgattctatcgagttgaagaatctcgttctaaggaaaccggtggaactgggctggggttggcgattgcgcagagtatcgttgcactccatggcggctatatttatgtagaatcggatgatgatttaacgagttttgtgattcatttgccggttaaacatgaccaaccactagccattccacaacgcttaaaaacaaccaattaaatccagcggggaaccgctgattacataagacagaggagttttaacatgaaacgtttgaaacaactaatggtgggcttagtcaccgcgatgacgttgattaccggcggcttcagtacgttaggaaccacggtaacggctcacgccgccagcactaacagcacgacggtgaacttgcaggcaaaagctggaatcgccgttgatgccaagacggggcagattttgtacgataaaaatagtgatcagtcattgccagtggcgtcgatgacgaagctgttatcgatttatctggtcctagatgcgattcatgatggtaaattaaaatgggatcaaaagattacggttaataaggcaacggccaaagtggcccaaaataccaacctgtctaatgtgcccttacgtgccggtcatagctataccgttaagtcgctgtatcaggcgtcattgatttattcagctaatggggcgattgaagcgttaggcacggcggttgcgggttcaccgcacgcgtttgtcaccaagatgcgcgcggaagctaagacgttaggcatgacgaacgctaagatttataatgcctgtggcctgactaataagcaagtgggtaagctgggttacagtaacgttaaaggctcaactgaaaatgaatggtcagcggctgatcaagctaagctggcggtggctttggtgaacaagtaccccgaagttctaaagactaccagcatcaaaaaaatgtggtttgaaaagggcacgtcagacgcgactaagatggaaaactggaattggatgttaaaggggctatcagcttcttacagtaagttacatgttgacgggctaaagaccgggacgtcagacgccgctggtgccaactttacggggacggctaacaataatggcaaccggattatcacggtcgtgttgcatgccgctcacaagtcggatactgacccagctcgtttcaagcaaacgcaaaagatgatgtcttacgtttacaataattttaagacggtgacttataaggctgggagccaaattactggtagtaagacggtgaaaacccatgatgccaagcagttaaccgctaagacggctttggccagtgggatcaagctgtggattcgtgatgaccaagtggccagcaacgttcactcaacgacccaattaaagtcgaagttgaccactaaacaggcgttggaagcacccgttgcgaagaacacccaaatcggaacggcaaatatttctttgaagggtgatcaactagggttcttaggcaatacgaagacgacgaaggtaccactgaaggttacccagtctgttgaaaaagcgaacatctttgtgcgtgcttggcgcgcaatcgtggcgttattctaatttgaaaagcgttaactggtcatcagcccttgaggttggtggctttttaattgtccaacgaaaatcaagtgctgactataaaaataatttcaaggattgtgaacagcttaaacgttgctactaggcaagttagcagcgtattgaacatggttgagggcctgttgtttttttgacaagtcaagcattaatgtgcgaagatacttttattattagccagaacacgcaatttttaagattattttgaggataaagggagttggcatttgtgaatatgattaaaggcgaatggaattacattcggcataatcggttgatcttaatctccgtattagccattatgtttattccgttcctctattgtatcttctttctgaaatcggtgtgggacccgtacggagagactggtaagttgccggtcgcggtggttaaccaagatcaggccgtgacgtatcaggggcaaaaactaaacgttggggatcaaacggtcaccaatttaaagaaaaatcatcagttgggctggcgctttgtttctgctaaaacggcggctgatgggttgaagcaccataagtactatacggtgattacaatcccgaagaacttctctgccaatgcggccacagcgctggatacgcatccgaagaagatgacattttcctacaaaaccaatggttcagctaactacatcgcccaagtaatgagtgaagtgggttcagacaagctgaacagtgaaatccgcgccaaggtgacgaaggcatacgcccaagccacgtttaaacagatttatgcggttggtaaagggatgaacaaggccgctaagggttcggctcagttgaaagacgggacggtcaccttaaccgatggcttgaacacctacacgactggggttcataaactaaataatggattgcagcagatgaagacatctgtgacgccattggcaacgggtattcagaagttgtcgacagggtcagcaacactgcaaggtggactagcgaagtacacagccggggttgaccagtatgctacgggcgttgatacctatacgagtggtgtcagtcaactaagcgctggtatgccgcaattgacagcgggaacctcgcagttggcaagtggggctaagacattaaactctggtgtatatacgtatgttaatggtgtttacacattgaattctggtattcaaaaattgagtaacaaagttggcccattagctagtggtgtgactaagttgtcaactggaagtaaacagctgacgtcggggttgaatgagttgaataataattctagtgcattgaagtctggtgcaactcaattagctggtgggttggatcaaatgcagacgctccttaatagtttggcaccgggactaacaactcttgagaacttaaccagtaattcgtctaaactttcggctatacaaagcctattaacaacactttctaacagtggtgccctagatagcagtaatattgagtctatttcagcagatatcaagcagatgcagacagttcaggcggctttagtaaacggtcaaagtacgctaggtacaacagctgaatctgttaaaaaggacttggtggctattcagtcacaaaaggctgccggggcaagtacaactacaacaagttctagtaccagtacgactggtgtgagtgctactcaggctgccgctgctgctgcaagtagtaatgctgcggcattgagttcagcagtcgctgcaggagacagtagtgttgcaaacagactggctggaacagtcgcacaagagactcagacgaccgtcagcaaagcaagtacgattaaatctagtagtacctctacagatacgataaatacggctggtagttcagatgcaaccacagcactggtatctgatgtcaccacgttacttacggagttgtcgagtctacagagtggtcttaataccttacaatcggctgctagtgatttgaatacgcatacggctactttgcaaagcctagcaacactgttaccatcatctggactttcaagttcagatttgactcagttgtcatcagccattacgactttacaaaacagtagttcggccattgccaagctaggtagttcgtcaagtgacatttctaaattagtaaatggcgctggccagttaagtacgggattggacacctatactgctggtgtttctagtgcactaggtggttccaaaaagttaacaacgggtttaacaacattaagtcaaagtgtaccaacactgacgactggtgttatgcagttagctagtggttctgaaaagctagctaaaaatggtgctactctgaagagtggttctagtcagctagcttcgggtgcaacaaccttaaattcggggattcaaacggccgcagctggtgttaacaaattaaacgccaatacgccgaagttaactgctgctggtaacaagttgatgagttcttccaatcaactgaaccaaggggcagcacaactcagttctggtttaaccactttgaacagcaaagttccgacgttaacaagtggggttaaccagttggctgctgggtcacaacagcttgatgataatagtgacaaactcatggctggcgctaacaagctccaaaaggggaacggcactctcgccaagtccttgaagagtggggcggacgaaattaatgcgcaaccattgaccagcaagacggctgatatgtttgctgcgccaactaatttgaagcacgaaagctatagttatgtaccaaattacgggcatgccttagcaccatatgtgctgtctgtggcgctttatgtgggggcgttggtcttcaactttgccttcccaatccgaaaagtctccatggctggcggctctgctactggttggtatttgagtaaagtttccattggtgcggcggaagccttagccatggggctgatcgaaccagccttaatgatgttgggtggtttgagtgtcgatcatccaggatccatgttcctggtatcggtcatgtttgccgaggcgtcgatgttcattgtcatgttcctgtcgatgctactggataaccctggtcgattcattgccatggttctcttgatgctccaactcggtggttccggtgggaccttcccaatggaagtcaccaaccacttctataacgtggttcacccattcctaccaatgacttactcaatcctcggattccggcaagccattacttctgggatgagtggcatggttgggcaggccttctggatgctactgctcttcacggtcattggtttagccttactttggccaacgatgatctggctgcagaagaaacatttgatgggcttatcacaacttgatgataaccaaaaattgcaagcggtagaggacccagagtctaattcccattcataaacagttaaaataaatcccgtctcatcacaattctatgtggtgagacgggatttttaattgtataagtagctatttcttcaagaccaatgttttattggcagtaatgtaagttccattggttaaaatcaggcgagtagtgatgccgtgttgcttaatagccttaattttaagaacgattcctttgcgatagtgccgcaccttgctggtgagattaactttgcggtaagcgttgattcctttgtcactgataaccataatctttttgggattcgtttgataatacgtattaacaacatagttggtgttggccgtaatgtagcctgtctgtccggaagtggttttcactttgtagcgaagagtgcccgcttttgttcgcgcgtagccgatgacagtgaatgtaggccgttttgtacgcggttgtttttggtaccaacgaatacgattatttttagtgaagttaacggttttgtataaaccgatcttacgagtagcgtagactgagattttgcttacagatactttagtagctgttgaatcgctgatgctatcggtggtactagtagtggaagaactggtggcagaatttacattgctggatgcgggactactagactctgagctactagaatcagtagcactatctgcatcaaaacgatatgtaatggttgggttgccttccgtatcagttgtcagtgtggctttattgaaagtgtagcccttaacagttggtgtggcctcaagcagtgccgcttcgatagtttgagcataattggttgtctacacgccatcattatcgtcaggaacactaaggaacatgccagtgtcaatagatttattattgtcgtctacaaaattaattgtgagggacttggttgcatacggagtggtgtatagtgccttaaaattcttcacgtcggatattttgaagtaaacgttcgcagcggattccatgaagtaggcttctttttgggccaaattgattctaagttcgcgtaagagaccgctgaatggtgagtctttggtagcgattttgttaccgtcagcgtcatagtagtcataagtcccggagtcaaaactagttactataaacgaacttgatggatatttgatccaagcaatgtcaccactatcaacgccgtaagtagttccatcactggtagttgttgaactggaagaatcgctgctggtagtagttgtagcggcactagtcgttggtgtgctggtatctgcgtggctggtaagggctggtaagggggtagcttaatgctaaaccagtcagcaaagtcgtgctaagcagtaagacagtattaaaatattttctacgcatgtaggcattcattcctttgaagtttgacttagctctagcataaatcgcgaaacttatactaactttatccattaactattacattctttaatgcatgcattagcacatgacataatacaatcattataggttaatactattccgaaaagaaggtctcgatcgagtatttacggaagtttacctgacaaattggtgaatgaaaggggaattggttgcattttggtggcaagtttactagactaaaaatagttgcacacaacctttttttgcgaaccaagtcaaggaggaatctgaatgtcagtggaaaattacgattacgatgtcttgtatctcggaagtggccatggaacgtttgacggtgcaattccattagcggccaaaggggttaaggttgcggtggttgaaggtggccttatcggcggaacctgccccaatcggggatgtaacgccaagattaccttagatgcgcccgttgccttacaacgacaattggcggcgttgaatccagttattactggagacacgacgatcaattggtcagctaatatggcgcacaaacacgaggtcattgatggcttgccagattttattggtggccttctaaaggacaatggtgttgaggtgatcacgggttatggtaagttaaccgcggctcacagcgttcaagtgggagatcagacctatacggctgataaaattgtgttagcgacgggcttacattctcaccggttggccattccgggtagtgaattagcccacgatagtgaagatttcttgaatttgaccagcctaccggcccggatgaccgtgattggtggcgggtacatcgccttagaactagccactatcgccaatgcggctggtagtgacgtgaccatcttattgcgggggcaacaagccttacgtcaattccaccagccattcgttgaaacggtgctcagtgatttaactgaccggggagtccagatcctgagagaaacgcaagtcacggcgttaaagcaggctgataacgcgctacaggtcatcacggacacgcaggggacactggtgaccgattgggttttggacgccactggccgggacccgaacacccaaaacctcggcctagaagatgtaggggtcgcctacaccgatcatgggattaccgtaaatgaccatctacaaaccagcgtccctaatatttatgcttccggagacgtgattgacaaggaacaaccaaaattaacaccaactgccatttttgaatcgatgtatctcagtcagactttcgcgggcgagacgaccgagcccatcgactatccggcgattccaacggtggtcttcacttcgccacgcttggcgcaggtcggggtgagtgtcgctcaagcccaaaaggatggtgctacggttgaaaccaaccatgtgccagacgattggtaccgacaggtgggtaaagaaagtcagggtgacaatgccttgatttttgatgccgaacatcatttgattggtgcgactgaagtgagtgaacaagcagcggacgtgattaatacgttgttgccagccattgagtttcagtatggtccggctgaaattggtcggttagtacacctcttcccaacaatcggtgcctcagcgtggggccaattatagacagacaatcgggattgtgaccttggtcacggtccctttttttttcgtataatgaagggcattatcagaaagagggaatggccatgccagcaatatttcgattgatcacagctgccgatgaggcccaagtcgtcgccatttataaccaagcaattgcgactaaggggagtacggcagatttaacaccattaaccgtggcccagcgtcaaccatggtttcaggagttttcaccggaccattttccattgtgggtgattgaaaccacggcaggcattgtggggtacgtcgggttagaaccctacagcgaccggcaagcttatgcgcaaacggccgaaattgccatctacttatcggctgatgcccaaggacagcatttgggaacgcaagcactcaactgggttgagtcacaggcaccagcactgaaggtgactacgattatttcccgaatttttgggcataatcaagccagtcggcacctctttgaaaagtttggctatgaacattggggacatcttccggcaatcgctgatatgcagggattcgtcgcggatttggaagtttacggcaagcatctgtcatgaaaatccgctgtacattttcacaagcctttaattaaaacagataaaatcgcggttttcctttgctaaatatcgcatctgttgtatgaaaatggcatgaaacatgttaaaatatcatcgtgtggttttatcgctaacggataaacctgttaacttgcttcatatctcagagtattcaacggaggcaaacattcttgaataaacgacggccaaaccccaagcaagtgcctgacccggatgaaccgttatggcggtcgacactgcgggtagccatgccccttaacttgagttacattccgattgggctggcttgtgggattttgctacacgcggcagggttcaataccttattgacgggactcgtctcacttttgattttttctggtggggctcaattcctgattgccacgatgttaaccattaattccccactactttcaattgtcttgatgttgttctttttggaattacggtatgcattattgagttcgagtttatcaccgtacttaaagggtcagtcgaatcgctttttatttattttcgccatttcgctaaatgatgaaaactatgcgatcaactacttaaagttcgcgacggataagaaatggaccggtaaggaagccttaatggtggaacactattccttgctgttctgggcggtcagcaatgttatcggtagtttgatcggtagcgcgttaaagattgacctcagcatcgttaatttcgcattgacggcgttattcttatacatgattgtgatgcagatcaagaatcgcttgacgattgtgatctgtttgatttcgggtgtgctggcggcagtctgcatgatggccaccaagagtaccctaggattggttatttcaacactgattgcttcgttgattggctttttgcttgagtcaacgttacgtaaaaagttaccggatagccattggctgtggaaacttcgaagcccgggggcgaaaaagtcagcagttgaaaattcgaatgaataggacacaggagacgctatatgagtacagttaatacgtggaccagtatgcaacatttttggttaatcatcctgggcttcttcgtggcttttattccacgatttttacccctaatgctgtttaccaaacgcgcaattccggaatggttcaatgaatggatgaaatacgtgccggtatcactatttacggcgctagtggtcaaagatatctttattgatagtgccacttaccaattggtattcggtcatatcgcggaaatgttggcggcggtgattgtagtggtgattgcctaccgaacccgttcaatggcgatctcagtcattgtgggattgatcgcggtttttctgctgtcactggttgttgcgtgaatttaattaagtaaatgaagttaggccgttgtgaaacggccttttttaatcccactagaaaaaatcgctatccatcggtgatcaatccgataggtagcggtttttctgtgaggccatccgcggtggcccacacgtattgagttgattacctaagcatgaacatgggtatcgtcatacatatatgcccgtgtcattggtaacatccgggctgaagggccctttgaaatcaaatactgaatcacgtcaatattaccagacttgaaggaagcagcgcaagcctgtaaataaagatcccacatccgaacgaagcgttcgtcaaacatctcagtcacttcggcgcggtgttcgttgaaattcttatcccagatttcgaccgtcttctggtagtggcggcgcagcggttccatatcatcgatctgcaaaccgttctcaatgatatgggtggtgttttccactaaaccgggcacatagccaccagggaagatccatttgtttagccaaccattattggcaccgccttgttgccgggtaatcccatggatcaaagcaacaccgtcatccttcaggtacttctgaacgcagttgaagtattggcccagattttcttgaccaacgtgttcgaacataccgacagaggtgatgtagtcccattgttctttacccagttcccggtagtcttctagccgaacttcggctacgtcttctaacccatcttctttgatgcgggcgttgacgtagtcgtattgttcttgactcaaggtaatcccggtaacgtgcaggccataatccttggctgccgtcagcatcaaagttccccaaccacagccaatgtccagtaaggttttgccaggttgtgggtcgagcttcttgatgatgtggtgaactttgttcatttgtgccgtgtagaggtcatcttctggcgtttcaaagtaggcacaggaataagtcatggtatcgtctaaccagagcttgtagaagttattaccgatgtcgtagtggttctgaacatcggctttactttccttttcagtgtgcttttgtttaggcaggacattgatgaatttcttgttatggaagaaactctcggcattttcgtaggccgcggttaagaggtcttcgatactaccgtcaatttcaatggtgccatccatgatggcttctcctaacgcaattgaggcgttacgagatatttccttgaccggaatggcctcgtgaatagtaatggtgatgtcaggagtgccagtcccatagacatcggtggtgccgtcccagtagttaacgcggacgggaatgttgaaagtgtgactcagaaacgttttgtagaatgttttttcaagcatgtcaggggtcctttccggtttttcttaaataagatttcaagaaaacaaaatttactacgccattatacgcctttcatcgggtaataggtaagggggaacgctcaatgtaaccgcttaagtttaaaacgtcggtatttctcccagcaaaagcacaggaatccatcactaggcatggtataataaaggtataatttaccagcggaggtcttcattttgaaaaaatgggtatgggtcgtggcgacaatcgttgtggcactgctgattggtggttacgcgtattcaaatcatcacgcaacagccaaagagtaccaagcggcaatggctaacgggcgtactgccattcaaagtaaacattatacacaagccgaaagttacttccagaatgctttaaagcggcggttaaatgatgcgcctgctcaacggtacctgacgcaaacgcagcgattcgtttcggcggaaaacgctttggatgatctgcattttgccagtgcacaaaagcattatcaaacagtcaaagataccaagaatggatcgcaagtcttaactaagcgggcgcaggatcggttaaagcaagttaagacgattcggggtaacgttaaacaatttaagaagctattaaccaaggcgcaaggccaaaatgaagctctgaattatgggcaatcaaatacaatcttggatgagctctttaataatagtaaattccggcaacgttactacaagaacttatacagtcaagcgttggctttacgtaaggcgaacaatgctggtcagacggcctcattggctagcagtgcaagtagtacggccgcagcgtcctcaagtgagagtagcgctacgagcagtagtaccgccacaagcagttctagtgcgtcattgacgtcatcagaacaggcggcggcaaagaattactcgggaagtaacgagtatacggtaacaaagaagcaaaaggaactgaacggcaagaccatcacggcggatcaaatcgctagtgcccggaagaccattaatgcggcaggagttcaagcagacgcaatgagtgatcaagacgtgcgagttgctttgcaacaggcgaataagaaggatatgtcgttatcggcatacgccaaacaatatctgcaataaaccggaagattcgagagtgatactcgaatcttttttgtttgtcagcaggtgagtcagcccaataaccttaccttttctaacgggttagttataaaaattaacatgtaagggaggtcaataaactaatcgtaaaagaaaaacatcagctaaataactgatggtattaggtaattgtgggtgcttaaacccggtattataacctttttctttcaaaaaattgaatattgttacgaaaaataagcaagtcattattcatgcgaaattggtaaggacgttttactatataagtagaatcagaatctacaaagggggttaggtgacacagccctcgaaatagcgggtgagccaatcttgggggatggggcgacctaaactgatttgattcccaaatcaccagaagctattgggggagctatgttaccaagaaaattatgattatcaacaaacacattatgcgcaccaccaatgagaaacaggttttgcagcagattgtgaatgcgggtccgatttctcgaagtcagatctcacgaaatctctgtttgaataaggtcacagtgtctgatatttatagtcaattactccatgaagggttgatccgtgaggttggtcacggtgttagcacgcggaatggtgggcgaaagccggtgatggcattactgaacgtggggtatggttatgtcatcagtattaatattcttcggtcacgcttctcgatgattacctgtagattggacgggcggtcggataattatgaaagcgtctcaacccgggatgtcgatttgacgacggttctggatatgattgatgaacgaattgccaatacgattgctgcaagtgattcacgattattgggaattgctttcggactggatggcgtcatctacgagaatcaaattctaagtgcggctttaaagggctttaagagttttgatttagcgaaatattttagtgataaatttcaagtacccgtagttttagagaacttagccaatgaatccgccatttatgaacgtgattttgcgggtgaaggcgtttatcaggatctgatttcagtcacgattcgcgatcaagtggccgctggaattgtggccgatgggcatctctatcggggccataacggtgaagcggggaatattggaacttgtcctctagccgatcgctaccatgaaggcagttcatcaacagtgaatcactttgtcgccgaaggtccggtattacaaaggattatggcttatcagcatatcgaccgggtggatgtgaaccggattcggcgtgattatctggggcaccgaccagaattgatcgccattttggacgagtttgcttactatttggggaaggtcttgggcgatttgtcgaacacctttgctccggatgcaatcgtagtaaacgcaccgattctagaattgttgccagagattatggatcaggtccgagggcacgttgatcgcttatcaattcgccgcaaagcaccattgctattgagtaagaatgcgaaggaagcgtctttaacgggtggtgcctcggcaattattcataaggcattgggcttagatgatttgcaactaacttttaaaaatgagcgttcggcggtgcttgaagaagtggaatcgtaatgaacgcgtaaaattgggaactgggcccacgcccggttcctttttagtatttccggcaaaactactagggaatcattaaagttaaggtataatgaacctaacaagtgagatagggggaggttcaccagtgagtttatggcaacgctttgttgaaaacgttcagcttcggcggtttacggtgctagcactaattatttttgtgctctggctgattcgcgcggaaatgaatatgattctgttgacgttcatcttcacatttctcgtattgcagttggtcaaagcggttcggcgagtcgtcaagctaccaccggctttgattgtgacggtcacgtatgtggtaattataggactattgtattgggcggtgaccacgtatctaccgcagatattaacctcatccattcacggaattgaaaacttatataagttctatcaagatccgaagaataatagtaacgagattattagttatgtaacgaattacatcaagacgtcagatatcgttaatcagttgcaaaatggggctaagctcgtgctgacgtacgtctcgacgattggatcgtttggggtcacgctatttatgtcgatgattctgagtttcttctttacgattgaaagtaagcagatggcggccttttccaagcgcttcctaaccagtatgtatggctggttcttcgaagacattaacttctttgcgacgaagtttgtgaatacttttggtgtcgtgttggaagcacagttcttcattgcactgtgtaatacggtgattaccacgattgtgttagcaatcatgcagatgccccagttgccgacgttggccattatgattttcattttgagcctgattccggtggccggtgtgatcgtctcgataatcccactagctattttaggatattcagtgggcggcttccgctacattgtttatattctagtgatgattgtggtggtccacgcactggaagcctatgtgttaaatccaaagttcatgtcaagtcggacagagttgccaattttctatacgttcgttgtgctattggcaggtgagcaactctttggcgtctgggggctgattgtgggggttccgatcttcacgttcttcctggatatcttaggggtacgaccggttcatggcttgcaccccacaccgcacgtggatgtcaagaaaatccgcgagtatcggcgaaaccatcatccagaagatcaggatgatgaatagggctgaaacctaggaagacggtgtcaagtcgtttaggtgacgatgaaccagtcgaaataaacaattgagacccaatttaaagagggcttcgcgagggattgctatccttgcgaagcccttttagtcatttaatagggtaagtaaaagtagcaatgccgcaactgatgcaactctttagagactaatctaattagttagaaggagacatcactctaactggtgacggttgattagtttgaaagcctcctgatggcggtgagggcgtaaaatacgggcgaagaaaaagttgttgtgtcattcagggaaggtgtagtgaggtgagaatagatgaggagttgttcattggctgtgtgaggaggagagttcaatgcggaaattaatctatgccatcctcattgggatagcggcgctactcgttggtgttgggctgacacatccagtggtgggacatgccgcggaagtgccagttacgggactatctgcgggggatgccgttatcaaggatgctaatggtaaagttgtgacgggacaggggccgtttgatcgttatcagagctatagtgtgaattatgactggcaaattccggacggggttaagctagcggggaatacgtcaaccgtttcggttccagcggggttggaacccaatgcagatatttcgtttgatattacggattcaaccggaacagtcgtgggtcattttagtattaaggcgggatcgtctaccgggatggttacctacaatgaaaatgcggattccgctgtgaaccggcacggaagcctatcgtttcatgcgagtgggaccagtgacaacaataatcaggggaatgggtggacggttaataaaattgggtggatttcaggaatggaaccacagggtgcgcccaacgagttgacttggaacgttgcctttaactcggccagtgccaatatcggcactgtaacaattactgatacgctaggaccgggccaaacctatgtgccggggagcgtttatgctcccacgggatcttatgatgctaagggaaactttattccagatagtggaacgctgacaccaacagtcagtgtcaatgggtctgagattacctttactttcagtaacgtgactaaagcagtcgatatgacgtacaagacgaaaccaacactgacgaataacgaaggtaaatggacgaatacggccagtgcatccaacggtgggtcagtctctgcgaccgtgacctggggtggtagtggtactggaaccggtgaagaacctagtgaggtgactttgaccaaaacggcgagtgatggaaccaagttgcccgatgctatttataagttggaagatagtttggggcaggtgatgttttctgcgttgaagacggatgagaacggtcaaattaatctgcatatgctgacgccaggcgattacactttgacggaagtgaccgcaccagatggctatgaacttaatacaacaccgattaagtttacggttgtggctggtcaaaagccaattcagttaaatgctgttgacccgaagacaacgccaacggtaccaacgctggacaagggaagtttgctcattaaaaagactggcatgaatggtgttgctttaccgggagcggtcttcacactgaaggcggctagcggtgaagttatcaaagagggactggaaacagatgccaatggtgaaattttgctaccggatttggtggcaggaacgtatacgttgattgaaaccaaggcaccagaagggtatatggtcaactcggcaccaattaccgttgaaattccagcggatgggcatgaggtggtcgtgccaattaaggatcagcaggtaacgggcggttccgagacgccgacaccgaacccacaagaaccacaggtgccgggcgtaacgccaccaacgaaaccaatcgagccaactactccgggcgtgacaccaccaacaaagccaggtgtgacgccgccaacgaaaccgacgaagccaaccacaccgggtgtgacagtaccaacgaaaccaattaagccaataaaaccgggtgtgacgccagtgactaagccgaccacgccaccgactactgggactattaaaccaggtgtaacggggtcaacgtctactgggaccacaacgcctggtggcatgggaactgatagtcgcagcaatgctcgttcggttggacatgctggtggcagtggcatagttggacaagcgcggaacgctaatgggacagccggtatgggggcacacggtcagacaatgacccggttgccacaaaccaatgagcagacatcgccatgggcggcagtgatcggcctggtagtcttgttgggagtaggcctgtttggtcgagtatatcggcatcaagattaaagaaaacgcgcgactggcaacggtcgagcatttttgtaagctcaaagattgtgaaaatagggaatatagctgaaatttagcggcagatggtgtaaaataatatggataatatgagaaaagaaagaggtcataactgatggcaaaattagtactgattcgccacggccaaagtgaatggaacttggaaaacaagttcactggctgggttgacgttgatttgagcgaaaagggtgtcgaagaagcaaaggcagccggtaacaagatcaaggaatctggtttgaagttcgactacgcctacacttcagtattgaagcgggcaatcaagacgttacactacgttttggaagaatctgaccaactttggattccagaaaccaagacttggcgcttgaacgaacgtcactacggtgctttgcaaggcttgaacaaggctgaaacggctgaaaagtacggtgacgaccaagtgcacatctggcgtcggtcatacgacgttttaccaccacttttggacgctgacgctgaaggctcagctgtaaaggaccctcgttacgccaacttggaccctaacatcgtacctggtggcgaaaacttgaaggttactttggaacgggttatgcctttctgggaagacgaaattgctcctaagttgcttgatggcaagaacgtcatcatcgctgcccacggtaactcactccgggcactttccaagtacatcgaacggatctctgatgacgatatcatggatcttgaaatggcaactggtgaaccagtggtctacgacttcgatgacaagttaaacatgacgaacaagacgaagatgggtaagtaattacctggctttagatgagccgctctgtatgtgggggcggctttttcgtggggaaaaatcggcgtacagtgaaggacggttaatcgggatgagcaatgattgttatttaagaccctatgcaccgactgattttccggctgtgcggcggttatttaagacaaccgttgagcgcattaattgtcgggattactcggcagaacaactggccgtctggattggtgatgacagtccgctaacgcagcaacgctggcaggagagtttgtgccaacatcagactttggtggcaatcaaggatgatcaagtagtgggatttgcagatatgagtgataccggatatttggatcgcttgtatgtgcacgctgcgtaccagcgccagggcattgcgacagcgctggtaaccgcgctggaagaacagatggtgacacctaggtatacgacgtatgcgtcaatcacggctaaaccattttttatgcagatgggttaccacgtggttcgtaaaaatacggttgtccgggctggtatcgatttgataaactttgaaatggtaaaaataaattcggaagagaagagagagtaaattttggcagacaaagacgttacgcaagtagaaatgatgaagattattgccttgttccgcaaagaaggctacaagggagaatacgaggatttccagcgggtcagtggaactgatcgggagttttttgtggtgatgagtaacgaacaaggtattaaggcattgttccgggcaagtttgatgttgaacgctgtgcagttccagtatgtgctcgatgataagcatacctttgtgcaagaggacgcggatgccggataattcagaactactggcgttgattaagaaacgggtttgctatacagatttggtttatcagcgcgttaatacgaagttaaaggtagatttgtcacgggctgagatcgagacgttggtacaagctatcttgggtgacgagcaaacgatgcttgaaaagcgggggaagaattactacgtcaccagcttagctcgccacacaagattgacgataaattcgtttaattttcggctgattacggcggatcgtatctgatgatttagaactaaaagaggtaacctagctaatcagctggattacctcttttagttcggcataaaaaattcagatcgaccgtttaaactgcgactgtaagcgccgggctgcaataaccgctccgactaacagcaacaagcagactagaaagccggcttcaataccgatgtggccgttacctgggaaggtgcgattaaccaatgcgactactgcgatgataatggccgttccaaatgaggccgcaacttgtcgaattgtattgaaggttgcgacaccatctggcaccatttcgtaaggtagtaggcccagtgcgtgagtctgcaatggaattaacatggtgaccaagcctagctgtcggacagcctggaaaatagccaagatgacgggtgaactactcgtaccaatcaatgcttgaagtagcgttccagcacagtcgatacttaagccaatggcaacgagccgtttgactgaaattcggtcgtacaatcgaccgctcaaccgggatagcgttcccgtcaacagagcaccagggagaatcaccaaccccgaaaccaaggcactacggtgctgaatcgtctgaatcaacaagggcaacagaatggtattgccatacatggtcgccacgattagcatgttaaccagtgtcgccgtgacgaattgtccatggttgaacacgtgtaaattaattagcgggtcagcgtggcctaattgtgatttaacaaaaatcagactaaacccaaccccaatcaataataacccaccgacttgccaactcagaaaactagcggttgaaatgttagataaccccatcaaaatacaccaaagaccgacgctgaccagtacgaagccgcgggaatcgaaatgcggtgattcgttgtgaggaatttttggcaggataattagagaagcaactaaggtaatgaggatgaacgggatgataataatgaagagataacgccaagataggtagtctaggataaccccagagacggttgggccgataatgggggaaaagttaaaggccaggccaatgatccccataatggtgccttttttagcaggctcggcgtagcgaatggccagcacgttgactagcggcatcatcatgccggctcccaccgcctgaatcatgcgcgccacgatgaccaagatgaaagcgtggcacagggcgcctaataacgtcccagccaggaaaataagggtcgctaatatgtaaagattgcggaacaagaagcgtttaatcaggtaggcactcaccggaatcatcagcgcgttgaccagcatgtagccgttggtcacccactgaacctgggcctccgagatatgaaaggcggtcattagctggggcaatcccgtattcatcagggtcgaacacagaatgccgaagaatgtcccaaataccataactattagggagcgagagatgcgtttattcgtcattgaccaaagtcctttctaaatagttgaaacaagcaactattttaccgtatcatacgggcagattttgtcaacttggatttgggctatctgtgtactttggaagccaggaaaattataaatgggagtattgacgatttatgatagtcaaccggtattttagtcgacggatgagtttaagtacagatcatgagtttagtagcatggcaatttgccagtttactaaataatcagattaaagtggtatgtaaaaagggcgtaaccgcagtttggttacgtccttatgtgctatttagcagacgttaaatagtttgcttgaagttgttttaattgcgtgttggagagatctaaccccttgtgtaagaaattatccatgttgccgtatttggcatcaatagctttgtacatcgtgttcaggtaagccatcttaacggcattttgtgccttaaagttttcgacgacaattggggtaacttctttaccttgggccttccagccagcttccatcttctgcaggttttccttatttgtttgggctaagtacgtgttggactttaagtaatcttgagcaatcgcttttttgtcaaacttgagggcggacataactaaggcagttcccataccggcccgatccttaccagctgagcagtgccataggacggccttgcctttaggattaatcaaaagttggtggaatagtgacttgtaggcttttcggccttgagccgtggttacggcgtcgtggtaggatttttccatcatcttagcgccagcgccctttttagaaaagtctgggaaggcaccgaaagatttaaaaacattggctttaacgagtttgacgccggccatatgcacgtcaggactcattttttgttcagtagtggttcgtaagtcaacatcggtagcaacgtggtaggtcttcactaatttcgtttgatctgccttggtcaagtgtgacaggctatttgcacgaatgaggcgatgggctttaatcttttgaccgtgccggttgacataaccgccgagatcgcgggcattgctagccccttgtaacttaatgtgagtggatgttgacttaatggctttagccttagccgctttggtcttggctgccccagtggtcttgaccgtcttagtcgttttagcgtgcgtagctgccgagacgttcatcaggggttgttgccatcccaatgtggttgctaataatagagccgttactaaagtgcttgtgcgtttgttcatatcacaatctcctcctctgatttggtacatacttagaatactaagttgatgtaaaaggatgatgttgattgtgtaaaaatctgatattgtgggacaactaaatagaaatatatttgtaaatagtggttgtagttggtttaaacactattggtactggacaacttgttggggttaaatgcgttggttaatcgttcttgccaatctgtttgatccagttccaggtatcttttgtaagttatctattagtcgtataatcaggacaataactggaggtgtcggcgatgaagcaagcgttggtgatgttgtatccagatttctgttattttgaagtggcggctttaactgaaattttggcgtttaaagaagatgagtggatcgtcacaacagtggggacggatcggcagaattatttgggtgaagatgggttacaggtcctagctgaaaagtccttttctcaggttgatctgctagccgttgatttactgattttgccggggattgacaattatcacgtaccgttagctgattcgcggaatgttgcctttctacgccaactaaatgcgaccagtcgaccaattattgcggccatgtccagctcaccagtgttgttggccaaggccgggttattagatcaaacccaatttaccggtggtctctttgaggagacttatacgaaaaacccgtttatcccgaagcagaatttagtgcggcaaccggtggtggtggataatggcatcattacgtcgagtttccaattctttcgggaatttgcgattgcagcggcccgggcttgtgggatccaggtaggcgatacggcgtttagtcccgcccgaacagatcgcccctatacaccggcagagttaacctatcattatccggattaaaaaactggctagtcccaactatgtgggattagccagttttaagtcgggttaatctggttgtttaatccacccagcagtcccggttgtgattagcacttcgacacgatctagcaacattaataaccaaccgaaggaaataacaaaaccaatcatttcaaaggcagttaaggaaaaatagccaaacacttgaaataagagcgcggcgaccactagcgcaattccgaccccgtctgacaacagcaagaagtctcgtgtaatttggggcagtagccaccgaacaccaacgattagagcgatgattaagtatactaaaaagacggcaaaatggtcatgaagagcgtgtgaattggcattgttgggaaaaacgcccactaatcctaaatcaacagcagttagcgtcaataagccacgtagcacccataatcgacgggagcgaggaaacgattcttgcagactaacaaacagatagtcgatgagggcaatcatcagcaatgctgaaaaaatcagcgtggcgttaaattgccaaccgccactggaagcaccagtggtgccaagaaagctaagattgtgttgccaccaatatttttgattgttaaccgccatcgcgatgacgacaccgctaatgattacgagggtgaggacggtcgataagacactggcgtcgatcattaaggcgaagtaactcatagctgtgttggtgacactgctaaacgcaaataagataatactggcggttgctaatccaaagctggcgccgttaaacagcatcccaagtagccacatgcttccggtcaagattagaccaagaatcagggtgaatgataagacaatgacggggaagttacgccagtagatatttttagtaaaatgattctgcggattatggcggtcatggataaaaaatccagcgaataaaatagttcccatgattaccccgagaataataatggcggtggctaaggaataattacctacgagttttagggtatgtagtccttggtgaatgccataaccgtaaaacagcagactgactatcagggccgtggcgaggggccacaggagtgattggtgctgaaaaaattggcgtcgtggttcctctagctggacgacgagtcgatctcgtttgacgaccagtctaactggtgtgtctttatttaattgtagttgttcactaatatcagccgggatatttaactgaaaatctttttgtgccataatgccctccaaatcaagctattacaatgactttcattatagcaaattttgagcagggtgattgtgaaaagcaggggatgctagtggtatctttggataacggcgatcgcacaagcgggctggtggtgtatgatgaacatggaaagtaggtggcatgaaaccatgcgtaaggggatttatggattaacggggatctgttgggtagcggttgtggtgataattgttgtggcagtacagcaacatcacttattacaattagcgccgatttatgcttataatcgaccgcagggattgctgggatggaccttagccagtgcgattgtgctgtcgataacaagtgggctcatgcatcgtgaggccaagcagcagtcacggtaaaaatatcggtgtaatcaaaaagcttcggcccaagatggctgaagctttttgattacattagatagtcttaatctgtacaaagccgccgaatagcttcggcataaatatccatcgctttatacatgcgactgagttcccaattttcattgacctgatgcatgaagtcgggagttcccgggagcatcgcgccaaaggcaacacagttgtgcatcgtgcgagcaaaggtggcaccacctgaaatttggggttgggtatcgtcgccagtcaggtcgtggtaggtactcatcaagacacaatgttgcattttcaacaaaaaccattatgatagaggcaaggtcttgatttggtcaaagatgaaagggtgttgaatgcatgacaatgaagcaggtcgtaattgataagaacttttggacaacttttccggatgcacagattaacttgatgtggattagtgattttgataatcatgatacggatgaaaataaggcagagcgacaacaattgttgcacgatgccacagtggcttctaaacaatttacaaagattgacccattccgcgataatcccgtggtggcagaatggcggaatgcctatcaacagtttaagaagcggaagggtgcccgttcatcaatcgaggcattattaaaacgagctagtcaaggtcatgagtttatcccgatcgaaccactagtggacgtctataatagtatctccttacgctatggggttccgttgggcatcgaagatcgtgataagattgcgggggatttacatttaggcctggcccaaggcggtgaatcatttttccctttgggggctgaagctgatgaccctgctcgtgaaggtgaaatgatctattatgatgacgaaagtgccgtttgccgaagcttgaattggcgggaggcgcaacgaacgatgctgacagaagaaacaaccaacggtattgtggtgatggagtcaatgaatgctgatcaagcagcacgggcaactgccgctatggctgagttacaaaagttgattcagtattactttgggattgaaccgggagaaattaaaaccttaaccaaagaccatccaactgtggattaacaaaatgagtgccgctgtcattgagacggcggttttttataaaaaacatctctgtcacaagtaacacgtgacagagatgtttttgtagattaataccaatgatgattttgccaatattttttggcttttgtccaagacccgtagcgtcccttgacgtacgaattagccactttttcctgattgactggagataagttgccatgtagataagattttagtaattgataacgaccataacagtttccgtttaccgcacgataactgtaacttgattcgtgataagcaatccagttcttagaggccatttgttttttagataaggaagcgttaattttagcgatttgcttcttctgactagcggtcagcttagtcgaagcttgggccgttgtcgttgtttggggtaagaggttcgttgtgacatcggtcaccatgccgaaagaaaacccgaataccaacaaaatggatgcaattttaagtttcatttttgacatatattttttaaacactctctctaatcgaatttatctgatatctagtaatatacgcgagaagtgttgcaatcgtgttaacgcgcagttactttgtaattaaaagcgcgtcacattgatgaaatatgttgatggttgggcaattattttaaaaagtttgttgacaaccagtcggaaagacctatacttgataagtcgtttagacgggttgaatggaggcaaaatatgtatgaactgttggtattaggttcgttactttcgcgggacatgtctggctataaactttgtcaggtcttgggtaacgctttggttccgcgacgaaaaatttctaatggcgtcatgtatcccttgttaaataaactagcggctgcaggagatattacgttcgtgacggataccacgaatgcccgcggaaagaaagtggcgcacttaacggctaccggtcgtgcgcacttacatgacatgttagtgacaccagtgacgactgacgctaagcgagaatctttatatcggtttaaatttaaggggatggcaactgaaccggtggctgtgcaaagccaaattttaaatgaatacaaagaagcgcttttaaccgatctgcaaatttatcaacaggtttatctgcatttgaaagaaaaactcgcaacggcttcgatggatagacacgcttcactagactggagcatccgtacgttagagcttcaaattgcggagagtgaaacgaaaattaaatggagcaatcggcagctacaggatttacgactaactgatgctcatggaggtaaaacgaattatgactaagagatatcgtcaatggatagggctggttgccctatctttaggcgtctttatggctttgctggatgttacgattgtcaatgtggcattaccaacaatggtgcgagattttaatgaatcgtttaataacgtgcagtgggtattaaacgcctactcattggtattgggcgtaactttgctaattgtttctaagattggtgatatgtatggcttgaaaaaaatctttgtgttgtcactaggccttttcgtattagcatcagccatcaacggccttgccccttcgttattagtgttggatattggccgcggcgtgcaagcggttggcggtgccggtatgaattgcactggcaatggccttggttgcggttagctttaaaggtggtaaacggggagtcgccctagggattttgggatcagtcattggcttatcatcggcgtcaggtcctttagttgggggctacttagttgcccaatttggctggcggtcaatcttttacgtcaatattccaattgggattgtggcgattattctgacactcatttatgtggatgaagtaccggacatcagtcgtagccaaaagattgattttgccgggatgttcctatcggccgcgagcttgtttacgttgatttatggattgattttaaaggaaagtcatccgcactggggctggctgagtggccagatgattggctggtttggcgctgctattctattcttcatcgtatttattgtggttgagtcacggattagtcaaccaatgattaatctaacgatgtttaaaaatccccactttgtaggaaccgttatggttgcgctggcgttgggagccggaatttattcatacaatacgtatctcacggcgcttatgcaaaattacatgggatattctgcgctaggtgccggtgttcgacagttaacgattagcatctggtcattacttctgggaccaattaccggctatctgggaaatcgatattctaagaagtggatgatcagcggtagcctatttttaggtggcatcggatttttactgttagccaatgcaatgacggtcaaagtatcattcatggccctctggccaggaatggttttaatgggaattacgaatggacttgttaatccgttattgaatagtgccgggatggagggcgttgccgttcgcgaaatgggaatggcctccgggttaatcaatgtctttcgtcaaatcggggtcacgctaggtattgtgtgcctggggttggtccaaaacaaggtttacgaaacttatttaacgcagcacttcagtcgagtcaatatgccacatgcagctgcgaaggccatccatcaagcattagtgaatgccggtccattttctggtcacagcattgcttttagttcgcgtttgagtcagacgccatttggacatgcggtacagcagattgtttggcaagcatatgccaatggaactcgcgccgtttcattagctgctgccggaattgtaattgctggtggtttatgtgcggcattcttaatgcgtaatcgaaaagctcactaaatcataatggcgtttgaagtcgtcaggtattgtcacataccgtgatttgtgataatctgacagtagttgaatagacaaaaacaagagaaatggtcaatgtcccatctggtcggatggcgtagcgaactaaggatagtgggagcttagtgtatcaccaattggggataaccccgtttctgttgctggctgaaattattgaagtaggctacgccgtgaccgacacgttatcaaacggagcgtatgatagtacgttattaaagttggttttgaatttaaaacaatttgggtggtaccgcggaaagatctttcgtccctgttatagggatgatgggtctttttttggtgttgcggtgattcatggaaggagaaataaggtcatggtagacgttttagttaaagatttatttagcgatcggcattttgctgaagatgaagtggtgacattacacggttgggtaaagacggtccgtggatccaagcgggttggtttcatcgaattaagtgatggttcgacgattaagcacgcacaaatcgtgatgcaaagtgatctcgagaattatgcggaaatggcgaagttacctttgagttcgacgattaaagttgttgggacggtggtttatacaccggatgccaagcaaccgttggaaattcatgcacaagaagttgtattagaaggggcttcagataacgattatccactgcaaaagaaaaagcattcttacgaatacttgcggacgatggcccatttgcggccacggacgaacacattctatgcggttttccggattcgctcgttggcagcgttcgccattcatcaatatttacaagaacatgggtttacgtacgttaacacgcccattattaccagtagcgatagtgaaggtgctggtgaaatgttccgggtaacgacgttagacatgaacaacttaccgaagactgaagatggccgggtggatgatcacgaggacttctttaaaaaggaaacgaatctgacggttagtgggcaattaccagttgaagcatttgccttagctttacggaacgtgtacacgtttggcccagccttccgggcagaaaactcgcatacatctcggcatgcctctgaattttggatgattgaaccagaaatggcttttgctgacctgcaggacactatcaatgaggctgaaggcttactgaagtatgtggtccaatacctattggatcatgcgcaagacgagttggcttttctagacagtgctgttgatgatgacttgctgaaccgtttgcaccagacttgcgatgaaaagtttgcgcaaatcacttacacacaagcgatcgaagagttgaaaaaagcgccagttgattttgacgtgcccgtttcatggggacttgacttacaagcagaacatgaacgttatttgtgtgaacaagtgtataaacggccaaccttcctgacggattatcctaaggaaattaaggccttttatatgcgagacaatgaagacgggaagacggttgcggccgctgacttgttggttccccgaatcggtgaattaatcggtggcagtcaacgtgaagaacgtcaggcccaattagcccagaagattaaggactataacttgccgcccgaagagtatcaatggtacttggatctacgtaagtatggtgaaacaccacattctggctatggtattggttttgaacggttactgatgtatgtgactggaatggaaaacattcgcgatgtgattccttacccacggacaccgggtaacgctgaattctaagacattagacgcatagtctttaaataaaatttcgaagacaacgttaaacaatcaaaaaggcaggttcaacggaaaataccggtgaacctgccttttaattttcttcagtaatgctcgtcgtcatggcagccgtgattttacggtaaactaggacggttcctagaaagaagctagcggctaaggtagccgcaatcgggagatggatgaacatggttggtggcaagacgagtgccaagagcggaaacgcataggccgctggcagttttaggttgagcagagccagcagcagtaaaacgagtggcaagctgatcaaggttgctaggagccatgaggttaccagtaagtgtccaacaaccccaatggttgctgcgccactgagtgcggcaatttgtttaagtgctagtttacccgagtaggttgggcgctggaggacttcaaagaagaccactagtaccggcggaattccggccatttgaggctgtcccgctagacaaacaccgataatccagactgtggcaactgccgcaaagcctaaaatatgttgaaaatgaatcggatcgctggcaattgcgtggcgatagtggccctgtcgtaagacaccgatcataagaattagcgtaaacaagaaaatggccccgataaatgaccagtgggttgcattaacaataattggtaaaagtccggtggcaaaggccggtgctaagggagaacgtaattcacgcaagagcacgagaatgcccactaaagttagcgaaattttaatggggtagttaaccggaagctggttgattaaaaagccaataaccgccgtaccggaaggcgctaaaaaaattttgtaaggttgatggagccagcgtgggttgtgataaatccacataccagcggttaatgcagcaatttccggcaagataatttcttgatcgtgcaagaacattgctccagcgaccatcagaaggactaaagcgaagccgatcagatagtcacgactgacgtgagtcataaacttcataagtaacgaggcgcctcctaaatattattccgatgaaaacacaagcatttttgattgtaacatacctgtcgatgagattcaggtgaactattttttgcagattaactagtgataagccgggtgatcattatgcgtaaatagcctgttggagaattattcacaggtgagcgtaaaggttgcaatcggaaatactaatcggttattatgatgttaacgataggaatcaactaatgcaaaaaggaggcgttatcttatgtttggatggttatggtcattaatcgttggtgcgattatcggtgcggtggcaggtgcaattactaatcgcggcggttcgatgggctggattgccaatatcctagccggcttgattggttcttggttaggacaagcactattaggttcttggggtccaactttagccgggatggcattagtcccttcaatcttaggggccatcatcttaatcttgattgtttcagcaatctttggtgttcgcggcaaggccaaataaggcggtgatccgatgcgacgaggcaacaaaggacttttgacgattctaggactgattctactagccttgggcatctttcagctcggctggtggctgccgattccgggactttcagcgtggagtttagaaatgagctatacccaaatggcttggttgaaatatgttttagccggggccgtgattattaccggaatcgttggtttgggattagtggttatcggtatcttcaaaccaatacgtgagaagcaatggcaattcaccaatcggcttggtatgttggaagtgccacaggcagcgctagaaaaagcgttacgtcaccaactggttgaacaggtgggcttagttgacccccgagtaacggtgaaattgttacgccaccggcgtgcccgagtgaccgccatcgctcaggtcagtgcaacggatcagattgatccgctggcacaacaggctagccaagtgattgatgcttatttacagcaacaattagatttgacggccgtcaaaccggttgtccggttatcaccagttgatcggcaacggcacgtgtcagtcgtgtaaaggagggagtggcatgagtaatggcgcatatggcgcactgtggggtcttgttttgggactcgtatgggtgttccaaagcttccccgcaatgttgttagttgctgtgtttggcctagtgggctggggaattggtcggtttgtccgcttagatctttcggccctaggtaaacggattgaacaacttttatcgagataattaaaggaggggtcttatgaccacagaaaaaccaacattaaccacgaagttaacgtttgaagatgatgtgatcaagaagattgctggactggcatcgcgcaatattgatggggtcttagcattagaaggtgggatgatcagtaatctcacgaaccgattccgcaatgattctgatccaacccaaggtgttcaagcccaagtcggcgaacaacaagccgctctcgacatgacgattaccgttgaatatggtaaggatatgcgccagatttttaatcaactctgccaacgggtacaacaagacatcgagcgtttcactggcttagaagttgttgatattaaagttcatattaatgacgtcatgagtaagcaagaatggcaagagcaggcagctggtaagcctaattctaccgttgacactgacgacaaggtcaaataaaggaggccctcatggacaaacaacctgaagcaacgcaaacaattatttttgatgatatggtgttagaaaagattgcgggtaagacggcgagcgaagtcgatggtgtgctgagtttacaaggcaacctgattgataatttatcggatcgattaacagagagtgatcgaccgcaatctggcgtcgatattgaactggatgaccaacaaaagaccgtggccattgaactggatgccatcctagaatatgggaaacgtgccgaagaaattttaaccaaagtgacgagtaagattaccagtgcggtgaccaccatgactggctatcgagtgaccgaggttaagcttcgggtcaaagatatgctgaccaaagacgaatggcagcaacgacaacagtcatctcgtagtaaaaagaaaaaggacgactagtcactagccaatagctagcgctggtgctctactaaataaaggacgctttcagaatgttgtcagttctgaaagcgtcctttttatttgattacatggtagtcggccgaataggcttattcatcacacaaagttcgggccatcaatgccggatcaatgtgtattgtgccccaagtacagatggcatctaagatcggaattagtgattggcccatgggtgttaatgcatattcgacatggggttgagcggtatgaaagtcgtgacgggtaatcaacccatccgcttgtaattcacgtaattgactcgtgagtgttttgtgtgagacggcttgaatgtgatgttgtaagtcagcgaatcggcaatggtcatcttcgtctagttcataaagaatcatgatcttccatttgccctgaatcagttgcatggtggcgtcaaattcatttaaaaagcgtggtgctatgagtggttgcttatccataaagggtcctttcgggggaaacggtcagtcgtagttaccccaaagtgcgtacttgtttttagttcgcctcccattatactgagaattgttgagaaatacagagattgttatgaaagatttttaggaggtacattatgaaaaaattagtggtgatcacgggggctagttctggatttggccaggagattgctaaaatcttcaatgctgacggtttcccgattttattactgggccggcgattggagaaactgacagccttagcggagacctttgaccacgctatggttgctgaggtggatgtgactaatcaagaacagtttgcggctgctattcataaggcagaagcgcaatatggcccgaccgatttattggtgaataatgccggggttatgttactgggcaatgttcaaaatcaagatccacaagaatggcaaaccatgctagatactaacgtaatgggtattttgaatggcacccaaatcgtcttggacggcatgcgtgagcgtcaacatgggacgattttaaacatgtcttccttggcggggaagaagacatttgtaaatcatgcagcctacgttgcgtctaaatttggcgtacatggcttatctgaaaccttacgtgaagaaaatgccgcacaaaatgttcggatcatgctcgtcgcacctggggcggccgaaacggaactgctgacccacgttacgagtgacacagccttgaaggattatgaagcgtggaaggcgacgatgggtggaatcaccttagatcctaagcatgtcgctgaaaccgttaagttcatgtatgacatgccacaagaggttaatattcgtgaagtagatattgcagcgactaagcaggatgcttagtctggtgggatggcgattagcgccgtcctttttttattattgatgaacctagccagaccatcaaaccgaatttaaccagccaaatggcgaggccgattccagctacccaagtaaaaaaagtaacgaaatttaacgataacaaggactacctatactaggcgaccttccaaaacgatgcccgcaaagccatagccagcaatgtgcggtaatcttaggggcgtgaatccttgcaattcattccaaggcaagccggaaatattaattagaatcaaatttccaaagggattctgtgtgtgggtaatgtgtgtttaagctgtagaatatcaatgctccggtcagttgtttgccaaataccatccatcatgattccccctttaaatgaatactggcagtttagtggatttcgatgattagtggcaaccaacatgttgatgatggcaggcgaactttagaatattttaaaaatattacaattaaaacgctattgacacattgctgtaatataactaaattaaatgtaatctttgatttaggggagtggatattttgaaaaagacgctaacagttttgaccgcattagccttgatggcaccattggcaattgttgcaccagtttcagcgaagacgacaacagcaacgaccacgcaggcaagtgttaagaaacaaacgtatacgattttatcttcaagtttttataagacggcgaagacgtaccatactaaggacgctaagccagttgtatacaaagccgttatgggtgctgatcggccaacgatgacgttaacagctaaggggaagctgaaggccgggacaacttacaaggttaccaagcaagttaaggtaaagatcaacgctaagaagagtcagaagtacagttatgttaaaggccaaggctgggttgtttctagcaagctaacggctggcaagtttaaagccgctagtggggttaagaagacagcaaccaagtatacgatcgtctcagtgacggcgcttaaaaaagcgaagacggtacataccaaggatgcccgtccagtcgtatataaagccgcagttgccgctgatcggccaacgatgacgttaacgacgaacggcaaactgaaggccgccacgacttacaaagtgacgaagcaagctaagctgaagaacgctgctaagaagaccgtagcctttagctacgtatccggccatggctgggtgctgcaacgtgatttgactaatggccaattcatgaatgctgattaattggggaattaaccagcattgatatggtcattgagatagggggagtgaagcatcggtcatccgggaggtgatcggtgcttttttattttcggcaaataagggtatactagaaagaaacgaatggaattttcaggaggactcatgatagcacttaaatcgcaacgggaaattgatggcatgcaggcagctggcaatattttggcagggctgtttcatgaattagcaacctacatcaaaccagggatgacgacgtgggacattgatcattttagttaccaatatattattgatcatgatgcgacacctggtgagctaaactttgaaggctacaagtattcaacgtgtgtgagtgtcaacgatatggtgtgtcacggttgtcccagtaaggatatcttaattcatgatggtgacttaattaaggtcgatacggtcatcgattatcatggatatttaagcgatgcctgccatgcatttgttgctggcacggcaagtcctgccgtgcagaaactgatggatgtgacccttaaagccttgtatctggggattgatcaggctgttgtcggtaatcgaattggcgatattgggtttgccattcaagattacgccgaaaatcaaatgggctatggggtcgttcgtgaatacatcggtcatggtattggacccacgatgcatgaggaaccagatgttccccactatggcaaggccggacatggtacgcgattgaaagcaggcatgacgattacaatcgaaccgatgattaatattggtgattggcgttgtggcgatccagcggatgatgggtggacgattcgtactttagatggtagtcttagctgtcaatatgagcacacgttagtggtgacagatgatgggccaaagattttgacctcagttgatccggtcatggatgcaccgtatttattgaaatagagttgatgagcggagctgtggctgcgctttttattcgattttagaaaatgaagccgtcgttcgtttccaaagattgtctatggtatagtgggtgtaaacgaattcaagggagcgagtcgcgtgtacaaaataattaccagtgatctcgatgaaacactgttacgacaggatgggagtatttcatcggcaaacgtcgccgccattgcggcagcttctaaacgtggggtcaagttcgtgccaaacaccgggcggagttttctatccattcaaccattgttaaagacgttaaacctctaccaacgaccaaacgagtatgtcgtctcgtataatggtggtgtcgttgtagaaaatcaggacaatcgtgtcattgtcagcaatgaaatgccctatgaagaagcggccaaggcttttgccatcatgagcgagtttgatgtggatattcatatctatacgctggatcatctgttcatttatcggccacgagcagatgatcgcgcctacctgcaaacccgtggggtgaccttcactgagatgacaggtgcatttgaccagtttagaaatgcgcagattatgaaagttatcgttatgaatccggatgtgatggttcggcaacaggtttatgcggcaatcaaagccgcatttacagaaattaattgtacgtattcatcgggaatttacatggaagtcaaccatgccggtgtggataaggggcgggcgatcttagacctgggtgacaagctgggaattaaggctgatgaaattatggcaattggtgataacgcgaatgatttaggcatgctgaccaaggtgggattacccgtatcggtagctaacggcattgatgacgttaagcaagtggctaagtttgtaacgccccatgactacgagcgcggggttgctgatgcaattgaaacctttattttataagtagataccaagatgccaggacggttgcgttctggcatttttgagcggtggcttaaacagagctggtgattgacaagtcccccgccttccagtagggtaagggaatacttaagcgaaaggggtggatgagcctgtgagaatcgaacaaatcatggtgtgtgcccccgtaaatggtgtcggacgtttttccgtagagtaaattttaaggagaaatatgatgaaaagcgtccaaaagtcaggtccttctttgggactggtaattgttttagtggggtttccccaaattagtgagtcaatctttacaccggtactgccacagttacaacatgtgttggccgtgggtgccaatcaaatccaactgaccatgagcacgtactttgttgcgtttgccattggtgtcttggtttggggtcaattggccgattactggggccgacgcccagccatgttgactgggattggcgtctatttagttggcaatgtcggcctattggttagtacgcagttcacgacattattgatttggcgactagttcaggcctttggcgctagtacagggtcggtcgtcacccagacaatcatgcgcgaaagttttacgggtgtgaggggggccaaggtctttgccaaaaccagtgcggctatggccttggcaccagctttggggccgttaatcggtgggatcatgcaaaccatcagcggttatcgaggtgtttttgcaacgctggtgacgatggcaatcgtcgtgggattactcgcgcaagcaggtttgccggagacccgtcaattaacaacccatgcccccatcgttaagcaacgcctagtggtgcagcggttattgacggactcggttgtgtggggttatggtctattaattggggggattaacggcgccttgtttagttactacgccgaagccccatttatttttatgacccactttggctattcggcagtggcttacggctggttgggactcgtgttagctgcagcgagcttattaggggccctcattgtcgggcgactactgaatcgttggacgcccgaacaggtgaccggcggtggacttattgtgagtatggtgatgagtgctggcttagtgggtgctgctgcactgcatcaggctaccttgatgattatcggcatttttttaaccttttttggattcaatattaccttgccgaacgccttgaatcgcgcgttagtgggctacgaacaagtgatgggaagcgctagtggttggtttaacctagggtattatcttttagtcagtaccgtaacgtacggaatgagttggtggcacaatggtgctatcaaccgactgccgttctatcttttggtgctgagtttggggatggggttggcattttggcggttagtcagacgacaccagtaatctgatataacaagaattggttgatgagtaggggtgaagtcttgtctgctcaactacagtcatgatagacgccaatttccgagactcaggaaccacagtatttggtaataacctagttaggttaacgataactggttagttgcaaatgacaagctagaacgaaaagaaacgtgtatgataatgtcgtaagcaactcatgaattgtagaaaggactgggtgctaatgacgatgatttacgatttccaagaaactgaaatgagtggtcaaccgctcaatttggcagactatcggggaaaagtcgtactgattgtgaatacggctagtaaatgtggactggcaccacaactggtggggctagaagacttgtatcagcgatatcatagtcagggtcttgaagttttgggcttgccgtccaaccaatttcatcaggaactagaatcggatgaggcaaccagtgatttttgtcaggttcattatggggtaacctttcccatgacgaaaaaaattcaagtcaatggggcagatgaagatccgttattcacgtacctcaagaaaacagcgggtcacggtcgaatcaaatggaactttacgaagtttcttattggtcgtgacggacagctcattgcgcggtacgcccccacgaccaagccagagaaaattgaaccagcgattgtgacggcgttacagcccgattagaataggtgtattaaaaaaggatctaccacgtgttgaacgtgataggtcctttttggtaatagtcgctaatgcaatttttgagtagcagtggccccatacattaatttctgaatgtgcgtcgtgattttggccattcgagggaagccactaaagccagtctgcccgtgaccatgagtcatgatcacaaggacgtaacgctgcccgcttggcaaggtgacaattgcggcatcgttgttggtatcgccgagaaacccaactttatcagcaacggttgtgccggccttagcggcgctggcgcccgctggaattccagtccggtaaacctgttgtttcatgagagacagtagccacgaccgatcgtgggcatgattaaagggggcttgcgcacgatctaagcggaccaagagtttggttagactcgcggcggttgtcatcgcttcttgattggcaatgaacatcggtgtgtaataatcttgactaccgatataattatcgatgccagctaagccgtacgtatctaaaatgccctcagcaaagtcattttcactgttcacaatcatccgatgaaagccatcttggctggtcgtgtcccacgtgtattggccctgatgattgagatgaaacagataggccgcaatgaatagtttatatgtactagccgaaacaacgggggtatgggcgttggctgaaactgccaattgaccgcggcggtaaaattgacgggcaagcggagatttggcggctgaactacccgcaattggccctaagttgtagaaactcacgctggtcgtaccatcggcggtgaggtgggttaagtatttttttaggcgggctttgagatggcgttgttgctgcttaatttggtgtggcgtagctgcttgattggcagcaaccgtatcagcttgcgtcggtcgttgttgatgggcgtagacactgaacataccagttagcccgagaacaacaatagcggctgccatcacaacgacccggtatttaaacaaaagttgggggatttggtggggtttcatcgtgtcaggactcgctttacaaaagagtttgttggttaacttaacacttgacagtatacgcccaaatgaagatggcgtacatgaaaaattacggtggacaggtaactagcgacttatcatcggtccaaattagtcgttacttcgggttgcgatacaaatgcattcatgttatagtgtaatagtaaaatataacactagggaggtagaacggatggagtttgatgataaagttccaatttactatcagattaaaacatatctttatcatgaaatgataatcgggcagctggcaccaggggataaattgccggctgttcgccaactggcagtagacttgacggttaacgtcaatacagtccagcgggcactcggggaaatgatcacggaggggattattgaatctaaacggggaaaggggaacttcgtcacaatggatgagcaacgaattacccatttaaaggagcagttagtcatggaacagttggagcgcgtttatgaacaattacacgcattgaatttaaccgatgaggaaatcatcgcgagtttgaagcgctacattgcacagagggggcaacaacatgactaatgtattggctatggaacaagtatcttataagcgaaatttaaaaacgattttacaaggggtcgatctgacattagcgacgggaaaaattgtcggattattgggtgaaaacggtgctggtaaaacgaccttgatgcgcttgatcactggaagtgccaaggggcaagggtcaattgcggtttgtggtgatacggctatggtccagcacaaacgtcacgtgagttttacggaacagttgcggggattttcagctaacaccaaggtagaacgggttgttaatttctatcgaaccgtctatccagattttgatgggcagcggtttgaagaactggtcactttcttacaaatcgatacgacattgaagttgtcggcgctgtctaaagggatgaaggaaaaggttattattgcgttaaccctggcacgtcagacacagctatacttgttggatgaaccattcagtgggattgatagcataagtcggaagaagatcatcagcagtattttgaaatggaaaccaacagatgccacgatggtcattagtgatcactacgtctcagagattgcaccaattctggatgaagtggtgatcgtcaaggatcaaaccatctatgcccataaattaagtgacgagattcgggaagactatggtattggtatcgaggcttattacgagagcctatatgaggggggcgtcagtcatgactagttttggatcattatttaaagtattgggaatgcaacgtttccggaagatgaacgatgtggctggtctcagtctggctgctatcttcgtgtccttactgtggtcgtggtttactactggaattagcagtggccaagtttttagcgtcacggaaagttggttaggctcggcatccatggtagtctggatcttgctagctattgataatgaacatgtctatacgcgagatacattccgattaatcccagtcagtgatatgaagctctatctgaccaacttactggcttcattaagtgcctttgtgtatttcgggctaattcatctagttctaatgggaatttcagcgcgaatcgatcataaatttttgatggatttgacacacggtgtggcagatactcccgtacagaaagctttaatcacaatgggtttactgatcatcttagttttagttttgatgattttaatctggacgaccatttcctttgcgcacttagtggtgcgaacgaccgggagcttcttgccgaatattggccggcgaattgttaatgcgattctatacctgttaattatctatctagtggtgcgggtattagtttatctctttgaactggtttcgcactttggtgtttcttttcagggggactacagtccatttattttcatgatttcgattttcttgggattagccattgttgaagcaatcattaatattttcttacttaaaaaatggggcgaaactatcgccaactaaaagttgcagtcaaaaatcttggccatcaaagttgatgaccaagttttttgtcggtcgtcgtattacgaaatcaatagaacccatacgtaattcttacagcatctttattcgctctttacacctacttggtatgctgaaattattcagaaaggggatataagatatatgcgatttcagacagtactgacaacactggggtgtgctacgattatggccactgcggtgacaccagcctacgccgcaaccgcaaaagattcgcaacttcagccggcaatttcacaaaaggttaatcggcccattcacttagagggcggggaaaacatgcgtgatcttggtgggtaccgaaccaagtccggccaacgggtgaaaatggggaaggttttacggagtgcctcattggagaacctgacggcaaccgatgtgctcaacttacaggtcaaccatcagctcaccgagatcgttgatctgcgaacaacagagcaaatcatgaaaaagcctgatccggttatggaaggtgtcaaatacctccaggcctcggttctagggactcgctcgaactacgatgatgatgaccaaggaatgtatgatgatatggcccataaagcagcggccaaacggagttatcgtagtctgctgattcagattgctgaaaacaagcgtggggcgttactattccattgttcacacggcatggatcgtaccgggactgcggcggccattttatatagtatcttaggtgttagcaaacgagatattcaacgagattatttgttgtcgaacacgcaattaggcgtaacttgggccaagccagcactgctgaattccttttacaagcaaattaatcaacaatacggatcgatggataagtatgttaaacacggactgaagctgagtccggctcagataaaagccattaagacaaacctgttaacgaaagcaccgcattaagcacaaataggcctgcctaaccagttaactggttaggcagacctatttattcatctcaaacgggattaaagaagataatataagccactaagcccgataaagacataaataatacgtttaatagtggcgatgttgagtcgagtaacgacgtggctagcaataacggtgccagtaacggcccccaccatcccaatgagaattaacgggatgtgttgcatggtaaggataccgttagccacgcggatactggtgatgtaaaacgtatcaattagaaaaaaagtttggaggttagctaagtattccggcattgaatgtgctagtgataaaaagtagagggccattaaagggccaccaataccgaatagaccattaaagaatccggagactatcatgaagcaaccggcgacataccaaggaaagggttgcgtattcccgcggtgattaagggtgaaataaagtgataagccgacgagtaagccgcccagtagcagtcgtaataagtggacatcgagaacatgtcccagatgaacggaccctgtcgccacactggcataaattagaaatggtaaaataatttgcctgaacttaatggcatgatggtaacggtaaaccagtgttgagacactgcccaacatcatgacccccgctacccccgcgctctggtcaatgggtaagatattgggcaaaagaatcatcatcataatgaccgcaccaaagccagttagtccttggacagtgccgcccaataggccggcaagggcaacaattaaccacgtcatgtggtcgcctcctatgaatgaacaaataaaaaagccctcatcaatccgagatgagggcactagttgatccataggttacatctggaatgtacagagcaactaggcaggcgcaaacctgcataaataagcatacctgttttggggcagaatagccagagaaaaataaaatctaattgatttatctgagtcaatgggggaaaagctagttattttttgaaaatagttagctttttagttagcttttacttgcaaaaactaactaatatgctaatatagtgaccattaagtattcaaggaggacacacgcatgacagagtcaagtcgagatttacttaaaagctttggcaaattattgcagaatcgggcatttttaatggccgtcagtcatcaacctggaatgggtgaacatggcgggccgggtggtggccgaggacaaatgcggttattacagctattatcgcaatcgactacggggttgaccaatgctgaaattgccgagattttggatatccggccgagctcggtgagtgccacaattagtcgtttggttgacatggggctagctgaacgcttgcctaatccaactgacaagcgagcagtgattgtgaaattaagtgatcgtggaaaagagatgtttgatcagtacgacgaacgggtcgatgactggtcggataaattatttggtgacttgtcggctgaggaacaggcacaattagaacacctattgacgaaattaaaccaccatgttgatgatgtgaactggcatgatatgatgccagataatcgtcagtggccacaccacggcatgggtggcagagggatgggctggccccgtttctaagtttgagtaggttggaggcaaagagagatggcacgaagaatggcagcaccagcgaccgcacaacaacggccgactggcaagtttgattttaaagcatttttacgattaattcggcagactaaacctaagtattggcaattagcagtgggcttactgttggggatgttggcaactggcgcccaactggcggtgcctaagttggcccaatcgttaatcaacggggttggtcatgccatgaatcagtcgttgttgattacagtcattgttctatttgtggcaagtgcagtgattagcgctatttctggtgcactgctggggttcttcggggaaaatgttgtggcacgtttgcgtgaaaccttgtggcataaattgattcggttgcgggttagctattttgataatgtgaagaccggcgaaatgacttcacgattagtgaatgatacgatgcagattaaagaccttttggctaattcatttccacaaatggtcacgtcattgctccaacttctaggggcgttagtgattatgttattgatggactggcgaatgaccttaattatgttcattgcggtaccattggtcatgattgtgatgtttccaattatgcgacaatctagcaagatcggtcgtcaacggcaagatgcaatggccacctttagtggggcaaccgatgaaacgctgagtgaaattcgcttagttaagtcttctaatgccgaaacctatgaaagtcaaaatgggtcacagcaaatcgaaacattgtatcatattgggctgaaagaagctatttatgatgccattgcgggccccgttatgactgctagcatgttagctgtgtttgtgggtgttttggcttacgcggcagtccgggtgtctaacggaacgatgtcgattgggacgatgttttcttttctgatgtatttgtttcagatcattggaccagtcggaaccttaggccgtttcttcacggatctgtcaaaggctaatgggtctacggaacgcgtacgcgatctcttgcaagaacctgaagaggccctgactgcgggacccaaccaatcggttaatgatcaaacattagcgttagagcatgttgactttgcttatgaagatgatgggcaaccagttttgcatgacgttaactttgaagccaaacctaatacggtcgtggctttcgccggaccatccggtgggggaaagtcaaccatttttggaatgattgaacgatactatcaaccccagcatggacgggtgacgattggtggtcaagatgtggcgacccttaatctaaatgattggcgttcacagataggctatgttagtcagaattcggctattatggcggggacaattcggcataatttaacctatggtgccgagaagacctatactgatgacgaattgtggcatgtccttcagttgacctcagcagatcagtttgttcaccagatggctgatgggctagacacgcaagttggcgaacgcggagtgaaggttagtggcggtcaacgacaacgactggcgattgcacgtgcgtttcttcgtgacccacagattctgttgttggatgaagcaacggctagtttggactctgaatcggaagctatggtgcaacaagcattgacgaaattgatgaagggacgaacgaccttaattattgctcatcgtctcagtacgattgtggatgcggataacatttactttattgaaaatggtcatgtgagtggtcatgggacacatcaagagttgctaaatagcttaccaatttatcgagattacgtccggattcagtttaaagaatagaaaaaagtccttcgcaatgcggaggactttttgagttggggagtaaaagaacgcgtataataactggcaatacaaagaaaagtggggatatggatgaaactattgataacaggctttgatccatttggtggcgaaaagacgaatccggctatcgaagcggttaaacgattaccggcggcgattgctggagcgacggtggtaccgttggaaatcccaacggtgtttggtacttgtgcggaagtcgttcggcaagctatcataactgaacggccagatgttgtcttaagtgtgggccaagccggtggccgatcggcattaacgccggaacggattgcgataaatttagatgacgggcggataccagataatgctggtttccagccggtagatcagccaattcaaccgaatggaccagcggcctattttacccagttgccggtgaaagcaatggcccaggcaattcgccaggcaggtctgcctagccatgtttcaacgacggcagggacgtacgtctgcaatcatattatgtatcaggtacagcatttgcgggcgacggagtttccacaactgcaagcaggatttatccatattccttttttgccggaacaagtggtgcaacgatctggagtaccttcgttgtctttgacagatgatgttcgcgggctaacggcggcaattagagcaattgtgatagctcgtgcggattaattactatacgattatacgaaggctattggctgtatatcggggtcgttggcattaagagggcagctaaatgattacccggggcaggtatacttcaagcataataatggataagccatacaactaattagccgaattgatacaaatgccgattggtgtggggtgtttcgataccatgatttttcattttgttttataatgaattttataagatgtgaatggaggaagaattgatgcaaaaatacttagccgaatttttcggcacgtttatgctggtctttttagggactggtgcggtgaccgttgccgcgggtaatacgttaacgattggattagcctttgggttagcgattaccgtgtctgcgtacgcgtttggtggaatttccggtggccattttaatccggcagttactacagcaatgctgatgaatcggcggattaatggtcgtgatgcattagggtacgtgattgctcaggtattgggagcaacagttgcttcggcttttatgaaattatttgtaagtggattaggattagcgactaaccaattggggcaaaccgatttccctaagatttcgacgggattagcctttttagtagaagtactggtgactttcctattcttgctggttattttaaatgtaacgagtgatcggcacggtaatggtgactttgcgggattgacgattggggtaacactggccttcctgattattgtagcgttgaacttgactggcggttctttaaatccagcccggtcatttggccccgcaattttcgccggcggaagtgccttatcacatctatggctgtacatcttagcgccggaagttggtgcgattcttgcggctttggtcgctcgtgtgatgggtagtgaagagtaacttaaaatgacctaataattggctctgcaaaaccttttgggttttacagggccaattttagtaggtagcttagtttgtgaattcgttacttccgcaggctattagttcaagtgaatgttgttcgtaagaccatagtgctcggtaggtatcattaatcagccgtcttcaactcttgcaatcggaattgtacaatatctgtaatcagttgtaccggcagtgcctggttatatgggatttgaatggcacctttggatgttcgatatgaactgagtgcggcggcaaaatgtttaataggtccgggagtggggtatagtcccagatgatttttagcggccgcaagataaatgatgggatgcttaccagaataaaaagctgacatgccatagctaatcttttgactggcatttagtaataaatcttgaagtaattgatatagagcggtgaagtcggcttgatgatttgaatcaatatcgattaaatagtcattaattgtcatgatgagctctccgtttcccaaatgaattgatttcagtatagcaaacgtagagtaattttcatgagcgcgtaattaaaaataacgctgtcggcactaaatttgccgggggcgttatttttaagcaatatcgcacgcgcaacctattttgctaaagataccgcgtgttttgtatagtgaacatgccaaccatgaggaagtccagtaacccgtttaaatttgccagtatgcgcttggaaggtcatcagtttggtgccgttttttaaatgtcctttcgtgagtgctaacgttcctcccagtttagcagtatgttttatttttaggtgggaactaggtgtgacgactaatcgtccagctgactggcggaattgaccgcccaagtgggtatagtttttagtaacctgtagtgtaccaccattgagaataatagttcccttaccggcggctgttgggctagctagattcagcgttccggctttaagccgtacgccgccagtaaattgattattgccagctagggttagtgttccggtcccctttttaacaagttgaccttgaccagtcagattattacgccaagtgtcttgggcattaaagccgcctcgcttagcgtccatggtgatggttacctgctgatttaaggcaccataaccgttggtagcagagaaaaggtctaagcgtccccagccttctgtatcgtcgagtacaggatatcctgagggtagtccagtcgtgtagagaacatcgcgccgttggttagtagacaagtacggtaaccgtgaagctaatagaacctcggctcctttaggcactcgcatggcttggtgagtatcaccacttggtttaaaaccgtaagtcagtcgtgatcggtaggttgtgcggttagtttggtaattactgaaatcatctacagcggtagccactttgctgtctaatagagcgcttgtgtgggcaacttgataggcttgttgtttgagatcctgattttcagggtcattcaatacggcggcggtcatagcggttccaaccagacgaccaccgataaccgctaatggtgaatgccgaccggccaatacgcggtcgtagcccacctccgaagcccgtgtaatgagctcttggaaacgttctggtacggcgtaggccaacgttaagccggtttcaaacgccgcagttgtatgaccacttggaaagtcgtaatcgtcacttttagccgcggccatcacatttgacagggctggtagtactttaacttggggactttgccggtaggggcgaatgtatttgactacatgcttaacgacacctgttccagaaaatggggaatgcacggttgtgttaactagttttaccagcggtcccagcgttgaagttggatcggcccactcaaccttactataaggagcgttggccggtagaggagtggtcggcatggtagtgaaatctgtctgggcgttagcatttttaatgaaggtggtagcgtacggccctaaaccggagattaggttgtagcgtagatcacgacgatcggtcaaataggatcgggttgcttcggcgtccgtacgatgttgggtaattatggctgattgaacgatattttgattaagaatatcgggatcatgggcctggccactagaccagtatgtaggaaatggactcatttccccaacgaccggattgttttgcacggttgtgtggccggcgatattttggcgataatgatcaacaaaatagccgtaagcggctgcgtgaggtgctaactcatcagtggtctttgcttgggcactttgaatagcaaacggcaaggttactaccgcgatagaaacggtaaccagagccttttgaaaccaagaatgctgattcgttttcataaagaatcccgcctttcatccgtctggggaggttaacatcaaggtacaagatcaatgtatcaaactttttcggaattgtcagtggggttaatgaaaacgatacacaaaccatacataaatagtacactatcaatcggtaatagctggaaaaagtgggttcattaatttttaaataataagtggtccagccaagttataatagatatgacacgcgatgtttgtagtcaaaaagcgtgctacgctcagatgtagcacgctttttgacggggcctaaatcaggatgccattacaatgttcgacttcgtgttgaataatctgggcgacaaatccggtgaaagtctgacgttgtttctggaagttttgattcaaaaaagtaacgtcaatcgttttaaatcggtgggttggtcgctcacctgacaaagaaagacagccctcttgtgtatcgtagggcccagccattttggtaatctctgggttaatcatcgctactggtaagatacccatatcaacgacgataattcgacggttaaccccaatcatattagccgccattcccacacaattttcctgattcgctcgtaaggtatctattagatcagtgatcgtttggccgtctgctggggttgctggttgcgagcgttgtactagacgtgcttcatcgtgaacaacggatttaatcatgggaatcctccaataaatgatattttttgagctgttcgtgcgtcaattattatcttagtatagcatgaaagtctgcgcgataacgtggcggtcagtccgttagataatgaatgaaccgctgtgctgctggtgatagagtaccatgcggataaactaattgtaagtggctaatgatggggtcagtgaacgggcgcatgacaaaatccgctgtcataaagggggcaactgacttggcaaaaaggaaagtcacacgatctgtgtgggcaatcattgccagcagtgtttcaatatgcggtgtggaaaaacgaatattaggcgtgaagccagcttgttgatagcgctcgctgattcgttcataaacaccggaaccgggactgagtgttaccacatcaaaggggcgcaagtcagggagttgaatgctggtttggtgggccagcggatgatcgctagggagaacgactttaagttcgtcatcggttaaagtcacagcatcgaactgtgagtggttcagttgttgactttgaacgtcgcgtagaataccgagatcaaacgattggtgctgaagctgagttaagagatcagccccctctaattctgccaaagaaaagttaatttgaggatagtcttgcatgaattgactcatcttactggctagaccgtactgagccatgacgggcacactgccaatctgaatcgtaccacgccgaagttcacggtaatctagtagttcttgctggagtaattgatactgtgcagtcagcgtttgcgcgtaacgaaaaaagacttcaccactttccgtaatggttaattggcgtttgttacgtgtcgaaattaaggcggtatctagttcttgttgcatgttccgtaatcgttttgatagcgcagattgtgtgatatttaaggcaatagcagcatcagagatattgcgcgttttataaagtgtgatgaaactgtagaaatcgtcgatagtcattgaagaaccttcttcttattattccatttaggcataacattagtcgaaagttgagttgtttgcaacgattttatgccttaaagtggtgattgtaagcaacttataggaggtaatctgatggtaaatgatccttatgatttacgaaaagtattggccgagctaaaaacccatgccaaccagtaccatgagacgaacgtagctgtgaatccaaatgctgaattggctggtgtttaccgctatattggtgctggagggacggtaaaacggccgacgcaagaaggtccagcaatgatgtttaataacgttgaaggcttctccgatacgaaagtcctaatgggattaatggcaaatcggcgacgagtggggctcatgttccatcatgattaccaaaccctgggaaaatttctaaatacagcggttgaaaaaccaattcccccagtgatggttactgacgcacctacccacgaggtggttcacaaggccactgatccggactttgatattcgtaaactcgttgcagcacctacgaatacaccggaggacgcgggaccttacattacagtgggtgtcgtgttgggatctaatatggccaagactatgtcagatgtgacgattcaccgaatggttctagaagataaagacaagttagggatttacattatgcctggcggtcggcatattggtgcctttgctaaagaatacgaggccgctaataaaccgatgcccatcacgattaatattgggttagatccggccattacgattgggtgcacctttgagccaccaactacaccattggggtataacgagctgggggtggctggtgcgatccgacaagaagctgtgggtctgaccaaagcgctaaccgttgatgagaatgctattgcccgttctgaattcacgttggaagggtatatcatgcccaacgaacggatgcaagaggatatcaatacccagacaggtaaggcaatgcctgaatttccgggttacgacggtgatgctaatccagccgtacaggtcattaaagtaacggctgtcactcaccggaagcatccaattatgcaaagtgtgattgggccatccgaagagcatgtcagcatggcaggaattcccaccgaagcgagcatcttagaattaacggatcgcgctatcccgggtaaagttttaaatgtttataatccacctgcaggcggaggaaaactgatgacaattatgcagatccataaggatgatgcggccgatgaaggtattcagcggcaagcagcactgctggcattttcggcgttcaaagagttgaagacagttattttggtggatgaagacgttgatatttttgatatgaacgatgtaatgtggaccgtgaatacgcgtttccaggccgatcaggatttaatgatattaccggggatgcggaatcacccactggacccgtcggaacgaccagagtatgatctgaaatctattcgaacgcgaggcatgtcatcgaagttggtgattgatggcacggtaccctttgatatgagggaacaatttgaacgcgcgaagtttaagccagttgctgactgggaaaaatatttgaaataaaagggtgatggctgatgaaacggattgtgattggggtgactggtgcgtccggtacgatttacgcgattgatttgttaaaaaagttacgggataagccagacgttgaaacacatttggtaatgagtccgtgggccaccaaaaacttggcactagaaacaagttatacattagcccaagttaaagcgatggccgactacacgtacagtgatcgggaccaaggggctaagattgctagcggttcattcctacacgatgggatggttattgttcccgctagcatgaaaacggtggcgggtgttgcctatgggtttggcgataatctaattgcgcgggctgccgatgtaactattaaggaacgtcgacaattgatcattgtcccacgggaaacgccactgagtgtgattcatctagagaatttaacgaaactagccaaactaggcgcgcaaattattccacctattcccgccttttataatcagccacaaaccattcaagacttagtggatcatcagactatgaaggtactggatgcatttggcattcagcaagtgaccgctaagcgttgggagggagattagccatgccagttttcagtgtgacgcaagcgggctatacgattgaagcagcactaacggttattggcaaagacttattaattgtggttacgggtggcagtaacccacatattggcgatgtaacaacgttgacaagggacacccccattcaaacaattaagtatcctagccatgacggacgattccataaggataactttgtaggcgaacgggtcgcgcgagtagtacagcccagtttagttgggagctgtacagtgacggcggggattcacgttaatcagatcaccaaggcccagattgctgcttcggcgctgatgggtgaagcgctaggccgccaaattgtgacgtggctggtagctcacccaattaaagcgccagcaccgcagtattacggtgacgatgaacagccgctatgaaactgtgtaatcagccggcgtaatccctaatcaaacgtgattaagttatggtgccatctagcctctgaacgaggaatcgatgctcaattataaacaaataatattatttaagcgtgtatcagttggtctatcctattgatacgcgttttttggtagttgaagcgtgaaaagagaatttaaaatgcgaaaaaggacaagtcaaggactcacatttcgaattatgggttagcgaaatggtacggaaggctggtataattcttaccagcagagcaagaaagtgtaaaaatcgcaataaaacaccacgggtagtagaaaaaagcataatctcaacaagatattggggctcgtaaaatagtgaacatgctatgataagcgttggaaaacggttgcaaaagatggggtgaatagagagatgcgcgtgggaattcagaccgaatcaaagctcatgagtcaactgcatcctctggccgctttaatctacttcgtggcattatttacgttgctgttaatcattaaccacttgttgctgacggttttgctgtttgcaagtttagtcggactgtgtcgttggtatttgggacggcaccgggttggccagctacttaagggagtcagttcgttgatgatactcatctggggacttaatgtcttgttaaatcaaacgggcccggtctggtggcagtggtcagttggtcccttgacctttcgactaactaaaacggcggtgctgtatggtgggacaatggcgttgtcgctgggcggaatgatcctggcatttgtctggtttaatcagattatgaccaccccaaaactaagctatctcttgtttccagtcgtaccgcgattggccatgctgctgaccatctccttacgcatggtgcacctctttactgtgaagtttcgacgattggtgatgcttcaaaagacacgtaatgttgttgtcagcgaaggctcgtggcgccagcggttacaacaaacggggcaatttttacgcattttattgattgactcggtgtcctcagctatggaaaccgctgtgttgatggaggcccggggatttggcgcacataaaagaagtcattaccgtacttttcggtggacgacagtcgatacggtatttacggtgggaagtgtcggtttgtttgccattagcttgtatttgcgattcttgggctgggggtggaccactgacgttcgacaattcttatggtggcagaagacggatgggtggtttgtcttaccgctggcgattttcttaggcgtgcccgttattggagaggtgggttatcgattatgtcagaattaatagaagtgactcatctgacctttacctatactgggcaagcagctcccgccttgaaggacgtgtcactgacaattcatgcaggtgaatttataacgttagtgggggcgaccggcagtggaaaaacaaccctgcttaaacagctcaaacatgagctgtggccggccggtgagcggactggtggtttaacttttcgggatacggctattcaggcattgtcgccagtcgagagtgcccaacagattgggtatgttgcccaagatccgcaagtacagccgataatggcgacggtcatggaagaattagccttcccattagaaaacttaggttatccgacggcaacaattaatgatcgcattgccgaaattgcgaactatttagatttgaatcatctgttacagcgtgcgattgaaacgttgtcgggtggccaattacaattggttaatttggcttcagtactggcactgaaaccacaagtgattctgttggatgaaccaacggcacagttggatcccacgactgcccagaaatttttgaatatcttacagcaagtgcatgatgagttggacttaacaattgttttgacagaacatcgattgagtcgggtgatggcgctgactgatcgggttgccttattggctaatgggcaggtcctaacggttgctgagccgacaccagcgttacaacagatggcggcaacgccagctttgcaagcctttgtaccgccggttccccacttttttcttgatcacaatctagttgttacgccactaccacttagtgtaacgatgggacggcgagcgttaagacagtctagttggcggtttcaagccgtgacaacgcggcagccagcacaatcggggccacgtgagtccgtattggtcgctaccggtgtttctttccactatccgacaaccggtgatattttacaccaggttgagttacaagtagcgaccggggattggttagcaattattggcaagaatggttcaggcaagtcgacgttgctgactgttttggcgggattgcagaagccacagcacggtaaggttcgcttgaatcagcaggttatttggcggatgaagaatcaagatcgtgtcttacaagtgggctacctttctcagaaccccacagaacaatttaacggtgatagtgtgcgtgaggaactcaccgcacaggcacaattacgaggcacatccgttgcccagcgggtggaccaaatgctgattcgttgccatctaaccgcagtcgctgatcaaaattcgtttgatttgagtggtggtcaacaacaattgttggggttaggcttggcgctgatgacggaaccgcaagttttactactagatgagccaactaaaggactagatccggataccaaattaagaatcggtcagttactccagcaagctcacgaaacaggtttgacgatcatcatggcgagtcatgatatggatttttcggcacagtttgcggacacgtgtacgtttatgtttaacggtcgggtgaacccaccacaagcaacgcgtttatttttcacacagaactttttagcaacgacggcggttaatcggctgttacggcaacaagtaccacaagcgttatttagtcaagatgtggttagaaccgataaaggaggtgagtaacaatcggacagcatggatggtggcagaaaaactggaattggttaatcccggtcgggttaatgctcggcttattggcggggatgttgctattaaaaggacatcacttcttatggtttagttttggatgtttggtttgcagtctacttcccgcctattggcattttgaaaagcgccaacttggcacacgattattggtttttttagcggtaattgtggccttgggcgtaattgggcgcgtcccattggtggcaattcccaacgtccagttaaccagtttcgttgtcattgtgagtgccgttagtttgggccctgagttagggtttgtatcaggatcgatgatggctttagtgtctaacctgtttttgggtcaagggccatggacaccttggcagatgctagcctgggggctaatgggattgaccacggggttacttggtcggacgtcactcaaaaatcaactatgggtgatggttatctggggagcactgtgggggttttggttcggctggatcatggatttgtggtatgccttggcttatgtgcgaccattgcgaccggctagcttcattctatcgtttgcggctagtttagtgtttgatgccatgcacgcggcaaccaatgcgataagtttgttgtttttgtatgtaccttggcgcaaagtgatggatcgtttgattaccaaatacactattttataaaaggggattctattatgtttaagaataaagtaattgcagtttcattaaccacggtcatggccttaggggcagttgttccaatggtcgacgctaacgctgcgagtgttaaagtggcatctaagagctcacaaaagagtaagcaaaaggccctctatacatacgcaaagaaaatgttgaagcaaaacaaagatggactttccagtaaagctaagattttcagtaagtctgctttcccaacgactggggcggcatccggttattctgacttcttgttgggcttgaagaagcaaggctataagtttacgagtgccaacaagaagttggttaagaaaaacttagtcgtttctagcaagagcgatccagcaaccttggcgaacgcaatcatcggattacaagccatcggggtcaacccaactaagtacacgtcagctggcgccaaaaagagtctgaacttggtcagcacgttatacaaaacgtctatgagcaagcaaacagttaatgttcaaagtgcggccttagtagccgtgtcttcaaataagacgtttaagcaacccagcaaagcgaagttctccaagtcttcacttagcttaaagattgccaaaaataaacaatccaataacggttgggcatacaataatacggcggctagtgttgatagtgataccacgtcaactgtcgttaatgcgttgacaatgagcaagagtaaaaacaagaccgttacggctgcaacgaaggctggtcggagctacttgaagaaacatatttacaagagtggggcctttggctacacgtatgctggtaaggaaaatccaaatgccaattcaacggctgaagggattctagctttggccacgaacaagacggcctttagctttatcaataagaaagccatcaagagcggtcaaacggcaacgccattgaaggccatgttcagttacgtgaagtccgatggctcaatcaaaggggcttacagtatggtcttagcttacgggcaagtgagtgtggccactaatgcttatcataacgggtcatacacgagtaaattagcttacacgttcaagtaatcttacctagtcaggagcgacgatcatgaggaaaacgaaagggattattgcggcagttattgtcaccattttgctgattggtggagcgttggcatttcaacaaaatcacgccaatcaggccagtgaggacgtgacggcgaccagccagtcggtgacatcttcatcacaagcggctagtgcaactagtcaaagtcgagttaaccacaagcaccagtcttcgtcagcaacgaagaaggcccacaaatcagcgacgaagcccaagaatagtaccagttcgactaatgatcgtcctcactcgtctaaggcccaagtgaagacccagtcgtctgcagcgacggccacgtcgactaagaaacgccgagcaacgaagcaatcagcagtgacggcttctaagacggcacgtaaagctaagtcgacaaaagcagcagtggcagaaaagaaggtttatttagtagttagtggctataagaagacgttctttaaaggcaatgtggtcattcacggcagtgccactgcgttttccgtattacaggcctctaaactaaaagtggtttatcaaaatggtgcgtctgtctatgtcagcagcatcaatggattagcgcaaaacgatgtcaaagtcgggagcggttggaaatataaagtgaataacaagttcattgataaagcggccaatttaaagcgggtatcagcaggcgatcgggttcattggtactttacgacagctggttactaaaattatctgtatgtaagtaaaagcggtattctcagaagctaacattctgagaataccgctttttattaaggttggtgagtttaatcagtgggcgttgaagtaaaacggccactaactgtgtagacccagtggtcagtcgggtggttgattgccatatgtgatgatttggcaacccaggtattttgggagaccaactgattaatctggctaattcgattttgttgtctaaattgtgacggggttattcccaaggtttgtttaaagactttggtgaagtagctagtttgggaaaagcctagttgcgtggcaatttggtgaattgggatcagcgtcgtggctaactgtttttgagccaatgtaatttttggggtattcacgtaggaaacgaaatttgtttgtaaatatcttttaaacaatcgactaaggtatgagggagataagtaggcgactttagccacctcatcgagagacaacgattggtgaatgtggtcatgaatgaaatgaagtgcctgattcatgctacggtaggcatcatcgttgataagtggtgtattgagcggtactagggacgttttggttgtggttgctacattagcgtgtactaacagctgatagaaatggctgatttggtttaattgggtagaatctagtgccgcccaaacttggatcgtgtcattagcgtgttctacgaagacctgccgtagcgtatcaattaggtaggtgcgcgcaaagcgaagctgctgagctgaaacgtttgtagtgtcacacaaaatgacgccccacaagcgatgatcaatgcccaccgggaagagtgcggtcgttgttagcgataatactgttagttggtgttgactggcagttacgtcggtagtcaccgtatcatcttgtataaggacaccagtaaagctgtaaaaaagcgtcttgatctgtgtcagaccggtgaactgtgctaggccgtgggccaagtcgtgattatttttagctgttgccgaaaaaaagggcataaagggagcctccacaaataagatttgttagagtccccgttgaccctgtgatgtatccgttaacatctaaaccaattgtagtaaattcttgtgcgaatttcaagaatcacagttggattggtaataactggcggtgtcatcagccaatatttctagggtctgtgacaaatttgatgacttttattaaaaaataggagagtcaatcttagatcgataaaggtgcttacgtatcacggtataatggacttaaaataataatcaatgagaaggcaaaacgatgtatatggcaaaggtagttggtagtgttgtttcgacggttaaagacccgtcattaattggtcgcaaactaatgattgttcaaccgatcaattctgacggccagactgttcgtcaccaagaagttgcagcggacgccattggggctggtgttggcgagtatgttttgttagtgcgtggtgcaggggcacgacaggttcatcaaggcgaagcgcgagatgttaatgattgtgcaattgtagggattattgatcggtttgaccgttagatgagtgaattcggaggggtagatgtggctagacaaccgtattattttgctaatggcctaatgattcgtaattctatttgtgcagccccaatagataggcaatggggactggtcaatggtgcagtgagtcggtgggattgcgattttcaccgtcaacacgcccgctacgttggtctagacattgtgggttcagcttatgtgtctacacggggatgtaccgctagaggctcgttaagcgtggcaggtgacgatatgatttctggcttacagcggctgacgacaacgattcatcaacaaggtgcaagggcaattttacagctcgttcatgctgggcagcgagcgatcgctgtaatgcctgatgatcagtgggttgcgagggggcccagttcgagcaaaacgccaccaactcacgctttgtcggtcgcacaattggcaatgataatcgagcagtttggacaagcgacccgtcgcgccatggctgcgggctttgatggtgttgagatccacggtgccaatcattttctattgcagcaatttatgtcgccactgactaatcagcgaacggatagttatggtggtagcttggtgaatcggttacgtttaccgatacaaattgcccgacgagttttacaggaagctcagagtagtcagcgaccatttatagtgggttatcgtttatctcctgaggaacggctcactgggggcctagaattaagtgatcagttattcttgatgcgctgtttggcagcattaccggttgattatcttagtttatcattacatcattattggcagttgcccttaacgttaaagagtccgcggccaacggctgttttagctaagcgattcattccgcaagtccctttgatggtagccggaaaagtcgttagcagccgcgatctaaaccagctggctgattggcaaattgagttggttggtgttggtcgggcgttacttcgagatccacaatggccgcgtcgggtacagtcatgaaaagtaaaaggtatcactaaagctcagcgcttggcggtactttttttgtggttagaggggatgatgggacattcaatgatgaaaacgactataaataacgagaatttttaatctagcctgccattttagcattaggtaaggtactctagtagaagagaagcaaattcggttaaggagtgataatggtgacgaaatatcgctggcaagccagtgccttggtcctagtggcatttatgctaggatgtaatgaatttatggtggtgggcgtcttatcagatattgcgcgttcactgcgggtaacggtcgcaacagccgggtatttggtgactatttttgcggttgtgtatgcggtaagtaccccgctcattacaattttaacgaatcggtttggccgttatccgctgctgatgacattgatggttattttttgattgggaatacttggagcggcttcactagtagctacgggtggtttttattaacccgaatgataaccgccgcagtagccggtaccattgaatccctgattatcgtctttgctaacgatattgcgccacgggagaaacgggcgatgctgatttcttggctagcagcggggtttagcattgcatcggtggttggtgtgccagttgggacggccattagcacggcttacagttggcatgtggcttttcatttgatttcggtggttagcttagtgacgtgtctggtaatggttggaattttaccccgtcacattaagcatgtgagcggcacgattaaagaccagttggtgttgctaacggatcggcgtatttatctgggggccgcgctaatcttgtttacagccgcggcgatgtatacctattacacatatattcgtccgttactgacgactggtctggggtttggtaccacagcgctaaattggttgctctttgtcctagggattatgagtattttaggtaatcggttatcaggtaagattgccgaacgtcatggtttaaccacgatgccccggttttatgtaatggatatcggcctactgttgtgtttacccgtagcgatgcagagtcaggtggcgggcttcggcgttttcttggtcttgatattgatcattatggccgttaattccccgattcaggtccattttctggatgtagcggaagccagttatccgcaatcggttgcgttggcctcctcactaaatgctatctttttcaatattggtatttccgtagggtcggcgaccgcatcggtcatgttgacacgtgttggcttaggttatttaggctggggcgcggctgtgtttgccgtaatttcgttagtgattgtcattggattgaatcgagcaattgcggctaaaaaagcagccgtagtggttaatgagtcgaaataactggctaataggaggataaaaaactgtgaagaaatatcgttggcaggcaattgtctttgtactggttgcctttatgttgggatgtaatgaatttattgttgtcggggtactttcggatattgcgcgcgagttcaaaattcccgtggcaacagtcgggtacttagtgacaatctttgccacgatttatgcgattagtacgccatttatcacgattttaacaaatcggtttagccgatataaaacgctaatgaccttgatggttattttcctgattgggaacacgttgagtggctttgcgatgaactacggcgttttattgttatcgcgagtggtaacggcgatggtcgcaggggccattatttcgttaatcatgacctttgcaagtacgattgcaccacgggagaagcgggctgggttggtttcatggatctttgctggttttagtattgcgtctgttttcggggtgcccatcggtaccgcgattagtaccagttacagctggcatgacgccttttacttaatttcgatcatcacttaggttggctgcttccccgaaaggtcgaacaggtgcaaggcagtatcaaaaatcaattggtgttgctaaaggatcggcggatttatgtagggattgcgttagtcttgtttacggcggccacgatgtacgcttattatacgtatattcggccactattgactacggcgctagggtttagtacgaccagtctgaattggttactcttcctaattgggattatgagtattattagcaaccgtctttctggtgtgttagcagagcgcaatgggttacgcgtgatgacgcgattctacgtggcggatgtgtgcctgctcgccttgttaccggttgccttgaacagtaagattatcggattgggtgtgttgctagcgttaagtttgattgtcaccattttaaattcgcccattcagattcatttcttaaatattgcggagcaggattatccacaatcagccgtattggcctcatcactcaattcgatcttctttaactttggaatttcgctgggatcagccactgcttcaggtatgttgggcactgttggcttaacgcatatcagttggggggcagcaggttatgcggccatttcgctggtgctggcggtgatgttgaaccgggttattaagcatcaccaagcggcagccaaagcagattagttcacatcgctagtcgaaagcagtaaggtgaaattaatttaaaattaggaggttatcagatgacacaagttcctgtagtgacgttaaatgatggttatcaaatgccggccattggtttaggcacgttccagattcgtggtggtgccggtgttaatcaaatcttggctgcaattacagatggttatcggagtctagatacggccactaattatgataacgaaggtgcagtcggtgaggcgattcgtcgttccggtatcccgcgtgctgagttctttgtcacctccaagttgccaggtaagtatcaccgttacgccgatgcgacgatggcgattcaggagtcgctgtatcgattaggattagactattttgatttatacgtgattcattggccattgcctaagcgagatcattacgttgaggcgtggcaagcaatgattgatgcgcaaaagcggggccttatccggtcaatcggggtctctaactttgaaccagcgcatttagatcggctgattaatgaaacaggcgtgacgccggcggttaatcaaattgaagtacatccttactgggtgcaagaacggatgctaaaagaagacactcaacgtggtattgtgactgaagcgtggagtccattagggcgtggaagttcggccctaacggaaccagtcgttcagcaattggcccaaaagtatcaaaagaatgtgggccagatcattttgcggtggcatgtccagcgcggaattgtaccgatcccaaagtcacgtaacctagctcatcaacgggccaatttggctgtttttgatttctcgttaaccgcagaggaaattcaggccattaatgagttgaataaaactgacggtcgaatcgataatcaagatccaaatgaatatgaggaatttgaataggttgctgagatatttagcagtaaaataattaaatgaaaaacaatggcgtaataaaattattatgattttattgcgctttttttgtgcgcatgatagccaagcttaaatagagcccaccataatgcctaactaatgattcgataaaacccttgtaaataaaggatttcaaaaagttatttatagaaatatgtaacgattgcatgtaattaacacgtaaatatatataattgataattgttttccattgtaaaaaaataaatcgttttttggttgtaggtgtttgtaatttaaattaattgtgataagatatcgttgtagcataaatgttacgtaaataaaacaatatttagggggatttttcatgcgtagttcattaaagcggacgttaactatttctgcggccgcactatcgttcgtgtcagcttcaggccttgctatgagtgcatctgcctcgaaaattaagcaagttgggtcaaccaatctcgaaccaacaacagcttatattcggaattacaaggcaacgggttcaaacgcaatttacaacaaacccggcaaactgagtggttcaaaagttgtcgcttctgcatcaactgctaaggctcaatcagtgcttcgtggttacaaagttgctaagctgagcaacaagtcttactacatgaaagtggtctcatttgacggccgctaccgtggttacatttacgttggtaaaaagaatccagtcaacaacttcaagaaagttggcggcggcttaacatacttatcaacgacgacttcaactagtttaacgaacaacgataaaaaggatctgtctttcgctaagccaggtactgacacgcaaatttacaaagcgccaaagggttctcagtataaagttggggcagccgttaaggatacgactgattacaagggacataagttagttgcttctaaagccgctatgaatgatatggatggccaaaagtggttgtacgtatctgatgttaccgaaccaacgaatgctagtggttgggttttggcttcacaattaactgattacgtcgctcctaaggcaccagtttctgttgggaatgaccaaacgacagttactaagaactggcaacgtgaattctataacccagcaactgggactaaggcttacagctttgacaacttaaacttgccattacttgggacttctggtggttctaatgttaactggacgacagctgttaagaagtttaacagtgatgcaacggttaagggtgacaagaaggatgtcgtaccagctgataccttggctacagcattcaagaacagcggcttatcaactgtttacatgaaggtaacgccaacattgttagctcggattcctggtggcttacttgataagatcgatagttactcaggtctttacatgaagtttgacttggatatggataacattccaacgacgacgcactacggtgatcaattgaagttagcttacaagctggacaacactaacttgtactacaagccagttatttccttaggtggtttgacaaacactaacgccgacggttacgctgcattacctgtacaattgaatgcaatgaatacgctttggggactactttaccaataaaccgataatttcttgcataattcttccaaacaagtaactctataaagtctttggttgtagtcaccaaacctatggtgtgttattgttaaaaagctgctgaaaggggtcttaaatagtcctttcaacagctttttattcatagtgccgcagcaattatacactggcgacgatcttcgaaaggctaataagctgataccgttcctgacatacggaacgcgtatcagtttcaagcaatgttcactatatcaaataatgattagataacaatatgtcatactataattttattttcattatgaattttgtagcaaatgatattaattttgcgttgatggctaacaaaagagtaaggtggtagaaaaaatgggtgaaaatataaaccaattattgaaatggacaacgcaattaagaaacatcgatcggaatctaaacgttgtggagatgacctcacagaaggtgacattactacagttccagctcctgcatgaaattgatcagcacacgtttgatccggggcattttgttgaacgggccggggtgtctcgttcatcaatctcagtgcggattacgaatttgatgaaacgtggatgggtaaccactgcaatcagtgaagaagaccatcgtcggcacgtactgaagctaaccgaagctggcaaggaaattcacgacgatgccatggaaagtgtggtcaacagcatcgaaatggcttacgatgggcttcaagatattatgagttcccaacacgttaaagactctgcaaaataaaatgagtcagtttatcaaagtaagttgtatgccagacagtgacatttgctgacacaatcaagtggtcagttagccaatcggaagtcggtatgttgatgtatcgactgcgcaagatgaatcttaaacaaatgattatttttaatgactgatgtatgctttttggcgaatgagcgaagttaattttcctcaaaagtcaacgatcgttttggcaaagattgagttggttttatgattagcaacattattcataatctcccaataacgaggaatctgatagactttttaacgtgtattcaggtcaccagatcgactgtacaaacactgccatatttttgccgctggttgtggtcaaaatgatgtgggcgcgaggctactcgtatgctatactaggcttcagattaggtaacatagtagtgatgggggagcgaaaaatatggtaaagcgacgaacgctaacacgtgaaaaagtgttagatcaagccaatgaattgattgccgatcacggtcttaaccagttaacgatccgagcgttagcaacgaagttatcggtgcgaccacagtcaatttacaattatgtgaatagtcttaatgatttgctggatcaggttggccttcgttttgtcaatgagttgaacgatgcccttatgcggcgcctggttggtgtttcaggtaaagaagcgttatttgttttcgcgcgcgagtttcgacgcggctgtaaacaacaagattatttggcacccttattaatgaatccggatgatttgcgtcatctagaacgcacgcacatcgcactgattgatttgtacaagcagatgtttacgagcttgcatttagatgaaaagggtgcgacagggttagttgaatcgactttgtatcgatcagctttgtttggattcatagttcaagaaattggtgggtttattcgactgccagaagcgcagattgatgaacgctttgagcggacgatggaattagcaattgaccaattcacgacaattgattaattatatatagtgcatttctcaatcggtgagaataaaagtggtacttccagcggggtttagccgttagaagtaccacttttagattaatattcaaaatagttcagtttattcttgccttcgagtacactcgaaggtgtttactaaaacatgtaagcaagtaaagggggtgggtttaaatggcagagaaacgataccgcattggtgattttgctaagttggtaggactgtcgacctatacactacgttattacgaggaacaaggcctaatcgttgcgcagcgtgatgaaaatggcgtacggttttatacagaagaagatattcggtgggttggtttcattttgcatttgaagggcaccggtatgcgattgaatgagttaaaacgttacgttaagttgcgtgctatgggtgataccacgattactgaacggcgagaaatgttgcagaaagttagggacaatgcggaggcggatattgccgagttacaaatgcatctgcaggttctcgggcacaagattgattggtatgacggtaaagtggaccatacaattgccgactcagagagtttccacgattatttacaacgatttaacgatgaaaaaggatgagtttaatggttaaaaacgaacaagttaaaaatggtgtgatttttccagtaggggataaaaatgttgcttatcaagatttctttgttggacagagttacttacaggggttggttagtgatccggatgttagcgtcagtgttagtaatgtaacttttgagcctggttgtcggaataactggcacattcatcatgacggttttcaattactattggtcactggtggtgaagggtggtaccaagaggctggtcaaccagctcgtcggctacatcctggtgaggttgttgtcactaaggatggggttaagcattggcacggtgccaccaaggatagctggtttagtcatattgcaatcactgcggggacacctgaatggttggaacccgttagtgatgctgaatatgctgccttggatgaggaggaaaagtaatggttaaaaaacaaacggccggtcgcgataaactcggcgactttgccccaaaatttgcggaacttaatgatgatgtgttattcggtcaagtttggtcgcgtgaaagtgagttgccggcccaccaacggagtctgattacgatttctgcgttgatctcggcgggaaatttcgaacaattaccggcgcatttaaaaattggaaaggaaaatgggatcaccaaggacgaaattgctgaagtgattacccacttgtccttttatgttggttggccgaaagcttggtcagcattcaatctagctaaggatatttttaatgattagattgtgagcaggctgcgaaaatcgcggccttttttgtcgtcaatttattcacagtgggttaatttgaacgacaagatttattaagaggtgcatactatctattaagtaaagctgaaaaagaaggagtcgatgaagatgcaaagaaaaggcatctgggggagtttaaccctcattgtattggtgagtgggttggcatggggcctaacgaacttacatactagccaagcgcaggctagccgggccgtcaccacatataagcaatggcaaaaggcctatgttgcggggaaatcacaaaaatatgtgaaggctaataatgggcaaggggcgaccaccgcattttccgaaggtcaaggttatgggatgctggcggctgtattggcagctaaaaagggtgccaatacacggacaacatttaatcagttgtacaagtactatcgtgctcaccggatttcaagcagtctgccgttaatgcaatggaagcaaacgaagcgggccggcaagatgacaagtgtgggttctgaaaagaatagtgctacggatggtgacttagatattgcttatgccttaatcttggctgacaaaaagtgggggagcaagcaggttaattacaagcaagccgctaagaagttactggcggcaattaaagctaaagaaattaatccaacaacggcgctaccaacaatgggcaattgggcaaccagttcgtatgatcgtagcaagttacggacgtctgatttgcttacggggtacttcaaaacctttgcgaagtatacgaaggataaacgttggacgacggtcgcaaaacgtagtcaaagcgcggttaagaaattaagtgcgcgtcataagaccgggctttttccagacttcatctacgcaacggggagtggtattaagcttaaggcggttaaaccctatgcgatcgaatcggggaccgataatcaatacgggtacaatgcttgtcgcgtgccttggcgattagctcagacgtataggatgagtaaagacgctgtgaccaagcgagcattgaccaagcaattgaccttctttaacaagaaaaagaaagtgacggcggtctacactttgggcggcaaagcagttaatcagtatgttaatacggcctttacggcgccagttaactttggggcacggacgttgaaaaaaacggccctgaaaacgaagacggctaaacaattaccgaagtcgattgaaaagaagaattactactcagcaacgatccaagtattaacggcgttgcaatagtgagacgaaaaaagcagcgccacagatagtctctgtggcgttgcctttttaaatcaatggattagtaagttgaaacgtaacccttattagctgtgatgtacttaccgttacttaattggaaccggtaagcatttttactgttcttagcgattgctgtgactgccagtttcttcccagcagcgagtttcgtgctccgcttgttcttggtgaacagcgttgagttgtattcatagatggcctttttaaccttgacgccagttaccccactcacactcttgtagtaactggtagaggttgttgaagaagttgccgtaccgttaaaccaactcttaacagcactgctatttaacgttttgttcaaatcaacattcccactgatcccggaaacagagcctgaactggtgtattgccaaagatcaatcgacgttcctgaaacggatggcttggtagagctatacttggcgatccatgaaccatcaaatttggagaaatccaaatcgtgggcattggcataatattcaccggcatacatgatgagtggtttgtcggtcagactacgcatcgtcttcaaccaagcattgacgtaggtttgttcactactcttagctgagctcatacgcttttcttcatcaagcacgaagaacttcgtgtgggcgttgctccgcttgtagaagtctttagcttcttgttgggcatccttgacgctagtgaactcagcaaacatgtactgaccgaacggcacgccatatttataggcgccattggcattgacatttcgtttggaatcaaccatatatccggcatcacctttactcccgtgttggacgcgaataatggcgtatttcaaatctttagatgccttagaccaattaatattgccttgatattgtgagatatcggcaactttggtgccagccgcgctcgctgtggttgtgttaaatgccacaccaactgccataacaccggccatagctgctaatccggcaacgactttatgtaacgtaattttcatgaaaatatcctcctcagtctttggtttcattgtacacgggaagcgggacagggaggttacggacaatttacatttagttacagttcgattgcaaataaaaaattgacacctacgcaagcagatgccaattcataacggatttagttagtgagcagcgacataaatcttaagcgctagcttagcgcgatttttatcggtcgttgtaataggattgtatttagataatccggctttgaccttcttaaaactgtaaacgttgctattgccactttcaaaatacatgagatcttgcttgtttggcgagtgattgagccccataacatgacccatttcatgggcgatggtgctagcgtattcatacttacgtccttcgttagctaaagttgatttgactaagccgacgtctttctttagcgtggttttgtaagcaggtaaactagtttcaacgttgctggcttcctgattaaaaagactttgatagtccttgtcagatgtcgtaatccctttagcggccaagttggccttagccttagtttcgatcgtgtcggcatattgcttataaaaagcattattgagttgattggtcatagaaatcccaatattttgcttctcagcagtgtagtaggaccaacgaacatctagcttcttggtcatgggcgtccaccaagcatcactttgatcactcttagaagcggcagccttggacacgccaaacgtcaacgtgtgatttttcttagaaccttgcgtgaattcagtcttaccgagttttttattccagtaagccatagctagcttaacgctttgcttcaaagtcttatctttcgtgttaacgtaaacgacagccttaccattctttttcaaagcactttgcgcgtcaaaggcgagcttatactttttccccagtgcgcgggcatgcgttcggtagtaaccgttagatttcttcagtagtgccgaagatggtgtgacactagcagcttgtgcagttgtgatgctggttaccactggtgttgccaataaggtaactgttgcagcagcaatcagtgattgcgcttttaaatggtgtagcttccgcataatgttaacctccctcaaatccccaaaacatttaatatttacaatagcatagccttttcattcggcagggtcaagtcatccagacttgtaaatatttattggcgatagtggtttagaccagtcatggtatcgctttctgaataattgtaagtagaacgttcgtttgggcaagacggtagattctggtatagtagaaattagctaaaaaagaggaggaatcccaatggtaaaacggtgtgattgggcaacgaagacgccggcaatgcaactgtatcatgatacagagtggtgtcgaccagagcatgatgagcaaaagttatttgaattattgtgtttggaaacctatcaggcgggactgagttggcagacagttttgaataaacgagccgcgtttcagcgggatttctaccactttgatttgacgcaagtggcagccatgtcagcggccgacctaacccgtttgttagctgatccagagattatccgtaatcgactaaaactggcggctacgattaataacgcgcaggtaattgtcaattggccggcaccggggcagtttagtacgtggctttgggactttgtagggaatcaacccattcgccatgcagtaaccagtgcggatcaggttcccgctaccacggatctagcgcggcatatttcccgggaaatgaagaaacggggctttaagtttgtggggccaacaacagtttactcgtttctacaagcagcaggactggtcaacgatcacctgttgacttgtgattgggcaccagagaaccaataggaggaaatggcatgcgatttttacatacagcggattggcatattggaaagaagctgcacggatattcgttattagacgaacaacgtgatgcctatgagcagattaaaaaaattgccgaaaaagaacaagtcgatgcggtagtgattgccggagatctctatgatcgggcattgccgagtgaagcggcagttggtacgctgaacacgatgctggttgatttgaatcgccagcagcactttccagtactggcgatcagtggcaatcatgattcagcgacacgattggggtatggacaggaatggtttgccagtacgaacttcttcatgcgtacacggttggcagaagctttgaagccagtgactttggcggatacacaatttttcctattgccttattttgagccgattcaggcacgacaactatttgaagatgaccagattcgaacggttaatcaggccatggaacggttggttaaagcgatgcaagctaaatttgcaccggacaaaaagcatgtattagtagcgcattttttcgcggctggtggtcagcacagtgattccgaaacattggtgcaggttgggggcctgaatgcggttcctactgagttgttggccccatttgattatgttgctttggggcatctgcatcgtaaagaggcgttgcaacaagtaccaacgatgaaatatagtggatcgccgctgaaattttcgacgagtgaagccgaagacaccaagggggtctggctcattgatacggataccactccggtgaccgtgacgtttaagccgctgaaaccgctgcatgacctcattgttttgaccgatagttttgctcatctaatggatccagagcgtcattatcccgtaacccgtgatgattttattgcgattgccttaacggatacgacaccgattaccaacgtgatgcagcgcttaaaaacacgtttccctaaaatcattgaattgaatcgcacgaaacaactcacggtcactccagttgacttaaatatccagcaagttcaacgtgacccgctggccctgatgaccaccttcttcgaacaagtgacccaacatccattgactactgctcaggaaaagtgggcgcgtgagaccctgcaggccgcacaaaaggaggatgcccaatgacaccagtaactttacatttggaatattttggcccgtatcgggatgcgacaatcgacttcacccgatttatgacgacgccactgttcttaatcagcggaaaaacggggagcggaaaaaccacaattttcgatggcatgtgttatgccttgtttgaccagacttcaggtaccgatcgcaaggctccggctatgcgatcggattttgctaccgcagcggatcgaacccgtgtcacctttacgtttacccatcgtgatcggcgatatgagattattcgtgagcccgcccagacgttgaacaaaaaacgtggtcaggggttaacagatgtggcggcagcagtgacgctgacggtctatgctgatgatcgggaagtcacgcaactgacaaaaaccaaccaagtcagagactatctgcaagagttattacagatggacggcaaacaattctcccagatagttttgttgcctcaaggccaatttcgccaattcttaattgcacctagtgaagaaaaagcggcggttttagaacgactctttaatactgaaatttttgcccgctggacggaacaactcaagcagcaactaaagaaagatcaagccaccagtcagaccaccgcagcagaagttacccgattattggcgagcctgcagtggacttctgaaaatgaagaagctgcccagactctaatcgctgcgcaacgtccagagccggtagtgactttaatggcggcccagcaggcaacaacccgagaacaacaagcacaattagaacgacggttggcaacggctcaggcgaccgtagatcggttggttcgccaagatgaacaggagcaaagcctgttaaaagatcgccaacagttgacgcagtaccgtcagcaggcaaccgagctcgcacagcaagcaccagccatggatgacttgcaaacgacgataaccgcgttggagtgggttcaaactcgccaaccagcttggcaagaacgtgagcaggcacaacaggcccaacagcaacgacaggctgaccagcaacaagcacagcaagacttgatggctgcccagacggcactcaagcaggcccaagcggcagtcgagcagcatcaaaccttatcagcaaagataaccgcaactacggagaccttggcccagtggcgtgccttagagccgatttatcagcgggtagccaccttagaacaggagctcaagcaggctcaacaaatcgccgaaaaacggcagatcgcttatcggcaggcgcaaacggcttggacgacgaatcaacaagcgcaaacgcagcaacgggcgattttagaccaacaagcggagatctatgcgcggcagacgaaactactgcaacaagcaaatgacttagcagatgctcaaagtcaagcagcaaccttacagcaacaagttgggcaacaggccgacttaactcagcaagtttcgcaaataacgggacgtttacagacagcccaatcagccgcccaaacggcacatgaccgggcagcagcccgataccaggttttccttcggcatcaaattattaccttgagtgcgcaattaacccccggaacgccgtgtccagtatgtggatcgacaacccacccgcaaccagcacaggcaacggtaactgagacagccaccgaggatgatgtcaaacgggcacaggatcaagcgacacacgcgacgcagcaggctgatcaactggccgcccagttgacgacgttacaacaacaattgaacgctaaccagcaggaacatcaaacggcgttgcaagcgttacgggcccaactatcagtggcagatacgatggacctgaccgcaatggcggcgattttaacgcagcgttgccaggagcagcaacaggctgaacaggccaatcaagaacaacgagccgctttgaaacaggcacaaacacagatcacgcagttaactgaagcggccgtggaacttcaggaaaaggtgacacaagcccaacagaccgtgcaacaacaaaccacgacggttgataaactcgccaccactttgaccacggaacaacaacgattgccagctgatgcgccgactcgaacagaatatttagcgcgggtccagaaattacaggatcaattggcggcggatcagcaaatgtggacggccatagagcagcaataccagactgcccaacagacggttcttgtggcccaagatcgactggcgacagcaactaaggaagtcacacaaagtgatcagcgggtggcaagggcgcaagctgatttggccgcacagctcgctcatccggtcgcgccgttagcgacggatacggaagcacaagttgcccgttggttgcctcaggttgcgaccttgccagttaaacgagagcaactacaaacctttcaagcccaacaggcccgcctagcaaccctgattgaaacgttgtcaaaacgccttcagggacaagccaaaccagatcgtgaagcaacacagtcggctttaatcgaagccaaccaggcggtcactaccttacgggagcaagagcgccaattgaaaaacttattagagcaaaatgagcaagcgacgcagcgattacgggcggtattagaccagcaagcaacggcacttcaacaaacccaagagctgacggaattagcaggtgtggtcaatggtgatggaccaaatagcaaattgggattagagcgctatgttctacagacatatttgcgtcaaattcttaccgttggtaatcagcgattccagcaacttactaacggccggtatcaatttgttattgatgaaacacctgctgcgtctaagaaacgctctggattggaaatcaatgtgtatgacgaccatgttggcgaacagcgaagcgtgcatacgttatcggggggcgaaagttttatcgcgtccctagcgttagccttggcgttaggtgaagtcatccagcaaacgacagggagtgtagatgtggatgccttgttcattgatgagggctttggttctttagatgaggatgctttaatgacagcattggaatcattagaaacgattgagggacgccaccggatgattggcattatcagtcatgtgagcgaacttcgtgaccaagttgccaatcaactacaagtggttgcgaatggcaacggggaaagtacgattcgttatcatgcagcggattaatttaatgatttgggaccgaaaaaagcgttcagggcgaaagccgtgaacgcttttaaaaaggagtgaacgcatcctaaccgggaccaagggggggagtttaacggtggatcgctgtaaattaactgtcgataacagttttgctttaggatgattttagggggatggctagacaatctgacactcaaaatttgggtgaggatggttgcttcttttcacctctgagaatacgcagtttggcaacgaataaatagccagatgctttgattttaagggatttatcccagtttagttagtcagcttgcgacagtgacctaattttgctagtccatcttttggcggcaagatgactggatgtttgaaccatcgtttgctttcatcatgttgttgataaatgttttaaaaaaatcgcacatagtttcaacgatttttcgtgcagaatcacagtagaagcgttagaatggggagtaattaaatgagaagcgggatgatttttaatgtgtacgagtttgacttatgaaaacagtcgtggcgatcattttttggcgcggacaatggattttgcttttgaactgggtggtcaaccgatctttatgccccggcaacaagagattagcggggatgctggtacgttcacaacaaagtatggatttattggtgccggtcgaaatttaagtcattatattttcgtagatggtgtcaatgaatttggcttaggtgctgcggctttgtatttccgcggttatgctaagtatcaacagtcggcaccagctgacaagctggcaatcgcccctcacgatgttgttgcttgggccttaggtaacgcccagagtgtggctgatttacgggaattggtcaagcacattcaaatcttagacgttccggtatcgcttttggggttgactacgccactacactttatctttagtgatccgacgggtgacacagcggtgttggagacaacaaatgcggatctgcatctgattgatgatccagtaggggtaatggccaactcgcccgaattaaattggcatctgcaaaacttgagtacttatgggacattacaggcggccgaacggccattacaagatcgcttgggttatcagttaccaacgcaaggaccaggaaccggagctttagggttgcccggtgattatacctcgccatcacgatttgtccgtacggtatttaataagcactacagtgaagcggcagccgatacaccaagcacgctgacgactctgcaacatttattagatggcgttactatccctaaaggggttaagttaatggcagatggtaccagtgattatacgcaatatcggggctatgcttgtttagacgatcgggtctattacatggagccttacgataatcaagaactacaagggattcgcttaaccgatgagatgttaaacgattgggatacgcccgtagagtaccccttggatcatacgccacatgtgaagcatctaaattaacctaaaaagcgttacacggaaatttccgggtaacgcttttttgagattattgacgtaataaggtgtttgcccgtgtgataaagtctgtaatcaacgcttggggaccacccaaagcgacgacagctcgcaatggcatgttcataaacatgcgatcctggaagatttgtaggcttccttggtcatctgtaatggctaagaagttttctggaccagcatattctggtgctaaaacaacctgcttgaagagatcacgtaattgtggatttttaacaatggctgccatataggtttcggtcgtgattggcgccggtgaatttttgaaatccatcgtgagtttaacttgcagacgaatgtcgcgagaggactcaccaatcatgacttcgtagtcgccggaatcagcttgccaacgagctttgggttcgcaccaccaactgaagtcacgtcgatcaagcgctagagtgaccgtttcagtctcgccaggagcaatggcaactttggtgaaggcacgtagctctttggttggcatgggaacgtgggaagcgtgattagcgatgtagagttgcggtacggcttgtcctgagcgcgcacctgtattggtgacgtcaaacgtcacggtggcgccgcgttcgttttgagttaacttgagattcgtatattcgaacgtggtgtagctgagaccgtgaccgaagggaaatagcacgtgcatttcgtgtgtatcgtagtagcgataccccatgaagatgccctcggtatagtattcgtgatgggggtcttgaccaaatgtgggcgccattggggtatcagtgagccgacgaggaaaagtttcggtcaaatgaccggaaggattaacggtgccagtaataatatcccaagtcgcttccccaacagcttctccggccagataagtttcaacaacggctgctacgctgtgaatccatggcatttcaaccgcagagccattttgtaacaccacagtggtatggacattggctttggccaaactgccaattaagtctgactgattttcgggtaacatgagggagaccttgtcaaagccttctgattcggccgcctttggataacctgcaaaaataatgacatgatcggcggtcttagcagcggttaaggccgcttcagcgaggtcgccgttggtttcgctttgatcgagacgataaccagggtagtagtcagcttttaacccactaccggccagtgcatctaatggggaaactaatttagttggattaacatgggaactgccagatccttggaaacgcggattttcagccagctcaccaatcaccacaactttgccagttgtttgtgggtctaaaggaagttcatcttcatggttctttagcaagatgataccgtcatccgctaactttcgcgcaaattggtggtgagcagcgtgatcgtagggttgcgcatggtcggccggtaaccaatcatcaacgacgtgcaagaggtgacgtaccgctttgtttaaagtcccttcgtctaattcgccagtgtgaactgcgcgaatgatatcattaactgaagcctggcccttcccaggcatttcgagatctaggccagctttcaaggcttgaaccgtattggcgacagcgccccagtcggacataacagcgccatggaagccccattcatcccgtaagattcgccgtaacaagcgttcattctgtgagttgagaacaccattgattttattgtaagacgtcataatggttgccggataggctgatttgacgatgatttcaaaggtacgcaagtagagttcacgtagtgttcgctctgatatatcactagaggcggtgaaacgttggttttcccggttgttcgccgcaaagtgcttaacggctaccccaacgtgttgggattggaccccctgaacgtaggcgctgccaagcttcccagcaacgagcggatcttcagccaagtactcaaagttacgaccacccaagggtgagcgcttcatgttaacaccgggtccgagtaagagactgacctgttcggcgcgcgcttcaattcccaagtgttccccaagctggtgcataagggattcattccacgtgctggcgcttaacgcagcagccggataggtaatggcctgaatggcgtcattgatattggtggttccagaattaatttgtttccgtaatccagaaggaccatccgtcatcattagcgctggtaaatctaggcgatcaactgctgcggtgtaccagttatttttaccggaaaccagagcagccttctcaggtaatgtgagttcagcaagcgttcgttcgatgtccatacgttcaaatcctttctttttgttcaacttacctctagtataccgttttcatttagtagatgttagcgtggcgttgtgaattttacggagctaattattttgtcgagagataggcgcggtagatggggagtttcggggtgcccgggtgtccctgctgaaagtttttctttgacaaatttaatggcttaaggtaactttaggtttgtgcaatccaattaataacaaaaagtaaggaggaaaatcacgatgatgaacctgacaacccaaatgaagatgatctctgctgcatgttgcgaatgtaacgtgccattttgtgttgctcaaaatcgtgattttccggctaaaccgtagcagtacataacgacaacgcaggttgtcagtgtagcgggttatcctttcacgatgcgagtgaagggataacccgctttttcgtgttttaaattgaattttgcggattgcacaccacaaatttgagaaagaaaaggagtcaagaacacatgaaaaaatggactggaatgggactagttgcggcagttattgcattagggatgggcttggctgcttgtggacaatcaacatcggctagcaagccgcagcaggtcttgcggctgccagcaacggcggcattagacacgatcgacttggctaaggcaaccggctatgggcagacaggaaacgtgtttgaaagcttttatcgcttgggaaatgatggtaaggttgcgccgggattagctgactcagcgaaggtgtccaaagataaaacgacctggacatttcacatccgcgacaatgccaaatggagtaacggtgataagattaccgcccaggactttgtctactcgtggcgccggacgttaacgccggcaaccaagtctacctacacgtatcttttctccggaattaagaatgcagataagattattgccgggaaaatgaatccgaataaagtgggaattcgggccaaaaatcagcagactgtggtgattcaattagataaacccatggcttactttaagattctcatggcctatccgctatttgccccgcagaataagaaggttgtcgaccagtatggcaagaagtacgcgacaaaatcacaatacatggtttacagcggtccctttaagattaccgggtggaacgggacaagcaatacgtggtcgtttgtgaagaataatcagtattgggacaagaacgtggtgaagctacatcagattaagtatcaagttgtgacaaacccacaaactggattgagcctgtaccagaataacaagctggactttgcacagctgtctaatgaacaggtcaaaaattacaagaataataaagcctttaagcagtatccttactccattgtgattcatttgaagtataactttaaggacaatgatactcagaagcgtaagatcttagcgaaccaaaatattcgccaagccatttcattgtcattgaatcggtcacaattaacagagaaagtgctaggcgatgggtctgtgaacccaacgggatttgttgccagcggattagcgaagaatccaaaaactggggtggactttgctaaggagcaggccgtaaagaataccacgacctacaacccaacgttggctaagaaaaagtgggccgcgggactcaaacaattgggaattaagcaagtcaagttgaatattttagccggcaatgatgatacatcatctagcacggtgacgcagtatctgaagagtacgctagaaaagaatcttgctggatttacgttagatattcaaaacgttccagcgtccgtagcacaatcgcggtcgcaaaatggtgattttgacatttacctttcacactggggcgcagactttaacgatccaatttccttcatgcagattccagttagttcaaattcactaaactatggcaaatggtctaatcaaacttacgacaaattaattgatcgggcgcaaaacgcagatgctgggaatgcggaagcgcgttggcaagatatggtgaaggcctcacaattaatcaacaagactcaaagttttacaccgctctatcaagccgactatgcttacttacaacggccagatgttaaaggaattattcataatacagctgggacgcagtggagttataagtacgcttatattaaataaatcagtgggataagtcatcacaacggttatttccggttgaactgggaaagtccccttggtatattgaaagcaagaggggatgacaacatggcaattggaccgcaagatggccgtgactggacgagtaatgggacggccgactacgatgcctattttgggacaccgacacatgatgaccatgtgttgtttgaactactgacagtcggtgttttccaagtggggttgagctggcaagcggccgcgagtaagttgccggtttatcggcgtctctttgcagaaatggtcccccaagtggtggccgggtttgatgaagaggtggacgttgagcggattgccaacgatccggatatgattcggaatggtcgcaagattcgtgcggtgattcgcaatgctcggggcattgtcaaaattcaacgcgagtttgggagttttgcagattatttatggcagtttgttaatggaacgccgtttctgttaccggcagtgacccgcgatgagttgaccaaccaatcggccattggaacggcagtagcgaaggatctaaagcgtcgggggtttagctttgtgggccccgtcgtgacccatatgtttttgttggcggcgggcatcttacacgagcaagttattgatgcgtaagtgaaatttaggtgagaaattagtttgacgattaagtcgtttaacgctcacattaataagccgataccagtctagtcacccgtttatatgaataaatttattagcggtttgtcttgacaccgaattaaagttgcattagacttactgataaattaagcgattgaaaacaatgtgatcaggagagtaaccaccgtcaatggttcgtagagagttcgtgatttgctgcaagcgaataacccacggcggggtgaagatggcctgaaatgaattggtatcactgagtctgattgatgaggtgataatgtttggcactcattaccgtgcacgcacttcaaggcgcaagctggcgagtgttaatgaggggccagacatttttgtctgacttgaattagaatggtaccacgacaaagttcgtttctattaatttaggagcggactttttcttttggtcactgttttcaatcgtggcgtttctattagggatattaaatcaaaggggttttgaggatgaagaaatcatttaagcattttagttggctattattgttattgattccactgttgattgtgtcaggctgtggtaagtccagcagcaagacggttaaggtcgggatcatggggtccgacgaaaagatttggaaaccaatccaaacgaagttgaaaaaggaaggcatcaacattaagttagtgaccttcactgactacaatcaaccgaacgcagcgttgaccaatcatgaaattgatctgaactcgttccaacacacgtacttcatgaatacctggaacaaggctcacaagacgaacatcgtttctattgggaagacggtccgcgcaccgctacggttatattccaagaaagttaagactgtttcagccatcaagaagggtgatcagattacgatccctaatgactcaacgaatgaaggtcgggcattacatctcttacaatctgctggcctgatcaaggtcgacaacaaggtgtccttaccaacacctaaaaacattaccgaaaacaaattgaagttgaagattacgccagtggatgctgcgcaaacaccacgttctttgacggatgccacggctgcgattgtgaacaacgaatttgcctctgaagcgaaattaccagatagcgaatgtatctacaaagagaagttgaacaaggcctcaattccttatatcaacatcattgccaccaacaaggccgacaagaacaacaagacttacaagaagatcgttaaggcttatcagacggctgaaacgaagaagttattgaagaagtactaccatggcttgtccattccagcttggtagatcgtcagatcataagtagagaaaatgaatttgccagcatcggcgagtaaggagaatgaagtctgtgactaatgaagcgattattcagttaaaagatatcgacgtgaccttccacaataaaggtcagacggttacggccgtgaaaaacgtctcactaacggtcaaccgtggtgacatctatggggtcgtcggttactcgggggctgggaagagtaccctcgtacgcgtgattaaccggcttcagcagccaactgctggtaccgttgaagttaacggccaagatattttgggcttgccatcgaaggaattacgggtggctcgcaccaagattggaatgatttttcaacactttaatttgatggcgtcacgaacgattgccgacaacgtgggctatccgctcaaaggtggcactttaacccgagaagaacggcaaaagaaagtcgcacatttactggaactggtgggcttgacggaaaaggctacagattacccggcgcaactgtccggtggtcagaagcaacgggtagcgattgcccgggcgttggcgaatgatccagagatcttgattagtgacgaagccaccagtgcgttggacccgaagaccacttcgtcgattctcgaattgctgaaacgcttgaatcaagagctgggtttaacggttgttttgattacgcatgaaatggaagccgtcaaagaaatttgtaataaagtggcggtgatggatgctggcgagattatcgaacggggggacctggtcacaatctttagtcagccacatgagaagttgacgcaagactttatcaatacggcgacccagattaatcaggcgttgaccaagatttacaagcaagcgcaaacgctcggcttggatgatcatcaacaattggttcagcttcaatatgtaggggccagcacggatgcaccattaattacggaattgtataagcggtttgaagtggtttcaaatattctgtacggtaacgttgaaattttgcaagacacaccgcttggcaatctgattgtcgttatgactggtgcgcccgataaattggcagccgcttggcagtattgtcaatcagcgggaattaccgtgacgcatctacagccaacagatccggaggtggcctaagtgaatttatttgcaaaatatttcccgaatgcggtcacgatgaagagtgattttgttcaggcaacgggtgagaccctttatatgacgttctttacggcggttgtcgccggtattgttggaatggccattgggattgggttaattgtgacgcaacctggcgggatcctagagaatcgtgtcgtttacaacatcttagataagctggttaacctctgtcggtcaattccctttgtgatcttactggccgtgattgcgccattaacgcggatcattgtgggaaccgcaattgggacgacggcagctatcgtgccattagtcattggttcagcgccattttatgcgcggcagattcaaaatgcgttggctgaggttgaccgcggcgtgattgaagctgctgaatcggtgggttctggtccgattgcgattatctttcgcgtctacctgcgtgaagggttaccagatattatccgctcgtcggtcctaacgctgattagtctgatcgacttaaccgccatggctggtgccatcggtgggggtggccttggtaacttggcgattaacgttgggtacagtcgctttgaaagcgacgtaacgttcctagcgatgttgattatcctggtcattgtctttgccattcaattgattggtgatttgtgggcccgtaaagtggaccataactaatgttaaatgaaaagcggtgttccttgaatttagggaacaccgtttcttttagggttttgtgcgcctaagccagttacttttagttgtgatggtccgccctctggtcgcgtcaactgggctggaacgtaccggacacgactttaagccaagaaaatcccttgtcttaaagctcggtcttatcctaagcgcgccaatgacgcgccctaaggataatgacggtactgaacccatttgccgcttcccgacgggctactggtgtggcacggtaacattggttaagcattactatttcgttattttggaagcattaacttaattatttgtgagtgtcagcattggtgtgttggttactactcgtgcccacagtaactcacatgagacgcgtgtttggaagttggtaagtcaattttaaattagacttgaacgggtcgctaacagctactaatttggctaaatattttttgtcatttcagtatttctgtcgattttaccattaaattttcattttccttcggtaaaatatgaggattatgatgcataccgcagtggtgtgggagagaaaggattatcagggtttggaaaattcaaaagcaacgactgaaaatgtcatgaagggaatcttttgggccacaatggcctcagccatgtgggggatttctgggacagtcctacagtttatttcacagagtcaagatattccagccagttggttcttgtcaacgcggaccatgggcactggaatcgtgctactagtggttagtttagtgatgtacggcaaaaaaacgttcgctgtttttcgtagtggtcgcgaaattatgtggttattaacgtatgccatttttggtttgggggccaacttactgaccttctatatcgctgtgcaaactgggaatgctgccgcagcaaccattctccaatacctgagtccactatttattgtggtgggtagtctggtcttcaaacatgaccggcccttacgcagtgatttgattgcgttcgtcgtcgcgatggtcggggtctttctggcgattacgcggggacatatctcccaactagcgattcccttgaattcgctcctgtgggggattggttccgggattacggcggcctgttacgtggtgttgccacgaccgttggttaaggatgaagggcatgcgccgattgtagttttgggctggggcatgtttctttcaggcattgtgttcaacctttaccatccatttttcctgaatacccccccaattactggcggcttggttgcgtcaatgagtacggttattttggtaggaaccattctcccattctcactggtgctctatagcacgcattttgcgccatcagatgtgattagtattgtggatgcgacccaaccagtcatgacctttattctgtcaattattttcttgagtttgaagattacggtcgcagaagtcattgggtcagtacttgttgtggtagccatttatctgctacaacgtgggcgtcggaaaattgaaacaccatttgatgaagtctcttagaaataaaaaatctccctgcccattggcaaggagatttttttaggttaaaacagccggttacttcttaaggttgtcttcaacataagaacgaacatcagcatcgctcttagcgtcgatttccttcatcgaagcttcagtttcatcggtgttgtgaccattggattccatgaagtgattccaaagggcatcccgaacgggttcctttgaatcagaccaatcaaatacttcgttcattttttcatccaataaagcagtcttttctacaacagccataaccattacctccaaaaaaatattggggtcagtgggtctgtgattggcatggagaccaccggcttcatttctcatagtagtccttttcagcaaaaatggtaaatattttgttcatcagtattgttcgttgacgtttaggggcaaaaccggcagaataaaggagcaatgaccggccaactttggccgagaaagtcagggataaacgtgaaatatcgtcaattaggtaaaaccaattttaaggttagtgaagtttctttgggtacttggcaattggggtccaagtggggcgacccctttgatgccaccgatgcgcagaatacgttggcggcggcttacgatgccggcgttaatttttatgataccgctgatatttatcaagacggtgccagtgagcaggcgttagccaagtttattaaagataagaaggacaaggtcttcgtgtccacgaaggtggggcggaagctagatccacacgttgctagtggttatacagcagccaatattaccaagtttgttgaagccagcttacagaacttagaggtggatgccttggataatgtgctcttacactgtccaccaaccgctgtttattacgatcccgaagtgtttttcacgctggatcagttgaagcaggctggcaagattaagaattatggtgtcagtgttgaacgggtcgaagaagcgatgaaggccctggattatgacatctcagcagtggaaattatctataacatgttccgcctacgaccggccgagaatttcttcaagatggcccaagccaaaaatgtcgggatcattgcgcgggtaccactggcgagtgggttgttgagtggtaagtatacgttggataccacttttggtaaggacgatcaccgtagctttaaccgccatggtgaagcctttgaccagggtgaaacattctctggtgttgattacgcgaccggtgttcaagcagctaatgaactccatgagcggttgggcttggcaaccccgttagcgccactggccttacgttacattttaatggccgatgcagtcagcacagttattccgggcgcgtcaaagcccgaacaaatcgcacggaatgttgccgcagccgacttgccagcatttacacctgaccagatggcaattgtccgtgatgtctatgaaaagtacctaaagaatcccgttcaatataagtggtaggtgaaaatcctacatgaaaatagacctttcaagcgcttaacggcgattgaaaggtctatttggtgtaaatgatgaattttggtcggttactggaacttacgcctaggcaacctgtaaatctaatacccagttatccggttgggcattttgattgagtttagcgggatcgttaatcagatcatcattaactttcacaacggttcctgcgtaaggtgttttaaagttctcgacggccttgtcactttcgacttccaagatgtcatcaccagccgccaagacatcgttgaccataataggtaagtcagcaaagctaatatcgccaatttgttctaaggcgtcactagctaggcctagccggtaatggccttggtctcgttgttctagccagaccccatctttaactgttagtgtgggggccggggtgtggcgaccgtgaatccagttgttgagacgttgccaaatggttgcttgcgtcatggtgaattcctcccaaacatcagcttaataccctttagtatacgctttcttgtcagtgactgacaacaacttgcttaagttgttgcgggctagaccttatgctaaacttaatgcaaattagtgtgattagaagggagcaacagccatgtttttaatcgatacaagtcggcaaggacaggtcgttacggatgctgtggttaatcagtcaattgataactatctagtcaacgatttaaaactacccgggcacggtctgatgatgtatgtcaatcaaccagccgtcattgtcggcattaaccaaacggtggctgcggaggtggattttcactatttagcagcgcatcacgtgcagctagttcggcgaacatctggcggtggggccgtgtatcatgatgagcggaacttaatttttgaacacattgttaatggcgatccccaagatgggtcaaagtttggggattacacagtatttgcccagccaattctgcgtgcattgacggcgatgggcgtggccgacctgggaattagtaacaaaagtgccttgacggttgacggtaagaagttctcggggatgacgatgtttaagagcgggaatggttatgctgctggcggcacgatcatgtatgacttgaatgtggcggctgcgcaacaggccttaattccggccagcgatcggccacatcgcggtgtggcctctaaccgggtgcccattaccaacttacgccagtatttagcgccagcctatcaagatttggacattcaaagtttccgtgaagcgttattgtgccacatttttgaagttgagcgactcgatcagattgagacctatcatttgagtacgcaagattgggcaattattgaccaacgattagatgaaaagtatcgcacggatgcgtggaattacggtgctaatcccggttttcgtgattaccgtgccttatcactgccaaccggacagttgcacgtaaactttacgcgacaagctgggcaattaaaagcggttgcgttatttggaacggtggggacgccgacggatttacatgagatctcagaacaattagtgggaacagcgacaactgcagcagcagtgcgaacagttttgatgatgccagcgatcacggccatcctagggccggcagctgttgaaccattggtacaagtgttaacggaggatgcacatgaaggctaagtacgaggtgaatcaatacatcggtgtgccagttcaggcaaacgcctctggaacctatgagattaaacgcgaaccggatggggactttaagctccattcttggcgaacgggacgtcacagcaaggggaagttcaccggggttggccaaatttttttaacggaaaatcatttgaaagtcgccgttgtggcggtatcccccgtcgcttataaggaacgtcataactttacgccgatgcaacgcttgaccagtgaacgggtcagtgacgagttgctccaaatagcccaaacgcatctgaattaatgggaatcgtgaagcaaataaagatggattaactatggttacaaaaagtgaaaacagtagcaggatacttgagcagtctttaagaacaggtttgatcaaaggtattgattataaaaggatcgtgtacgcagttgcgactgggtacacggtcctttttgctttaggtaaggggttttgggcgggtaataagtgaaaaaataacgggatgttaaataacgtgctgaatgacatgttaaaacgaaatataagtgatataatacttgttgaatagttcaataattgatgaatgtttgttgggaatatttttattcaatttttatttttgaggaaataagttgactagttatatttttattattctcattatgttgaacacgggctaaaaagcaatcgatttaatgttagtcacatgtacaaaaatttttggcctaactaatctatctaacttatatctgttacaggtttgaattttggaggtagaatcatgcggaatcgtttaaataagatgggactagaaggcaagacgcactataaactttataaatcggggcgaaactggatagctgctggtatcaccgtattttcagtcgggatggggttagcctttagccaaactgatcaggtacaagccgcaactaatacaagtgctgatgagatcgaaaatagtgctactgtcagttctagttcaccaacagaaactaaaaatacagtcgtgttgaacgccagtagtgcggccgcaacatccactgcagctagtaaagatgatgccgctgccgcaacatccgttgcaactgctggtgacagtcaatcgacagtaacttcggcagcttcagccagtcgtgcagtgtcaggggctgcgatggaggccactgccagtgactcggcagcaacacaaccaacggcctcaagtgcagatagtcaaagcgcgcagagcgtttatgagtcagcagcaagtggtactaccagtcagacagctgctagtcaggaaagtcaacaagttgctgataatgccgccagtgacgctgcttcttcagctaccacggcgactaatactagccctttgccaaagataaagatgagtcgggccatgaatgctacagctttggctagtgaagctgaggccaagcccaccgtatcgttagtaactacggggaccgtgtcgatgaactatggcgatgcatcgctggcagatctagaatcttatattagttctccagatgagacgccagttaacgacatcgcctactatattcaagatgcagcgggcaattacttagaagatgtaaatggaaacaaggtcaatttactatatgcgctctttctggattctactgaggtcaatgattacgttgatattgtgtatactgatgaacatgggcaagtcacgaaatattccggagatgtggacctttcaacgcttacccaaattggtagctatacagtgacgattaatgatgcggggaaagctgcgatgaaccgggttatgcaagactataatgcttacgataccttgaccagtgatttgaatggctttatccccaccttttcaactggggccgctgattatagctttacagttaacattgtccccataaaaatcacagctaccactggtataaatgggttaaatatgcttcgactttcgcagtcgtatacgggatcattgacaatgttaccggtagtcactattaaaaattcacagaagcgaaatatccttcaaattaacaacggcgagatcagcgatgcccaactaggcgtagccggcaaggtcggtcaacgtattttaacgctagcagactttacttatacgtatcaaggcaccgaaactaacttcaccggggcagacgctggccaatatacaattacccttaatgacgctggtcggaaggcagttcaagccgcgttggggtctaattatattctggatgacgcggcaacgttcaccacgaccggcacggtgaaggctgctgatctcgggctaacggtagcgagcgatacagtgacctataatgggcaggctcagggaacatctgtggctgtaacgagtggaactgcgtacgatcactttgactttaccacgacgactggcaaaaacgttggtacctataatgacctgacttacgcgttaacggattccacgcaagcggcaattttagctaagaactacaatgtcaccacgacggatgggacgctggtaattacgccggcagagctgacggtcacagtcaacgatgatcatgtggtttataatggacaagcgcaaaaaacgacggccactgttacgagtgggacgaactatgatgatttagcgtttactgccgttgcggcggatggcagtggcgcgtctgcttatacgaaggtcggcacttatgccatgaccggaaccacggcagccgataccagtaattataaagtttcatatgtcaacgggacgttgacaattgatcctgccaaagcaacgattacgattcccaaccaggtctattgggctgacggaacgcaaaagagtttgtcagcggtggttaccgggaccgttaatggcgagactttgaagtatcgtgtgactgacggcatgagtgcggttggaactaagacaatcacggccactcctgacgccaacgattcggtgaataaaaactatacaatttcggtcgttcccggcaccttgaccattggtgatattacggttaagtacctttacgagcatgtggatgccgatggtcagactcagatagatgccacggaaattggtacagcggcgcatgccacggacgcaacggccacggactatttgacctacacgacggcagccaaacccaagacgggctatgcgttagcgcccaatactggactagcctataatggcacgttaactgatcagggtgggaccgtgacgtatctttatttggccaaaaatgcaacggcgacggtgacgtatattgatacaacgactggtagcgtccttcatactgaaaatctgacaggcatgcttgatacgcagtccagttaccaaacggctgatacgattgctaattatgtgaagaaaggctacgtactagtgagcgatgactatccaacctcaggtgctattttcagcgaggacagtgctaattataccgttcggttagctcatgcgactgacgtaacagcggagactaagacggttacgcagacagtgcattatcaggatagtacgggcaaaccactacacgctgacacggtaaacacgattacctttacccggactaaagtggcggatcaggttaccggtgaagttacttatagtgattggtcatccagcaagggcggcaatacttttgatgttgtttcggtaccaaacgtttctggctatcggccagatacaacgaagattcaagccgtaatggtcacaccagccagtgctgatgatgttcagacggtgacttattcggttgcagagtctggtactgggtatgatgtggttaatcccaaagtaccgggtgacccaatagctgaaccagaaccttatgtgccgtttgccggaactaaaaaagttaaggcgggcgatacgggtaaactggttaataagcaaaaggtagttaaagcgggtgccgctgttcagactgctggcaaacagacagttaagctgtctgcgactaagtcagtcaagccagtcaaaacacaagtagatgcaaaccgagttaaccttaccgagactaagcgtttgccacaaactggtgaggcacaatcgcatacagaaacggcgggactaattggattaggcctagcgacattgttagctgggttggggttaggccgtaaccggcgaaaagaagattaagcgttaaaaagaaggccactcaccagttgatgagtggccttcttttggtgtcacttcacaaagtaagcgcctttgaagttcgattgtgtgccgacagtattgtattgtacgccgttaagcttaggattaatcaaataggtgctggcgggttgaaggagtggggtaacgctttgatttttcatgagcacaccttcagcctttaacagtgtattccaacgccgattgttaaaagcaggggcattgctagcctgagcaattaagcgatcataaatcggattagaccagctaccggcgttggcggtatttgtgctggtaaagagggcaagcatcgataacggatcagcgtactgggcgtacttggtggtcaatgacaaatccgttttggctggtggggtagcttgatcatatgaccagccacgtttctttaacttaattgtcagacccggaagttgacgcatcaattgttgtcttagggctcgggcaattttgccactgtattcggcatctagatagcctaaggtcaaggtgatccgtttgagatgagcccgtttaagcgccgcttgccactcgcgtttggcgagggcaggattataggcgagtgtttcttgttccggttgtgccgccgcaaagtccgccgtgccgcgttgtccgcgacttagaccggctgggaccacgccttgggccgtcaatgaggttgcgccgtaagatttttggcttagtcgcttgcgattaatcgcgtgagaaatggccaagcgcgcatttcgctgggcaatcagttggttcacttgagaccgcgatccttgcttacgataactgatgaggaccattcgcgagtatggccgtgccgtataggcagcttgcttttcgtagagcttaatattcgctgcactttgaaggcgaacttcatctaaacggccgttgcggtaatcatcccaggttttttgccagttacgataaacggtcacattaatccgttgaaggtagacgtgttctcgatcccaatagtggggattgggaaccatgtgccagtgtttggcggtatttcctttcgctgaaaccatgaagggaccagcgtagacttgatattgtggcttggtggcgtatttttttccgaatttgtgggcgacccgttcgttttgaggtccaaataacggataggtcagtcgctgtggtagttcggccatgggatggtcgagatgaacgactagagtgaacttattcggcgcactgacgccaagttttcgggcgggaagttgaccatcgagaatttgccgagcattgtgaataccgacaaatagatccgcgttgggagctttagtccgcggtgacagggcccgacgccaggaaaagacaaaatctttagcggtaatgacgtcaccgttactccaataagagtccttccataacgtgaaggtataggttgtcttgcgggcgtttatttttacctttttggcgagtgctaattcagcttggccctcaccagtagttgaatagagtccctcaattgtattgtttaaccgaccgaattcagccattttatccgtatctaaggtagctaatggccgaaatgtcgacaaattcagcacttgtcgtttcgtcataacgcctttactatcactttttgaggtggtttcttgcgccatcgtgcagccggctaggccactgcagatcacggctaatataaaaaagaatccccaacgtttcactttaccactccgttatttagcttatttcttccctgataataggggacgccagcgaccgcgtcaagctttacttgtggtcaatgatagaattcgctagaataaggaaaatactttgagaaaagaaggacgacaacatggaaaagtggtcgacagcgaccattcgcgagttccgacaaacgctactggcttggtatgatcgtgaaggtcgggatctgccgtggcgacacgatcaggacccgtatcacgtctgggtaagcgaaattatgcttcagcagacacaggttcaaacggtgattccgtattatctaaactttatggcgatgtttccgacggtagctgatctggcccaagcaccagaggaacaactgctaaaggcctggcaagggttggggtactattcacgggcccgtaaccttcaacgggcggcgcggcagttagtcgatgattaccggggaaaatggccccaaacggcggctgaattgctagatttaaccggtatcggtccgtatacagcaggcgctattgccagcattgcgtttggcgaagtcgtgccggcagtggatggcaatgctttccgggtcttttctcggttattgttgattgatgctgatattgctaaaccgcaaacgcgaaagctctttgaacaggtgattcagccgatcgttgacccacaacgtccgggtgcctttaatcaggcgattatggatttaggatcaagttatatgacggctaagaattctgacccagcgcattcacccgtgcgggcattcgatgcgtcgtaccgtgaaaattgcgtggctgattttccagtaaagactaaggcaccacggccacgaccggttccttattatggtttgattgtgacgtcacccgctgggtatttgatggtgcaacgggatgcaacacaaatgctcacggggtactggacgtttccgctgattcagcaagcggatttacaagacgcaactgaccagcaaccggcgacgctccagactgatatagcgcacctggaacaacggtttatgaccgactatcaattgcccatcacactgacacccttgagcggtcaaccggtgagtcatacctatacgcatcaacggtggcaggtcaaactactggtcgctgaattgtcatcagcagcggatttgacgttttatcctggaaaatgggtagcggcatcgaccattaagacgttgcccttgcctaaagttcaggagaaactgatgacgcggtaccaaaatcagggacatccggcggcttttaagcagaactagtttgcctgaccgtggttttgcagtatcatcaaggtaaacgagaattcgaggggggattatcgtgcaaacgatttttgatgtgttaaagcacgtatccattaatcatcaagaagtagagagcccacaggtagttgtgacggatgaagctggcaagcctaatggcctattgacggatctattgcatgacttgatcaacaatgccttattatttgtgacgctggctgacctggcctcagccgatgagctgattgcccgtttagagacgcacacaccacttccagccgatgtgctggctgagtaccaaaaaatcttatcagagccgtgttatgggcttaattttgcgccacagaagggcaaaattgaattaatcgtccatcgttaggaggcgcgcaggatggctgagctgattgaaacgatgcctggtgcgaatacagaacccccggtgttgttactacagggaacgggggggactaatcaagaaatgctggcttttggccggcgattagccccacaaagtccgttaatcacaattgccgggcgacagggtgaaggccaacagcgacaatacttttcgcaaacggctgtgggccccgtggacgaccaacaagtccaaatggaatcattatggttgggacagacggtgcagcaagtgtgccagtcacgacattgggatgccacgcgattaattacaatcggttactctaatggtgcagcaatggcggcttatggtctccaatcgggacacctcccgggaaaaacggctgtgttatttcgacctctgtggctgtcggttccgcaaccacagcaccgaacggattatccagcttggttatcagcaggcgaacatgatccactggtgactgtcgccaccgtccaacgagttgcagcggcctgtcaaaaaattggggcaaccacgaccctagaaatgacgggtgggacacatcagctaaccccgcaagaagtcttggctgcacggacttggctaatggtaaacgctttatagggtacgctaaaatcatctatttttttaaaactttgtatttgctattctgcgaaatacctgttatcctatggttaatgtatttatggttcggaagttttaaaggctcgacgttctttaagaatggctcctttttaccccagctttcaaatgcaaatattattgcgctatgcgcatggaggtttcattcttatggaacaaggtactgttaaatggttcaacgctgataaaggttacggcttcatcactttggaaaacggctcagacgttttcgttcacttctctgctatcaacagtgaaggcttcaagactcttgaagaaggccaacacgtatcccttgatgtagaacaaggcgaccgtggcccacaagctgctaacgtatcagttgttgactaatttttagtccaacttgagtcgttataaaaacccatcatcttcggatggtgggttttttgtatgtcgtagattttaattaatgcttagtcgctcgttaaaagtacaaggttgacccttagtgtttgtcaggaaagtcattggaggagagggaaaaagtgacaaatactatttggttgtttcagaagataaccatcacttaaagggatgggtcaaccggcaatacatcgtgtcttataacgaggtattaggtaattttggtgtcgaccaagattagcgtagtggtaaataatggcaacttatttatcacctgaaagatgaattagttgtgttccggcattagtcagcttattattaagttaaatatttaaggtggtggctgatgtgagtgaacaagtatttaatcaagcaacgttagcaaagtatgatgggcaacaggggcaacccgcttatgtagcagtggacggtgttgtctacgatgttacgggcgtggaagcttgggctggtggcaagcatcatggtaatttagctggtcaagaattaacggcagttattgatgggaagtcaccccatggacgtaaagtgctggctaagttgccggttgtcgggaaatatgaagcgtaattggattatcggaggtcagggtagatgccctggcctatttttgtgcaaaagaaaaacgcctagccgtggctaagcgttcaccaaaagttaacttaatcggcgattagattcatcatggaatttatcaccggttgccagatgcttgctctttttacgaaaggcatcgcgattatctaagtaaagttggctcacacccgcaattaaaataatcattaaaatggcaataactgcatacatagcaattccccccgtcaacattaggttacaaatatattatcctaatgttacaaacagattgcaagacgaatgctcaaattattagaaattcttgataatttctgagggttatttagagctactctgatgagtggcagactgagatgccttagactcggacgcttttttggcagattcctttcgttgctggtgctttttctgtgccttgcggacttgattggagacttggttagttggactaaccgtttttttacccgataagttggagacggggtaggcgatgagcagaaccacagcggcaataattagatacttaatattttgcttacgttcacccaatgcctgagtaatttggaaaaaataatagattaaactaatggcagcaaaaaagacgacaatttctgcggcaatatgaacgattcccaagagaaaccctcctttatgtatagtagcttaactgtactggaagcactaaagggtgtcaactgaacgatatctgtgattgacacgttctcactgcttctctataattaaagagttcttggtcttagaccagatgaggtcgcaatagctcagctggatagagcaacggtcttctaaaccgtaggtcgagggttcgaatctctcttgcgacataaggggggcgttagcagtgatgctgacgccttttttgttgaatttatgattagactcatgccaatttctgccgtctgaggactgagtatgctacagtagaaaggataattttaaccaaaaaaggagtgtgttaacgtgaccacgttagtcttagtatcgcacccacacttagcagattcgactagtcaacaatttttaaaggctagtatcaacagtgatgaggtactgtgggaacacatcgagagtcaagcgaccatagatattgaaaaagaacaggcgcagttgcgtcaagcggaccgaatcattttacaattcccgttatactggtatgccgcaccggccggattgaagcagtgggaagatacggtactaacgcggacctttgtgtacggcgatcatcgttatcccttggctggtaaggaactcggaatagtcgtaaccactggaatgccggccaaggcgtttcaacgcggcggggctgagcagattacgttagatgcggccttggcaccgttagccgctgtagctaaccgggcaaagatgaagtggttaccaacttttgccattcaccagtttgcttacttagatgaaccagcaaagctacaactggttgtcgattaccagcgctatctgacgcaaacgcaaccggataatttgcaaaataagcaggcgtggtttgcccaacatttaccggccatgattgaacggttgccgctagaacagcaacaggctgggcaactgattctaacggcatttgaacagcagcaaacggacttagaagcccttacagacaccttaggtttgattaaggagcaagaagatgactgaacaatcgcaatggttacgcgaacagattgaagacttagcagtgcgccagtcgcaattcaccgatcgcgctttttggttggcactcagccggctcgttcaagagcaaggtcggcgtcaggaacaattagaaggggaaattgatggccgtacgtggcgccccgatcgctggtagaattagttgaacttattgataaaagtatcaaaagtggcggccgttatcttcggtcgccacttttagcagataatttaatgttgtttaaccgtagctttactagaaattgcgtttctgggcagcccagtgattaatgggaccaaatttatgaccaacttcgatgggctgaccaatggcggtgttgacaaattgtttcgcaatttcaattgcgcgcttcatgggcgtgcccttggcaagctcggccgtaatgcaggcagataaggagtctcccgtcccattgactcggtcggttgggtgataaggttcgctcagccaaaaatcttcgccggtttctagcaaaatgtaatcacgaactgtggtctgattggtttggttgtgactgcccttggcaacaatatttttggcccccattttctgcatttttttagcagccaccatcatatcttgatcggaatgaatcgacatttcggcaatcttttgtacttcatagaagttgggggtgagtaccgttgcgagggggagcagttcttggcgaagtgtggtaaaggcactttcttctagcagttggttgccatgcttggtcatgatcacgggatcaacgactaggggaccaaagtcggccgcccgatagtttttgacaacggttttaattagcgtcgagtcggccaacatgccagtcttggccgcccgaatgtgataatcagtcgctaggtcagcaaattcttggtcgatgaagtcgctgggcatggcgacgctggcgtgaatgccgtaagagttaccagcgacacaggcggtaatgactgatgtaccgtagacttgccgtgcaaagaaggtgtgcaaatcggcttgcatgccagcactaccatcgctatcagaacccgcgatggtgagcgcttgaggatattcgtttgtcatgagtaaagggcctcccagataaaatttagatagcctcagcatagcataggtctcataaaaagtgttgatggagcgagtacaaagatatttatgatggcagttagggaactttatcaggccaccataaccacgttaattgaaccggtcaatttaccagaacctgtctaatcgtggtatagtcgctagtaaagagactggggggagcaacgtgaaagcaggctgggcggtaattgggtggagtatcttcggtggtgtggcaagttgggtggcgttagtcgggtgtcttgaccaaatttatcgggtcattccgactgaaccgttgactttagcgttcggattgggcttaactgtgataagcttagtagggatcgttcattcagcgcggcggggaccctggtggtgtctggtaccggcgacggtggcggcaatggccgtcattgctggcgtgatcaccgacagcactctgttgttactgggactaacgataccaggattttattcttagtgaagcttacaggaggtaggttaacgcgcatgttaattcaacaagggctcattgaaaatgcaacgcagccacaggatattcggattgaagatggcaaatttacggcgattgccgatcatttaacgccgcaagatcatgaacaggtgatcgatgcaacgggtaaattgattttgccaccattcgttgatccgcacgtccatttagatagtaccatgacggcaggggacccagaatggaaccagtccgggacattatttgatggtattcggatttggtcagaacgtaagaagacgttgagtatcgaagacgttaagactcgcgcacgccaagcattggagctacaagcttctcatggggttcagtttgttcggtcacatgttgacgtgaccgatcccgacttgacggccttgaaggctttaatcgaggttcgtgatgaggttaaagattttatcgaacttcagttagtggctttcccacaagagggaattttatcatttccacatggtaaagaattgatggagcaggctgcgaaactcggcgtcgatgtgattggtgccattccgcattttgagtttacgcgagagtacagtgtagcgtccctacattttgcggttgaattggcgcaaaagtatggcaaattagtcgatgcccactgtgatgaaattgatgatccagcctcacggggcttggaaacattggcgactttggccttggaaacgggactaggcgatcaagtgactgccagtcataccaccgccatggggtcttacaacaacgcttacgcttacaagctgatgcggttgttgcaaatgtctcacatcaatatgatttctaatccattgattaacacgcatttgggtggtcgttttgatacgtatcctaagcgtcggggcttaacacgggttaaggaactgaatgaggccggcgtcaatgtggcttttggcgaggacgatattaaggacccttggtacccaatgggtgatggtaatatgctggatgccttacacatgggaattcacgtgacacaaatgatgggttatgatgatattttaaattcctatcaatttgtgaccactcacggtgccaaggccatgcacgtgacggaccattatggtttaacggtcggcaagcccgccaacttagttgtgatgaataatgacaacttctacaatgccttaaaccaacggtcagaagtgctttattccattcatcagggtcgggtaatcgtcaatactgatcccaagcaagtgcacttacatttgaattaatcataaaaatgagtcagagattataatctctgactcattttttttaactcttctttttagcgtgcttgaccttcttgacggccgttacactaaccggcttagccgcagcaactggctttttgtgttcatgatgctgggttcgtagttgttcttttaaaacatcaatctcggccatatgttcggttttccattcctgataggtactggttgaatcagtatcgttgggttttaacccggtgttcaaccaaaaacaggcctcagaaagactgggaaagttatgaatccacagcgtctggccgttgtcagaatcaaaggcaacataggagcggaaatgcttcttcaagaacgtatgacgacgaatcttaaaggcctcacgcttacgggttagccgatagtctggtaagatgtactgaccggaactggctagttgcggaaaacgttcgtcgcgttggtcgcgctggtcctttagcatggcccgggcttgatcgacggttatgatggttgcttgaatcggattcttcatgaaaaaccccctctaaaaattgaaaaaaatggtcataatgatgttttccggtcaataatccacactttctaggttagcataatcgaaaagttatggaaacaatttaccccttgaaatggcagaatttctagataatttaatttttttgaaaaaactgggagactcagtgacgcgattggcatcgagttcataaaatgcgtaatgaaaaatgggccagtattaactttaaaatatggtaaactaatttagattaagttgaaagcaggggtataagtggcacaaaaatactatgcagtcagaaaaggaaagaagccaggaatctatcggacttggccggaaactcaacgtcaagttagtggtttttctggcgcgcaatataagagctttaccactcaagccgaggcagaggccttcatgaacgggcagagcacgactcagcgttccaagccagcccggtcagttggtgcaacgactactgtgacaacggcaacgattacagtctataccgatggtggttcccggaatacgggaaacgtggctggcggtcacgtgaaaaccggagataaggccgcttgggcttaccgcattgaactacccgaccaagtagtgacgggatctgctggtgaatttggggctagcaataaccgaatggaaattatggccttccgcaatgccttacagcggctagttgcattagaaaagacacaggaatcaattcaatttattttagattcacggtacgtcctcaatgcggtcacacagggttggttggctggttggaaacggcggggctggcggcggagtgcgggaccattagctaatgcagaattgtggcaagacgttgatcgactgctcccccagttttcacagttaagttaccaatggactaaggggcacgctacgaatcaaggtaatgtctttgtcgatcatttattgaaccagacgatggaccaaatgacggttgacgaaccaacgggaaagtcggcggccggccgtcatcaatccccggatcagtcagtcgcagacattgctcggagcttgcaagatctaccacttgacgataattaagggtataatagcgactagagattaaatgcggtgttgtctcgtgggggtactgattcaacttttagagaatcaggcgagtttcaaaaatttagtatgcgaatggggtaccaacgatgcaagcaaagttaattccatatttggaatttgaaaatgccaaagaggcgattgtgtattatcagtccgtctttggtgcaaccgatgtttaccgtgttagcccaaccgcggctgaagcggaacggtttggcctagaacccacggtagatttagaaaagatgacaatgcgcggcggttttcggatcatgggattggatattcaatgtgccgacgccttaatggggcaacccacatcttcgacactaatctcactgatgctggcggtggatgagaatgacggcgacagcgttaaggcattggccgcgctctatcaacggctagtcaaatcagatgtgaaggttattagcccctttactgggcaaacagttgggggcaaaatggggcaaatcgtggacgcttacgggattacgtggattttacgtgaacaacccatgacgccaccgctggaaacggcaactattaccaatcagattaattagggatgttgtgacgggcttgttccgtcatttttttgtccacaaaagcaaagtggtatgatgattacagaggagtgattgataaatgacaacagaacgggaaaaaatgacggctgggcaaccatataatcaatttgatccagaactgatcaaccggcgcgtcttggcccgaaaaacgttgcaaacggctaatcaactggcagataacgatgctcgtatggcggcttaccgtcaattattaccagatgttggtccagatttctttgtggaggccagttttacgtttgattacggctggaatattcacattggtgatcatttttatggtaattacgatatgacgttcttggatacctgtccgattacgattggtagtcactgttactttggccccaacattggcttatatacgccagttcaccctttgaacgcgatggcccgcaatgcggatgtcgaaatgggtgccccaatcacaattggggataatgcttggctagggggccgcgtgaccattttacctggcgtgacgttagggaacaacgtggttgtaggcgctggttcggttgtaacgaagtcctttggggataatgtggtgattgcgggtaatccagctcgagtgattaaagaaattgataacagtgaaacgggtaacgcacaagcacgtcagcaatggccggatcaattgggtcattaacttggcaatggtcatttaaaaagttgcgattagtgatgaataatttgacttgaaactggacattctgcgggaaatgacaaattctcattgaattcttagattactatgataactggctatgtaaccggtttattttcaatagaaaaaacttatccatgagcaagattttactaattgatgagcctgcgtataataagacatggatatcgctttaaaagatttcgcaggcaatttgtatttaacggtaatgcgctgtacaggtggctcggctaacgaccctggaactgcgctttttttgtaccgtctgcgccgcgattcatccgctgaaagtttgactttcaggaaacaaatgaggaggattatttattttagcgcgtaaaaatattgataagttagtattcgtgccaaccatcgtgttatttattctcgcgtcagctatctttatttttggtggtagtcaattacagaccactttgagttcattactgaactggatcgatacgaacatgtcgtgggcttatctgatggtgtacgtcgtcaactttttattttttatgtatttggcatttggtaagtttggtaaagtgaaattgggcgatcccgatgataagcctcactacagtaactttcagtggggaagcatggtgttcgccacggcgattgatgccagcatcttgatgctgtcgatcgttgatccgttgcgttatgtgcagcaccccgcttttggcgccaagccattttcgagtgcggcgtatagctctgctcacatgttgggccaatttaattgggggccgatggcgtggatgatgtttgcgccagcaaccattgcgattgcctatgtgttatatgtgaagcatgggaaggttcaacgtgtcagtgcggcaattacaagtctgcaaggcgatagcaaaggaaaagttgtggcgcgccatgtcattgacttcctcgtggtctttgggatcatgggcgggattggctcatctgtcggaatggaaattccgattatctctaaagtgttaagccgacttaccggtgttcaagataatttaatgctaaagattgaactcttcgtaattctctttattttatttgcagtcacagtattccatggcttaaacggtggaattaaccggctaagctctgcccatatttggactgcactgggcttattagccattatcttggtcttaggacccactatttatattttaaattcagaaacgaatagcttgggcttgatggctcaaaagtttgtttcaatgtcaacgaacaccttgcctaatggtggcggcgggagtactgcccaacaagaaaccatcttttattggggctggtggttgtcatacatgccagttatgggattgttcatcgcccgaatttctaaagggcggaccatccgtcaggttttagtaggaatgttaacttacggagctttgggctgcatgagtttttatgccatctttggtggctactcattgtggttacaacggacaggtgccgtcaatctggtacatatcttaaatacacagggccaagctgccgttgtggcaacagtcattgcgaccttgccatttaagatgattatcttagccttgtattgtatctcttgctttattttcttggccacaaccatttcatcttcagcgtttattgtttcttccttcaccagcttacatttggatgacgggcaagaaccaagtcgttggaatcgaatgatttgggtggttgtgttcatcttcttctccttcggtattgtgatggtcggtggcttcaagacagtccagacggtttcaacgattgcgggcttcccactcatggtagtctgcttgctgttactgcactccatctggcacatgttagcggcaaagcccaagccagtaccagtggtggttcctcaaccggtggttattcgccggattacagttgaattaccccgggcggtgcgtggaccgatgattttatcacccgaccatgctaattaatcatgaatcgcggtaaaaaaaaggccggtttaaccggccttttgtgtcccaattttcaaatgagatatgatacaattaagccgaatcatccagatggagggaatttaatttatggcagatgaaagtgatagtccattagtctttcgccggattttgattacgattgatgaagacgaccgaccgtcaaccagccgggcattccggtttgctttgacgttggcgcatgattaccaggcccacttgggtattgcatcagttttagaaagtaacgatattagtatttatgaatcattgatgccggctaagttaaatgaaaagcgggagcatctcaaaacaattgtccaagaatatgcggcgaaggccgaggcatttggggttgagcatgttcaaccaatcattgctgagggcggcgatgtggatgatgtgatcttgcaaaagattgtcccagatttccaaccagatttgattgtgtgtggtgctgacgtggactttgcgagtcatggtcatccaggtgccattggtttgcggttgactaaaaaggccgacgtttcggtcattgtcattcgttagggttacaaaaagtggctccgcgaaatctaaatggatttcacggagcctttttgatgcgaccaactcgtttggtcagtgggtcatttggtgtataatgtaagctaaatgaaacgctttcaaaaggaggagacgtcgatgcaacagccagtcgttcagggttttctattcgatttacatggggttattgctgactcttggcaatatcatttagcctcatggcgagcaattgctgatgagttgcatatcccatggaccgaccatttgacagcggtcctacccggaatgagtcgggcggattcgctagagaccatcttggcagcgggaaagcaacaggcggcatttacggcggcacaacggcagtcactgaccgatcatgagaatgctttgtacaaacagtacgtggctgagctgacaccagctaaccgcttgccgggtgtgaccgcttttttggatgaaattgtggctgctgggtatccgatggcgttagcgtccgcctccacgaatgcgccagcagagattgcccacctcggcttaacgagttacttcacgcacattgttccggcggggagtcttaaagccagtaagccagcgccggatgtttaccttgcggccgctggtctcttaggattgccgcctgaacggtgtgtggcctttgaagataccgtgacgggagttcaagccgcacgggcagcggggtgcttaacgattggaatcaattcgcagccacttccaggtgtcaccgcacagctgacgagtactcaggagcttagtcttgcaaccgttcggcgggtactttcccagccaattgggtcttcaaaaagtctttaagcacaattgcttggttatgagtctcgtccttggccccaaagagaaggatgacgtcttgtttggcgacttgggttgcgatgaccttcaagaaatccggaagtgctgggttagcttgtaactcagcgcgatacttggtctgaaatgcggcaaacctttcggggtcgtgattaaaccatttccgtaggtcggtgctcggaccaatcgctttctcccaagtatcaagttgggcattaacttttgagatgccccgtggccataatcgatcaactagcacgcgaaatccagttaagtcagcaggtttcgtgtagattcgttcacacttaattgccatttaaaatcatctccatacggttagtgtaccatagtctaaaagaaagcgagcgactgcgacaatgtctttattagccgatttttttaccgggcggcccactgaacaaattacacaagagttgttggggcatgaattgatttatcaaacaccagctggaatcatgagcggctggattgtagaagcagaagcttatttgggagaacaggataccgcggcgcatgcgtttaatggccggtatacggccgcaaatgcggcactgtacgatgatcctgggaccatctacatttatgtcttacggggctattacatgttagatgtggcaacccaagcgaatggtattccccaaggaatcttaattcgggggattgaaccgaaccgcgggattgagttgatgcagacccaccgagataaaccgttacctgatctgaccaatgggccgggaaaattaacggcggccttaggtttacaatctaaagcgttgaatcggacaccgttgggtgcacagaatctaacgattacgccaacggttacgcggcacccacgtcaggttatggctacctcacgagtaggggtcagtgctgggagttggcaggacaagccactccgttatactgttgcggggaatccgtttgtttctgatagtcggaaacgggattgggatcgagaaaatcatggctggcaaatgccccattagtctcacgaaatttgttataataggccgataatgtttaagggatggctgacttcatgaatattgatattttcattgaaacgcgtaaacggcttcacctatcacaaaaccaattagctgctggaatctgtacgcaggcaacgctaagtaagtttgagcgtaacggcaaggtgccatcactcaaaattttactgcaactatgtgatcgtttggaattgacgctcaatgacctatttccgttgaatcatgatgaagattcggtgcggtcgcggacgctagaggaagccgagtttcagctactggttgaggagtacgatcaggtaagagccaatttggccaaattgggtgatcccacgaagggaacctcgacatttcaacttcgtttttactttatccggggatatgtgaccgcattgagtggcggcgctattgcggatgcgctctacgatttttcccaaattttaaatcgcttggacgaaggtcaccattcaatgtacacgctgctggcttatacgggaatgggactggcctacagtcaggaaggggatctggatgcagcgaccttttactttaataagggcgctagccaaattcaccagtccacttttaaaaaccgccacaatatctggcgaacgctgaacattatctattacactggccagttccttggcgaaacgggtgaggtggcacgtagtaacgatctacttagctatggcgtcgaaatctgtaaggactaccatgtgacgtattatttggcacggattttgtatcaacgagcgcgcaattatcggcagaccaatggcgcaactgcccagattacgcaagacattcaggatgcggcggcattcgctcgtttgaaccgcaacacaaaactactagcccagattgcggctttcaatgcgggggcatagataacggctaatgaaatcgtctgtcccactaggttagggcggctaaagcaattactttttagtctcaattgtccgccctttggtcgcggaaaatgggctggaacgtaccggacacgactttaagccaagtaactcgcttatcttaaagctcggtcttatcctaaagcgcgctaaaaacgcgcgccaaggataacgacggtactgagcccatttgtcgcttcccgccgggctactgtggtgtgtggcgtggtcggtcgcgttggttaacctttaaacccgattagaataattccattttttattttagcttctttaatcgcactgtttgtgaacattgatattttcgtgttggtcattactcgtggctatagctgattccaaccagtcgtgccgacagcgacttgcatgagtcgcgtgtttgacaggcgtcagtgaggagccacatgacccacagcagatgcaactaatgaaaacaacgatatcagaattttttctgatatcgctgtttttattaatagcaaatttagtatggttttcgtccccagtggacggccgcggctcccagattaaataagtcgtaatgaacttgagttaaaccagcagccgtgaataaccggctgagttcttttgcggaaacgaagtggtgcgtggatgattgcaggtaattataggcttggtagtggtgggctagccgacccattaaaggaacgacatggccaaagtaaacctgccaaccggcatggaccagtggattagttggttgggaggtttcaaggcaaatcacttgaccaccaggcttcaccacgcgtgccatttctcgtagcacctgagtggcatcaggaacgttgcgcaagccgaagccaatcgtgaccacattgaaataattatcagggtagggtaactgcatggcgtctccctggcgtaaggtaatccgatcgtcaagctgggcttggcgaaccttagtggtagcatgttgtagcatcacaccactaaagtcgaatcccacaacgtgtccagccgggccaacggcttgggccaaagcaatggtccagtcaccggtaccacaacacacgtctaaggcaaaatcaccagcatgtaacgtcatagcctgcattacccgctgacgccaccaatggtgggtaccgagactaatgacactattcatttggtcatattgtggtgcgatgtgatcaaaaatatcctgtacccgatcttcgggcgtgtggttggtcaatggcatggtcggcgctcctttttacgacagtaggtagtctttatcgaattcaggatcttgtgaagtcaaaatcttaggaccatcgtccgtgatgacgagcgtgtgttcatactgggcagataaggagccatcggccgtggcatagtagttccaagacttatcagcgacttctttggtgatgatttcccaagttcccaagttaatcatgggttcgatggtgatggtcataccggcgcgtaaacgcaagccgtggccagcttctccataattagggacgttaggctgttcgtgcatggttggttgaataccatgaccaatcagctcccggacgtcacccatgtgttcttgaccttctgtgtaggcctgaatggcatgaccaatatcaccgatacggttaccaaccaccgcttggtcaatccccagataaagggcttttttggtgacgtccattaaatgctttgcttcggggctgatatcgccgaccgcgtaggtccaacatgagtcactttcaaacccgtctaagttgaccgtcatatcgactttaacgatatcgccattctttaagattagttccttacgaggaatggcgtgggcgacttcgtcgttaacgctgacgcaggtggcatatttgtagccttcaaagcccttttctgaaggggttgccccgtgttcttcaatgtatttgttcgcgaagcgttcgatttcccaacttgagataccgggtttaataatgtctcgtaaacccttgtgaacaccggctaagacagcgcctgaggctgccattttttcaatttcacgtgctgatttaatggttatcaacgtgttacctcctcaaaaattttgactagttctaatgtacaccaattctgctctttcggcgaatagatgtggttaaatcttaaaagtaaaaaacggaccgcggcaagctgcctgggcccgttgacgatttaagcttttaaactggtgatctttcccgcattaacctgctctaagacgcgtttggcttcggtgatgcgcgcatcgcataagaaatgcatggcgttatccttctcattttccgcgcgatccatttgttcggttaaaaagctaatttcatcggttaagtagctgactaagtccatgatctatcctcgattcctaacggtgtattcgttaactaggttcattgtaccaaagattaaaccagaagtaaccggattatgtcattgtgcttgcgggatggtttacaggccaagaaaaatggactaaactaaactctagttaagaatatttctaaagtggcataagggagtgggttgtgatggaagaagcagttgatttacaagggcggccgtatagccacctagcctttatttggacgttactggcgggaacctttaccatgtcgattagtcaatcatcactgtcaacggcatacccaacgttgatgcagtattttaatattccagcatctacggtgcagtggctgacgactggctttatgttagtcatggtggtcatgatgcccgttagtccgtggctcttaaataacattcagtttcccattttatttgttagtgttttggccttattcgatgtggggacctttattatttacctagccaccagttttcccttgatgatggtcgggcgggtgatggaagccatggccgtgggaatcatgtttccgtcctatcaaacggtcatgttgcgcatcactccagaaacccagcgggggagtgttatgggcatggcaggcctagtcatggggtccgcattagccgtggggccgattatctccggcattgtgttgaagtacaccagttggcaagggttattcgtggtctttatgttagttgttacggtggtctttctagtggccctcaagacgattaagaatgtgatgccccaacacaaggcccatttagactactggtcggttctaagtagcgtcgggtttatcgggttgttgtatgtggtaaaccaaattggtaagacggctgtcaattggggctggatgagcggcctacttatcgtcagtttattggcggtggcgtactttgtttggcgacaatttcacgtggcaacgccactattggatttacgggtgctcaagaccgttaactttgatcttgccgtattactgacgggaacgtcttatattgcgttaattgtggtgacaatcattttcccattgtattatcaagaggttttgggaatttcgccatttgcttcggggatggccttagttcctggggccgtggttttgagcttgctgaatcccttaactggcaagttagccgatcgcattgggtttaaggcgaccatgctaaccgggatgaccatgattgtcttggggtggttatggttagtcttagtcggtgggcggcaatcactggttgccatgatggtgattgcggcattaattgaagggggcaatgccttcgtgatgatgccagcagtgacgctaggcgccaactcgctaccagatcagttaatctcacatggaaccgcagtgattaccactgtgcgacaaattttagggtcaactggtgtggcggtggcaacgcttgttttggcactggtcaccagtagtcatttgccgagaatgtcgcgaacggcagcgagtctggctgggtatcaggcggttttcctgacattcttggcggtcgccgtagttggttggatttttgccgccatgttgcgtgatggtcgtcagtcgactaagtcataagttgtcaaaaaagctaggttcaaccactttttggttgaacctagcttttatttttctaactgagagttaccgtaccacttcaaagacctcacagaagcagggaatttggtcgttaaatgtttgttcagccacctggtattcacgggtgaagaaggcgcgatgctctttgcgccaagtgcttaacgtgcgatcgtcttcgccttcatggtaggcgtgttcctgactgacctgatcgaaaggcaccgtttcggtgaccttagtttgcgtgacacagaccgggtttccttgcgcatctaagatgatattgtattcgccaacgaacggaaagggttcatcggcttcatacaactcgactgctgaagtggttgcggttttttgtccaatcttgacgaggtgcgctagcaaatcagcggttgcgtctgaactgccaaaagcataggcgtcataatgatcggtggtgatttctgggtgatgggctttaaagtgttgccaataggtctttacgtccaatagttgctgcctccttgataacttagcgttagcttacaccagagtggcttaactgacaagacgatttaacagctcaacgttatatgactaatgcgtttcagcgaaaccgcggcgaccaccgggcttaggaatttgattttgcatcatgacgctgaaaccgccatcgatcacgagaccagtagcgttgatgtaacttgagcggtcgctagccaagaagagaacggcgttggcgatatccgttgttgtgccgatgcgtttgctagcggtcaaggtcttacggccgttttcaacttgtgggtcggcataaaaggcggccgacattggcgtcttaaccagacaaggttctaagacgttactccgaatgccaaacattccccattctgctgcgacttgcttggacagcatattgacccccgctttgctggtactgtaagcgccgctataggtttcgggaatgtcgctggcaacggtcgagatatggacgaaggttccgtgtttttgggtaatcattagcttaccgaattcatgggtaactaagtaatagccgttcaaattaacgtcgagtacctgtttccatgttgcgtaatcaaggttttctagtggatcgaattttaaaatgccagcggtgttgatgacgacatccacatgaccaaatgtatccttgacttgatccacggcgtgttggacgctggtttctttggtaacatcgcaactgacagccaacccagcaatgtgttcttcgttaatcaattgcgtgaccaggtcggcaaccttagcctgatccatatcaagagctaccacggtcgcttgctgggcggccaaagcctgacaaatttggacgcccataccaccaacggctccggtaacaacacagaccttatcctttaatcctaaccaatctgacatcataacacgctcctttaaaagatagcagctttaacgggagccaacggcattgactgtcctgtccacaacttaaatgcggcggctccttgattgagtaacattccttgaccgttaataacatgcgcgaccccggcctgttgggcgattgtcatgagtttagtcacactgggtgcgtagaccgtatcaaagacagtcatgttggtatgaaaccaagtggggtcagttactaacgattgatcgactaatttgcccatcccgaggccagtggcatctgtataaacatcactagtcgcgatagctgcttggaactggtcgcgatcctctaacggatagaaggttgcgtgacaggctgtttggtcattaatgatttggacaatttgctgggcgtttttaaccgaagggtcgttaatgttgaaggcgtttaaggtcttcaagccggaaagggcagcttgaatggcgatgggtgttccagccccaccaaccccggccagcgtcattgttttgccagttagttggacgccatcgtccgctaaagcatcgacgaaaccaagcccgtcagtggtatagccggtcaattcgccgtcgtgattaacaatagtattgactgcgccaaccaattcagccgtgtggtcgaggtggtcaagcaggggaattacggcctgtttatagggcatggatacactggctcccaacatgttaaaggcccgaatggcagcaatagcagcgggcagttgggaattggtaacatcgaaggctaaaaagcgggcgttaatcttggcctgagcaaaagctaagttgtgcatggcgggggattgtgaatgtcccgcggggtgggcgattagcccgactaatttggtatgaccatcaatttccataaaatattcctcctaacgattaatctgtcgtcgttgtatggcgaccgatgccttggtgaattaagtataagtcaattaagatcccgataactgccacgccaatcgcgacaaggtaagacccattataggcctgggttccagctgcctgattcatagataaggtggcaatctgtggaccaatcaaggcaccaatggcatagccgaagaacatgatgccatagttcgtaccagaaaatttttgaccgaatgttttccccgttaaagtggggaaaaccaccagcacgccgccaaatgaggcaccaagaataatcaggaaaatagtaaacatggcaatgctggtagcaaaacgtaacccagccagcccgatgatcgttaaggtgagaatcatcagtagggtacgagtttcgccgagcttgtccacagcccgacccgtaatcatccggccaaagaaattagctagggtattgacgacgacaaagttagcggccacgatgggggtcagttgcagttgaatctgggcgattgatgatagcgagccaattagcataattccggccgtgcaggcgatcgcgaagaggagtagtagcaaccaaaaattaagtgaacccatcatttccttgggtgatttgccagttgtgacgggagttgcattcgttgatgtcggtgctgttggtgaggccatcagccagccaactagccagattaagatcaggtaggcggcaccaatcggcatcaggccgttggcgcccatcgtagcacagagccaagcccccactttcgctaagaccagcggacctagcgaagcggcaccaagtaatagtccggagatggtgccccgtttttctgggaaccatttgagagtcgtcagtaatgctgggttatagagcagaccattgccgctaccggcaagtagcccaatagcaaagtataaaaaccagatattgtgggcgaatgcgcccaagaaccagccgagaccgaagataaagccaccaacgtacatcaaccgtttcggcgatgcatggtcaatgacccgaccggagatgatgccaaaggccgccataaagaattgataaagggttaacgtcagggcaacttgcgaggccgtggcacgcgttgccttaaccaatgtatcggcaaaaacagagaaagcagcggaagctgaacaacaaaagataatgataaaagctgcggtaaagataagccgccgatgaccggagactgtggggacatgagttgtttccatatgaaacaccgcctaactagggataagtgcaaaatttagaaaacgttttctatgacttttatgataggctggaagttaagagaataccaataccgatttttagtggatctatagcgaccgactatagattgtgaataatagaacgaggaggtcgtcatgaacttaaatcaattacgttactttgaatgtgtgggtcgattggagagctatacgcgagcagcccgggaattacacgtgagtcagcccagtctgacaacggccattcataagctagaagccgaactcaaattaaccttatttgtgaagcaaggtcggcatattgtgttgactagcacaggacagcaactgttgttggtcgttcaacagagcttacagacgttagatgatggcgtagcccaggtgatagcgaccaatagtcagcaaccgattaagctacgagttggttgtattcccacagttattgggacttttttgccccaagttttgcatgaatttgaacaagctcatccgcagcaagtgacctttgaactacatagtgtgaccactgaacaagtccagtcgggactagcggctaagacgtttgatttggggattgcggctgcagatacgcgcgaggcaggtatgcactaccagccactgcttaagcaaccctttattgttattgtggcgccaacgcatccgctagcgaatcgtcgtcagttagatttagctgacctaaccgactatcccgtattaacctattcaccagagctattaattgggaaaaaggttcagcggacattacaacggcagggcgtcgcttcgcagctaaaactacgggcggcttatcccgatgaactctcaattgcggggatggtgcaatcatctctggcggtggggctggtagcagataccctttatttagccgcgtttgacctggttaaaattccggtgacggttcccgaagacttacgggtgatttatgcgatgtatcgggcggctaatccgcaacatgccgcacttcaacagctctttcagctatttaattcgcgaacaacgacagaagacgcttccaactgacgatgaattacgctaaaatggcatattaagataacgtgaaaggggttttttcatgccaacaccagcaacagttgatttagccgcgttttatgccaatccagatcggagcgttgcggttctgaactacaatgcccggtttattaccagtatttttgatttggttaacagcgatgagctcgcgagtttcgttcaggtgttcttagccgatcaacggactaaggtgccagcagaagccgatgcaaccacaacctttaatctggcgacgcccgcggtttacttggcgacgattaaggctatcttgactgatcgcccagatgcttaccagcggttccaaccagccgagattttggctagcattgaagacctctactcgtattaccgaactttcttgcgagtggcaacgatgacgagccaacaaaatgacgtgatggcgagtgaatttatgaccattgaccagcgtttcaatgatttggtcattcggttgtaccgaacaattgaagaaaaattacaggggcatgccaatcaggtatatcgccaggtcaatgcggggtcgagtgcttgcatgctactccagcaaattgcgtggcccgcaccaaccgaatatacaagcttacaggatattccgttcattagtcgcttgatgctgcgaccaccaatgatggtgcacacgaagagtaataagcgaaagggacacttcacggcgtcagcaaccaatccgatcgctaacttcacggggagtgcaacggattggtactgctatccggctatgatcggtgagagcttagcttatatttatttccatcgggattatttagcgtcagggattgccttagctaacctattccaattagcggatagtcaagcgattgccggcaagaagcccgatttgattttactatttggttctcccagtgccgctggggatgagcaaccagaaaatgggcattacttctacgatgaagctaatggcgtgtatgtggggcaagtgccgtacaatgaccagacgacctacttcggctacatgaagaagatgtgtctgacgttgcacaatctccacatgattgcggaaaaacgcctcccaattcatggctcaatggtcaagattacctttacgaatggacaaaccaagacggtggtcttctttggtgactcgggggccggtaagtcagaatctattgaggcgcttcaagcggtcgctgatgatcagattgctaatattgaaacgatcttcgatgacatggggagctttactttggccgatggacatctgtatgcacaggggactgaaacgggggcctttgtccgtttggatgacctcagtagtgaagtggcgttcaacaacatggaccggggtgtttatatgaaccctgaacagaagaatgcgcgggtaattattccggctaatacgtggtcacgtgtggtggcccaccatgagattgatatgtgggtctacgccaataactatgatgatgcggttggcgtgcaacggttcgcggaccaagtacttgccaaagagacgtttatcgctggtaaacgtcgggctttaggcaccacggacgaggtgggaatgagtaccactttctttgccaatccatttggtccagtgcaagaagaagcggctacgcggccaattatcgatgcggcctttgaccagttatttgctgacgatgtgtatatcggtgaaatctatacgcacttgggtaacgacaaatcacaagaaaaactcaacgcgtcagcgcgggctttactgacagaactgttggcgttgtaagacaagtgaaaaaccacgacacattagaaattggtgtgtcgtggtttttgctatgagattattttaaattagtcagtaagcgctgagcaacggttttagctgagaaggggttctggcctgtaatcaactggccgtcttggatcgcaaatgatttgtaggcgcgcttgtgaacgaagtgcgcgccgtggttcgtggcgacagtttggttgagaaagggcaccacttttttcttgcccgcaaggatttcttcggctgtggtgaacccggtaatccggcggttagcaatgaggtagtgaccgggccgatcttgaatattaagtaatccggcgattccgtgacaaacgctggtgacaaagccaccttgttgaagaattgcgagtgacagcgtctggaggtcagtattttcagggaaatcccacatcacgccgtgtcctccggtgtagtaaatggcggcgtaatcactggcctgcacgtcttgtggccgtagagaatgggttaaggctcgttgctgaaaatcagtactttcatagagagtgagattggcttcatcggtatagcgcatgctgcgtggatctaagggaacgaagccaccttgagggctgacatagtcgacctggtatccagcagcttggacggtttctacaaattcggtggcttcgcctaaccacaagccggtggcatcagtggtgtgcgcatagtgggtaacgttggttaagacaatcaagatttttttcataattgctcgttttcctccataacggtggtgacgtgggtgagtagcgtttgtagttgttggatacgcttcgtgcgatgtgtgaggtagtagtaatttttggtgccgtctcgccggtaatcgatcagggcaacatttcgcagtagtttaagatgatgcgacactgctggacgggataaccccgtaacgtcggttaattcactgacccgtaatccccggtgaaccacttgcttgtcgagcaaggcgaggatgatggcttgacgcttctggtcgcctagtgccaccaaaaagtcactggatttttcaaattcatgctttaatttagttaagtcggacatcgatagtcatcttctttgttgattattttaaaccattaaaccacgatggaatgttactgtcaactctgaaactatagaattcattcgttgacaattttgaaccaatagtttacgatgccatcattatcgtttaaaataataaaccgttaggagcataaaaatgacagataaaatgcgtgctgccgtcattgaccactaccaccaagttgacccggagattcggttggttccccaacccgtaatccacccccatgatgttctcgttaagattagggcggccagcgttaatccaattgataccaaaacgatggcaggagacctgcgattactactccgctaccggatgccacttattttgggtagtgactttgctggcgatgtgattgctgtggggcgtcaggtgactgcgtttcaagtgggagatgcggtgtatggtcgtccgcaaaaggaccgaattggaacgttcgcagactatttagcggtggacactggtgacattgcactaatgccgactaatctaagttatgaacaagcagcagccctgccactagtaggtttaacgagctaccaagccttacatgatttgatggctcttcgtcctgggaaaaaggttctcattcaggctgggtctggtggtgttgggactgtggctattcagttagctaagcagttgggcgcgtatgtagcaaccacgacaagtgctgccaataccgcgtttgtccaatcattgggagcagatgaagtcattgactatcatcgtacagattttgcaacggtcctcaaagactatgatgccgtgtttgatatgttaggtggaaatactttagaacgggcttttcgagttgtcaagccgggtgggattatcgttagcgtcagtggtcgtcccaatggtcgatttgctcagacgtatggtctgccattgtggaaacgaggggtgttgcggctagcaacgcgacgattgacccaattggaaaaggtctcgggcgtcagctaccggttcttatttatgcagcccagtggtcaacagctagccgaactaaccacactagttgagcagaacaagctggtccccgttattgatcggatctatccgttaacggaaattgcggccgccctgacttactcacgtttgggtaaagcacatggcaagattattgtgaccatgacagaataaaaagagcgggtagacaacttaactgtctatccgttctttactgtcgagatttttgataattgcgattgattcctagttaaattgttctaacaaggctgtcataaatgctggcgcgtcgccaacatagccgtagtcggcgacgtcaaagatcggggcgtgttcatcggcattgactgcgacgatggtctgtgccgtttgcatgcccacgaggtactgaactgcaccgctaatcccgaagtttaagataagttcgggatgaatggtattgccgctttggccgatctggtcgtcatgggtgaaccgtttctggtcggttagtggccgcgagaccccaatccgcccgcccagtttttcagctaattgagtggcagttgtgatggtggtttcacttgcagcaccacgacccagcgcaattacccgactggcatcgctcaccgtagtagcggtattgacgactggtgtcgttgccgtgatttgtagtcgttccactggatggaaggtgaccgtaacggctgtcagcgttggggtgcccgttgccgggtgggcaacaaaggtattgggccgaacgctagccatctgtgggcgacggtcaggacaaatgatttcacacataatattgtcaccgtatgagggcttggtggcaacgagggtgtcttcgtcaaagcgtaggtccaaacagtcggcagtcagtcctgtttgcaattttgcttgaagtcgtggggcaatggaacggccggtaatcgtagccccaaataaaatcgtgttggggtgataagcagtaacgagttgggccagtgcatcggcttgctccgcatcggtagcagttgggaagcgttcatcgcgcgcgatccgaatttcatctggggcgtacggagtcagctcgtcttccaaatggtcagtcggtgcttctagcaggatcgtgaccactttaaaagtggtgccggcgattgatttggccttagtaatcagttgctgtgtagttggttcgatgtgggctaaacgacgctctgaaatgacccatagttctggttgtgacataccgatttcctccttaaatgagctgacggtcttttagggccgtaatcagttgactggcggcttcgcgtggtgttccggttaatggcgttagttcgcgcttaacgggtgccggcgcatagactttcgtgacgattgtgggtgaaccaacttggccgaggcgttggtcgtccagctctaaatcatcgtgatgccagacagtcaggggtttggcgaagctaagttgaatttgccgcggggtggggtaacgtggcgtgttcaactcactgcggacactgactacagcgggtaattgagcgactagcgtttgtttggtgtcttccagtaagcgttcagccgtgacttcattggggccacttaaacgtaagttggcagcgtaagtgatctgtggctggtggaggaactcggcgacaatcggaccgacctgtccagtatcagcgtcaacggcttggcgaccgaatagaatcaagtcggcgttaccaatttttttaatggcctgagccaaaacataaccggtagcaagtgtatcggcacctgcaaaagcgcgatcggaaagtaaaaccccttcgtcagcgcccatggcgaggccttcgtggagtgaatccgcgtaatcatcgggccccatcgtgagtaacgtaatagtgacgtcagtgtcggcggtatcttttaatgacaaggcaagctcaatggcatgtttatcaaatggattcatgacaccggccagcccacgacgatcaaggttatgtgtgatggggtcaatcgtcacgttattggtttccggaacttgttttagacaaacgataattttcatgagaacctcctagtggttaaattcggcgagggcaatagctgaacgcattttctcaacggttccttccgctatctctagtgcgcgggcatcacggatcaggtgttcaactggatattcacggctgtagccatagccggctagaatttgaagggcatcatcgccagcactaactgcggcacgagaaccatgagctttagccatagcggcgagttcactgtagggttgaccaagcgctttgagatgggccgcctgttggtagatcaatttggtggtttccttgcggattgccatgtcggcaactttgcgttgggtaacttgaagggccgttagtggttgatcgccggccttacgttctttagcataatcggttgcaatctttaattcgtgttccataataccggtgagcacggcacccattaatacccgagcgtcgtcatgagcagagtcaccgatgaggccaccgtcaccgagatttccgaggaggtggtcgtcatcgacaacgatatggtccatgacgatttcgccgactggcgttccccgtaaaccgataaagtcctcgcgtttaccaaaagaaaagccgggcatgtcttgatcgactacaaagacggaaagctctgttggggcggttttgaccaaaacacagtaaacctcagccagaccaccattcgtaatcataattttatcgccattgagtacccagtgatttccttcacgagtggccgttgaactaatactcattggattagaaccaccactagcttcggtcatggaaaaggcaaaaatccggtcggtagccgttggtagtaattgttgttgtaaagctggtgtaccatactttaagagttgatcaatagttttgaaatgaccttcaagggtcactgctgtgctggcgtttccgcgggcaatgtggttcaacaccgttgccgtaatttcaggaccaaagccagcgccgccaaattcttgcggtaacatgagtcctaagaagccggtcgctgtcaacttttccatgaaaccggcgggaaagtcaccagccgcgtccatcggcatatcttggggcgcaatctctttttgcgtataatcatccaccatttgcaatagtaatttttcagcagcagtcgttgttgacataagtgggcctccttgaagttgtttgtgcatatgtgagcgaataacgtgagtatagcggattatcaaatgataagtctaggggcaaatagcaaatagagaatatttaatattcccatatagaatatattgaattcctaaattatattataatggtattgatttaattttacggagtaaacaccttcgtctaaactcaaataaggttaatcgtaaagtggcttttaattgttcgacgtaaaataattaggcgaattttagtaaaaaatttggtactcaacccccggttaggttacaatgaaaccggattctttattttttggaggtgtactttgatggaaattacgaagagtgcggctggtacgttgaaccagcaggatgtctcaaaatatgtgttaacgaatcaacaagggacgcaggttgcggttctaacctggggtgctacgctgcaagaatttagtgtggtggaggatggcaagcgtcattcactgattgtgaataagcctgatttagcaggctatgaccacaatccgtattacttatgccaagccttaggtcgtgttgcgggtcggattgccggcgctcaatttgagttagacggtcagacggtacatttggaagccaatgaagaaccaaatgcgagtcatggtggtcctcatggtttcacctttgtgaactgggatgcgacgaccaatcagactgccgataccgctagcgtggtgttaacgcacacgtcaacgccggccgatgaccgttatccgggtaacttggagacgacgattacgtacacgctgacggaagaaaatcgcttagacatcaccttcgatgctcaaagtgatgcggcaacactcttcaacccaacgattcacacctactttaatgtgactgatgatcaacacgatttagaccagcagtgggttaaactaagtggcgacaagcggttggtcttggatcaagcgaagattccgactggtgagatggtgccaacggccgggacgggttacgactttagtcagccacgaacggttaaggatgggttggatcaacttcaccaaatgggccaagttgaatatgacgatgcctttgtcgtagaacctagcaaggacaccccaattgcgacaatcggggataccacgggacaccgggaagtttccatttattctgatcgcaatgggttagtggtctttaccgccaacccaaccgatgatgcacgggccgatgttcgggattacaatgccttagcaatggaagcacaaacgttacctgacgcgattcaccatgctgatttcggcgatgtggttctgccggctaaccaaccagtggaacatacaattagttatcaatatacgcgtaagtaagtctaagaggagagattagatatgagttggcaagaaaattaccaggtgtgggcccaacaacctgacctgattccttacatcaagcaagaactagatgcgatcactacagacgatgccgctaagcaggctgcatttactgcacccatgagctttggaaccgccggaatgcgtggtgtgatgggccccggcattgggcaaatgaatgtctacacggtgcgccaagcaactgaaggtgtggcccggtatctggacacgctcgatgatgcgacgaaacaacagggtgttgccattagctttgactctcgctaccactcccgcgaatttgcccacgaagccgcgcacgtcttgggtgcgcaccatattccaagctatgtgtttgacgatatgcgaccaacgccagagttgtcctttgcggttcgccatttacagacggccatgggcattatgattaccgcgagccacaaccccaagcaatataatgggtttaaaatttacggcccggatggcggtcagatgccaccgaaagcatccgatatgattaccgattttgtccgttcggctaaagacgtctttgccattgacgtagctgatgagacgcaactacggtccaacaaattgttacgcattattggcgaagatgtcgaccaaccttatttgcagaacgttgaaagtgtgacgattaattctgaattaatccgcagtgtcggtaaaacaatgaagctgatctacacaccacttcacggcacagggaaggttatcggcgaacgggcactccggggggccggatttgagaactttacgatggttcccgaacaagccattgccgatcctgaatttccaacggtgccattcccgaatcctgaattctcacaagcgtttgatatggcgatcgcgcttggtaaaaaagagggggctgacctattagtcgccaccgacccagatgccgatcgattaggtgccgcagttcgccagccaaatggtgattatcagttactaacggggaaccagattgcctccattctgttggcctacattttgaaggcccgcaagcaagcggggcagttgccaagcgatggtcgggtagtgaagtcgatcgtatcgaccgaattggccactaagattgccgccgcttatggtgttgagatgaagaacgtcttgactggttttaagtttattgccgagcagattcatcagtatgaaacggcgcatgaccataccttcctctttgggtttgaagaaagctacggctatctgattaagccctttgttcgggataaggatgccattcaatcaacggttctgttggcagaagtagcagcagactacaaacaacggggaatgaccctgtatgatgggatcgaagaactttacgcaacttatggttactttgcggaaaagaccacgtttgaggaattccctggtgttgacggtgcggaccaaatggcccacttaatgagtgaattccgggaaaacgccccgactgcctttgccggcaatcaaattgaggccgttgaagacttctcaacgagtgtcaaaacattggcagacggaacgaccagttcgattgatctgccacagtcaaatgttttgaaatactggttaagtgatggaacttggatttgtattcggccctcaggaacggaacctaaagtgaaattctatattgggactagtgatgagactgatgccgccgcacaacagcggctagcaacgtatgaaagtgcgttaaagcaatatgtcgcgtcgatttaagcgataaatataaaaagggaacggccgtagattttttatggccgttccctttttacaaatttatttattgatttactaaatttttacttagtaaaatacaaccggttgcaataccggtatttcagtctgtattactatttatagtgtaatcttacacaaattaagtggttgcttatttaacgaaataaccttatgatggctactgtaaagcgcttacatatagtaaaacaatactaaacgttttactaaccttagataaatgttgaaaacagataaggggtgtttcagatggctaagaaaaatgacaaaatgatgttggatccggcagagtttgcggccgcggtgttgggtggtaacgcgcaacgtccagatgaggaaaataagctgtatatcaagcggcaattgaccttgtacttggaagcaaccttgttggcacaagatttcaataatcttgaagaaacgcaattcgatatggcccgttcacagcaacgagaagatgtgctctcgaagattattgaacggcgttatcactaggaactactttttgaaaggtgtgaataaaaataatggttaagcaatatttatcatacgccgctggggcattgggacatgatgccttttatgcaacgttaagtacgtatttcgccatgtttgttaccagtgtcttatttgttggtaaaggagcgggaactgacgcaaaattagccagtatcgttaccacaatggttgttgttatccgtttagtcgaaatcgcgtttgatccgatgattggtgggattgttgataatacggacaccaagatggggaagtttaagccttggattttaggtggggctatcgtaagttctctgggattaatcgccatctttacgagtttatttggattagcagatagcaacacgacactttactttattctttttgctattatctttgttattttggatatcttctattcgtttaaagatattgcattttggtccatgctcccggcattgagtgtggattctaaagtgcggaacaagtttggaacgattggccggttcggctcaacgattggggcccaaggggttgccattatcattatgccaatggtgcttttcttctctcaaaagttctcggggacgcataatggaaccgaaacccgtgccggatggctgggctttgccatcttcattgccttgctttccttcttaggggcctgggcaacagtcgcaggaaccaaggaaaataccagcctgattcgggaaaatacggaaaaaacgagactacgggatgtctttaaggtgctgggagaaaatgaccagttaatgtggttagcactatcctatcttctgtttgctttgggatacgttgtgacgaactctctgctgctttataatttccaatatgttttaggggcagccaccaaatactctatggttgggggaattacaaccgttcttggcattatttcggttcctctgttcccagtcttggttaaagcaattacccgtaaaggtatctacgttggcggcattatcatgatgcttgtgggttacctgttattcatctttgcgggaaccagtgtggtgatgaccttagttgccgatgctgtcttcttcttcccatacccaatgattttcttagccgccttaatgacgatcacagatagtgtggaatatggtcaatggaagaatggggtgcggaatgaatccgtcaccttagcggttcgtccgctgattgataaactagccggtgctttttccatggggattgtagtgcttgctgcggttaactctggtatgactgggaacgctaagccaagtgatatttctgctcatggcttgttcattttccattccttcatgttctacatgccaatcgcttcattgatcctggctgctttaatctactacttcaagatttcattatctgaaaagcgtcacgcacaaattgtcactgaattggaaaagaaacttgaagcacaagaagctgaaaaacagaattagaaacaaatttaatggggctagggtggaaaacgccttggccctattgttgttaatgacgctaatgaaaacgttttatatttaattgacacggtcgcataaagcgactatgatgattacgagtaaaactttactaaaaattttattaaggagctaattgccatggatttcgccagcttagcaacagaataccaagaaaaatttgatgtcgccccacaacgggtgttcttctcacctggtcggattaacttaatcggtgaatataccgatttcaatggtgggcatgtattccccgctgccatcagtatgggaacttacgccgcttactcagcacgtgatgacaagcaattccgcgtgtactcggccaatgtaccagacgccggggtcttaaccttctcactggataacttggcctttgataaagccgataactgggcgaactacctgaaagggatgctattcgagctggcgaagcaagacttgaccatcgaccatgggtttgatttattcgtccacggtaacttaccagatgcttctggcttatcttcgtccgcttcaatggaaatgttgatgggcgaaattcttcacgccgcttatggcatgaagcttgatgaagtcgaaatggttaaagttggccaacaggttgaaaatgattacttcgggttgaatacgggaatcatggatcaatttgcaatcggcatgggcaagaaagaccaagccatcttgctagataccaacacgatggattacgagtacgcaccactagctcttggcgattatgtggtggttattatgaataccaagaagcgccgagaacttactgactccaagtacaatgaacggcgggctcaatgtgaagaagccttacgccggctccaaacgaagttggctattaagacattaggtgacctgaacgaagacgaatttgatgagaatgcttatctgattaatgatgacgtactgatcaagcgggcgcgccacgctgtctttgagaatcaacggaccttgaaggcctttgacgcactgcaaaagaatgatctgcaacgcttcggtcacttggttaacgcctctcacatttcgctcaactacgactttgccgttaccgggaaggaattagacacgttagttgaaacagcttggcaacaacctggtgtcttaggcgctcggatgacgggagctggcttcggtggctgtgccattgccattgtgaagaaagacaacgtggctgattttgaagcacaggttggcaagacctacgaagacaccattggtcacccggctgaattctacgtggccgagattgctgacggtcctgctgaattataaaagtaaggattggttggcgttaggccgattgattagtgtaaaataaatttagagaattaaacataagaggaggaattgatcaatgacagttttagtcttaggtggtgccggttatattggttctcacgccgtcgatcgtttagtagaaaagggttatgatgtggccgttgtcgataacttggtaacgggtcaccgggccgcagttaatgcgaaagctcggttctacgaaggtgatgtgcgggatcaagcctttctagacggtgtctttgataaggaagacattgaaggggttattcactttgccgcattctccgtggttcctgaatctatgaagaaaccgttgaagtactttgacaacaatacggccgggatggtttccttgctggaagttatgaacaagcacaacgttaaaaaaattgtcttctcttcaacggcggcaacgtatggtgaacccaagcagattcccattaaagaaacggatccgcaagtgccaaccaatccatatggtgaaagcaagctgatgatggaaaagatcatgcgttggtctgatgaagcctacgggattaaattcgttgctctgcggtacttcaacgtggctggggccaaagaagacgggagcattggtgaagatcaccatcccgaaacccacttggtacctatcatcttggaagtcgctgctggcgaacgagatcaattagccatcttcggtgatgattatccaactaaggatggtaccaacgtccgggattacgtccacgtcgttgatttggctgacgcccatattttagcgctggaatatcttaaggctggtcatgacagtgatgcctttaacttggggtcttccacgggcttttctaacaaggaaatgctggaagccgctcgtaaagttaccggtaaggaaatcccagcaaagatggcgccacgccgggctggtgatcccagcacgttgattgcggctagtgataaggcccgcaagacattgaactggcaaccccggtttgataatgtagaagatattattcggacggcttggaactggaagcaaacgcatccagctggctataacgatcggaacgaggagaagtaacgcatgacccaagataccattcaaacattcattgatcacattgtttcctcgccagcgccttatacggagctggatcggcagtacgtgacgaatcggattctagccttgattggcgagggttccgtaccaactgctacggcaaatgaaccgattgatttggttaatgcgttagtccaagcggccattgaccacggtcaaattgaagatgcacctagtcctaaggacatcttagaggcgcaattgatggatttgatgacgccactaccatccgcgttgaatcgtggattctgggatcggtatcaacaaagtcctggcgcggctaccgattggttctatcaactcagccaggtcaataactatattaagacccgtaatattgcaaagaacgtggtctttccggctaaaacaccggctggtgaattggaaattacaattaacttgtccaaaccagaaaaagacccgaaggcgattgcggcagcgcttacccagaagaagactagctacccgttagatcagttgtgtatgacaaacgaaggctatttgggtcgattaggttacccagcccgtagcaatcaccggattgttcggatgatgctcggcggtgagacgtggggatttcaatattcgccatacgcttacttctctgagcacgcgattttcttatcgcagattcatcgaccaatggtgattaatcaacatacctttacgaacttattggaaattgtgcgtcagttaccaacttattttgttggtagcaacgcggatttgccaatcgttggcgggtccatgttgacgcacgatcattatcaggggggaaaacataccttcccgatgatgaaagcgccaattgatcggtcgattgatttagggattgccggtgtgacggcgggggttgttcagtggccgatgacagatattcggttaactggaagccaaccagaaccactgattacggcagcaaccaaagtgcttaacagttggattgattattctgatgagcaggtggatgtgcgggcctacacggacggtacgcggcaccatacgattaccccaattgcttaccgtcagggcgacgattacgtgcttgacttggttctgcgggataaccagacgtccaccacttatccggatggaatcttccatccgcatcaagacgttcagcatatcaaaaaggaaaatatcggactgatcgaagtcatgggacgggcgattttaccagcccgcttgaagacggaaatggccgaagtggaaaagtatttgttagatcaaccgaaccagatggcagcgatgcatcaggcttgggctgatgacttgaaacagaccaatcacgtaacggctgagaatgtcaccgcgattgtgcatgaagcgattggcaatgtctttgcacgtgtcttggctgacgccggggtctttaagcggacacctgctggtcaagcagcgttagataaattcattgctcagatttaagcaacatagatgttaggaggtgatggtaatcgcagcgacgttaaaggatattgcgagtgcagtgggtgtgtccctagcgacagtctcacgggtcttaaactatgatcgaaccttgtcagtgagcgagtcgacgcgaaaacagatttttgaggttgccgaggaactgaactataccaagctcaaacgccacgcactcgtgtctacgaagccgttaaagattgccatcgtccaatggtattctaagaccaaagagctggatgacttgtactacatgtcgattcggatgggcttggagaaacggtgtgaggcgcagcggtttcaggtgtcgcagacgtttcaaaatgacctcaaggcgattgaggacgatgtggatgccattattgccattggtaagttcagcaatcaacaggtgacgacgatggcgcaattgacgccgaacctggtgtttgtggatcaggaccaactctgccatggatttgacagtgtggtcaccgatttccgctttgcggtcaaccaggtcattgagttcttcatgcaacgggggcaaaaacaaattggcctgttgtatggtacggaatggacgacggatggccaattggaggtcatcgatccccggtacaaagcctttcggcaggaaatggaagcccggcaggcctttgatcctaagttggtctttgcgggcgactacaccaatcattcgggttatcaggagatgcaaacggccattgcccaactcggcgatgatctcccgtcagcgttcttcgttagcaatgacccgatggctgcgggggcgttgaaagccttacatgagaacggtttagatgtcccgggtcgggtgaacttgtttagcttcaatgacacaaccattgcaaagtatgtgttcccagagctcagcagtgtgcatgtgcatacggagctgttgggagcaacggcagtggatctggtcgagaatcgaattcaaagtggccggaaaaccccacaattggtgacggttggaacggaactcatgctccgggagagcacgggaaagtaactagaaccgattagtttatgagaattaacgcaaaaacgacaccctttcctagttgggaagggtgtcgtttttgtgttagtgactatggatatcataattttcttgataatcgttgtgataacgttcactataattaagcggggcacgatagtccttaagttaaggcaaaggggactgatgagaatgataatagggatcttagggttaattgtcgcattgtgtttgttgtatattgcgatttctgtactgttgggcgtttaaacttgtgattacgtataggtgttctgattcgttgactgggtaaaggatcttcaataaaagcctttatgttataagtcatctggcatacaatgggcatacagttaagcaacggagtaattacccgaagcgaggcttagcaagttagtgcgacgctacaccttctcaacctgaataagcgggggtgagagtattgcacgtatcagccacgcggaaaggtggaccataacggcgatgctgttaggggtatcggttatgcttagggcaattggtaaattagcgattgatctagcaaaggcatatctgatatacaaaaaagccacttcaattaagaagtagctttatccatttttaccgcacctgaacttgcgaacttgtgggggctgtcgcaatcagtcctcactttttatatatatagaatagcacgggaggcaatgggatgcaatatatcgtgtctagactcacggacatacggtgatcgtccgaccggacaccatcttttgtttagcaaggtggttcatgtgaccagctcaaccttgagacactttaaaataaaaaagcccacacaagtgagtgtaacgattaagatacacttgattgcaatgagtcttacgcttgttcatacatacaactagatatattgggagatattagcatgaagctggtagataagaaacatatcacgataagtgtacgtcggacaaccagatgggagttctgggagtccttactagggtttgcagtgattgggttactactgtggtggttaatatgacagaaaagaagaccaatgaaacacaactgaaagccagtaggaagtgggccgagaatcatagagagcagcggcgctatattagctataaagctacggcaaagcgttctattaagatagcaagtgatgaggatctggcgacactggcacaactgattaaagatagacaagatgaaaaccggtagatgactataatgatcatcttttttagttggataaatcaacgctggatattcaaaagatcaagcgttgcaaaagtaactgccacgggttggcaatatcaccagcttgtggcgatttttgatttacgacgactgccccaagatatagggggtggtcactgactatacaactgttaatccgcagatgatttatttttttaaaacgagcacgatatttttatagctaaattgcgtccgtccaagttcatttactacctaaggtgttcaatgttgctggatgctgtgggtcgtggctcataacggatggaagaatctgtccaattacaattaactgcccagtcaaaatcagttgcattttgaggagaatttgttattagcgggtctcataaaaaagtctagggacaatttgaaataactatatattgtattttaatcaggaatcggctaccatatatagcatagtcttgaagaacgggagagattcgcatgatgaacacagcaacccaagcgtccgtgagcttgacgccagaatttatcgcagcaactgaaaaggaaattacgccacattggggtgaattgggttgggtgacttacaaacgaacctatgcccggtggttaccggagcaacaacgtaatgaagaatggccggaaacagtgaagcgggtcgttgagggaaatattaatttggacccccggttacaggctgatacagtgactccagaggtcttgactgaattaaccactgaagcccagaacctattccggttgatttatggcttagctgccaccccttctggtcggaacttgtggatttcagggacagattatcaacaccgcaatggggatgccttaaataactgctggttcatcgccgttcggccgcaagcgtatggtgacagccatatcctgccgagctacctgacacaagatcaggtggcggtttccatgccgttctccttcatgtttgatcaattgatgaagggcggcggcgttggcttttccgtgacgccaaataacgtgcaccaaatgccagttgtggatcagaccgttgatttaactatcgttattgaccctgagagtgcgtcttacgcggactctgtcgccttgggggcggtaaaccggtccgaatggatgcatgacaattccttagctgacgtgcgcttctatcggctcccagacacccgcgaaggttgggtcttagccaatgccaacatgatggatgcccacttcaattcaacgaatcctgagaaaaagacaaaggttgtcttagacattagcgatattcggccgaagaacgcacccattcatgggttcggtggcaccgcttctggtccaatgcctttagttgaaatgttgtttgatattaatcagattttaaataatgccgttggtcggcaattaaccgctgtggactgtaccgatatggggaatatgattggtaaaacggtggttgctggtaacgttcgccgttcggcagaattggccttaggcggcgccgaagatgatgcgttcattacgatgaagcaggataaggaccagctataccatcaccggtgggcgtctaataacagtgtggccgttgacagtgacttcacggactatgcgccgattgcggactctattcaacacaatggcgagcctggtattgtcaatctgggattgtcacgtaactacgggcgcttaattgatggtcgccaagaaggtatcgatgaggctgttgaaggcaccaatccttgtggtgaaatttcgttaagtaatggtgagccttgcaacctgtttgaagtctttccgagtgtggccgaagaacagggctggcagttggaagacgcctttggcttgggcgcccggtataccaaacgggttacttttagccattacgattgggaggtctctcgtaaggctattcaaaagaatcggcggattggggtctctatgtctggtattcaagattggattttaaagacctttaagcaacgggttgtgacgggctttgaagctaagcatgacgccgaaacgggtaagacttttatgcaacctatctataatcaagcggcggttaatcgtttcaatgcgctttaccaagcggttgttaaagcggatcaggattactctgacacccttggctgtcaaccatcgattaagcacacaacggtgaagccatctgggacggtggccaagcttgcaggtgtttccgaagggatgcacttccactacgcccggtacctgattcagcgaattcggttccaagatagtgatccgttgctaccggctttgaaggctagtgggtataaagttgaacccgatgtttacagtcaaaatacgatgtgtgttgaatttccagttaaagcggcccatgcagatgaaccggcctttgcttcggccggtgaggtgtccatggcggaacagtttgcaacgcaggcgttcttacagacatattggtctgataatgcagttagttgtacggtaacgttccaacccgaagagggccaagatattagcgacttgttgttacaatatcggcatacgattaagtcaacgtcactattaccttatagtggtgctgatttcaagcaagcacctaaggaaccaattgatgcagcaacttatgacgctaaatgccaagaaattactgctgacgtggcggagaagtttgcggcaatgactgggaatcatgatcaaaaggacattgaattagtggatcaatctgactgtgagagtggtgcttgcccgatccgttaaaactgacattgacaactaatattttaaattgatgaggcccctataaccaactggttgtaggggttttgcctataaataattttaaaaacaaatgacgtttttgtcagaatcaggtatgataaagacacttaactaaagaaggtggctggtagtatgaagatttatacccgggtcggtgatcaagggatgaccaaacaaattagtggcaagatggtggcgaagacggacgctcaaatcgtgacgctcggcgatatcgatgaattgcagtcttatcttggtgtggttgtagcgagcttacaacccacgcaaacggcgattgcagaagaattgagtgatattcaacgcaagctctatgaattgcaggctgatattagtgtgaaacgacaccagactatggtgcccgctgacaccgaatggctagagggtaagattgatgaatacatggcggcaaccccagagctaaaagagttcatcttacctggtggctcggcagctggcgcacgattacagtacgcccggacagtggcacggcgggcagaacgttcggcagtggcgctcaatacggaacagacattggaaccagccatcatgacgtacctcaatcgcttatccgattacttatttgctctagcacgttacgtcaatcaccaagaccactatcaagaagtacctagcaaacgtaaataacccccatgaatttgaaaggtaacgcaaatagacttcccaggaatcgttaagattcttgggaagtctatttagtgtggttgccagtaacgattgtggctaaattaccagatcttcacccgttcatcaggtgccaaatacatggcatcttctggttgaacgttaaaggttgtgtagaagtcatccaagttcttgacctgcacgttggcccgtaatttggctggtgcgtgaacgtcaatggacaacaggagttgcatatattcggtggtggctttcatccgccaaacattggcccagttaataaagaaggcccgtaagtcgacgtctggttcagacttagcagcttctaaggcgcagctaagcccaccgcacatgactcttatgttaaccaatattaattatgactcttccacgtgcatgacttaattgaagataattaattacttttgtgcctctttgaactgataagtcttatcatcttggcatttaaagaagtttgaaaagattgataaaacggaaaaatattgtttattagaaaattttattgttacatatccttaaaagcggtaatgtttcatttgtaatataatttacaaactaataaatatttgggggcgcaggaataaatgaatgtaagatatgagcgtgcaaagtatcttggcttactgggaatatcgttgttttctttttcccttttacaaagtcaatcaacaacggcacatgctgctacaaatagtttggatcaaagttcggtcgttagtgatgcttcacaggaaaaaacgtatactggcattccaaagagtaatacactaaaaagtgctgactctaatggacaagtgagtactgaaagtacgggaacagggagctctactggcatcgtttcagatgctactaaggtcgaaaaatcagtaacagaaacaacctcggttaacgatgcaactggtactgattcttcggataatgtcactagcggtactaattcaacgggagcgaataacgaccagacaggtattgctgatccaactaaaccgacagtagcggaccctaagaatctggtggtgattaaaaagaacgattccaccgtacacttggataatcagttaaaaattagtacggattcagtggctaatattaagaaagttaccgcttctaacccagataattcggcttataacgatactactaagaccgtgaccattactgatccaacggccacagatatggttactgccgagtatggtgtcgtaggaacctatcagggaaagaacgtcacagccaaagtaacggtgggcaacttagttaaacatactgaggatcatccggcaccaagcaatttaccagctaatgaggttcaaattaagtttcatccagactttggcggcggaattgaaacctataacgtagcgcaagacgaagtgaccattgcctttttcgatgagcaaggtaatccaattatcatcaataaagatggttatatcacggtaggcagcttaaatggacctagtgttaacacgatggggaacgagtacgttgactatgacaatccgaatacgtcagtttatattactgaggactcggtcgttcagtatcaagctaacccagttaccaataccggtgacgcctacgtagggacctcaagtgattttacggataaattaggagcaccaacgtcggaaaatggggctgtaactttccaacttgctggtaactcgtttactttcctgaatgatacaactcggtacaccctaaaaaataagaatcaccattggtcttacgctttaacgacctttaattcagcaacggtcgccccagcgcagacacctaaaccggttttaagtgttgataagacttccgctaaggcgggtgacgtcgttaattaccagttagatcagcaagtaaatactctaggtgaagatacgctattgcgttatcaatcttggattcaaacagtgactttaccgagtgaagtgacctaccaacaggcaaatttattagacagtaacggaaatgtgattagcgatgctttaattacatatgattccaaaacccaccaagttagcgttacgcttcctagtgattacctacagagtacgatgccgctaactggtgaaacgtactcattgaaaattaagaccagagttaatgcgggtgtctcaaatggagaaaacggttctgcatccggtgccagtacaattgataaagcggctaatgtcagcgataacgtagatacagtatatgtggcaccaataactgaagtacccaatgatactagtgatcctttagcgcgcacacacacattgacacttagacttgttaatctaagtactggaaaagtcattagtgaacaagtctcaaaaaaggattatcaaagtcaatacatttttcaagtgccaaacttacaaaaaagggaacttgtggttctgtggaacgattttagtgaaaaacaattagtagggaccatgccagaccatgatctaatgatcactgttccctattcagaattgatttataaagagaaaagatcaaaagggattagtgttatatgggcctacgatgcaagtggcaagactcggtttttgcaatttacccttccggatgacagcaatttggtaacattttataaattaaatatgttggataatggtgagtatattactgagcccatggtgaaatttacatctacttctagtcaaaatcatagtacaggaaaaaaaggtacatcgaagagcttatttaagttttctgataatcagaaaatccaattatggagtgatggaacatcgaatggtttctttagaagcgacactggtaagctttattcctattcttttagagatggaaaaattgttgttaagagtatcaagaacgcagtaatatctaaaagtaatcggccggcgaatgagaagcgaaaactaggtaagaatgttaaggcaaaggccaataagcgtgaaaatttgattaataatacgagagcagttgtgattggagaaaacaaaaataatcgcattgttgtagtaaatggcacgcgggaattaccacaaacaaacgaaaacagtaaccttatcgtttcattgataggactgctactacttccagttttttttctagggaaattaataacagagcgttttataaaataaggggactacgatatgaataaaatattgattaaatgggcgatattagttgcaactgtttcgggcggtatctccacaggtaacatgattgggagagcagccgcgactcctgactatcaggactactatgtgtcaacatatcaagagggtgttaattcaaaagttattaataaacaaaaagtaacttttactatgtttcaaaaacaatgtaatgaagaattttcccaagtatatgtaaattacctgaaggatggtggggaggaaaatttttcgcaatatatgagggataattattatggtcaggatgatcctggagcaagttcaaaaccggcttcagtcacaacagcaatttcggagcctacagcttcaaaatactatcattacagaacaaaagcagtgcggaagggataccacatgaaggctggagatatactgatttgtcataacactaacagtatgaagagtatccctgggcacgctgcaatcgttaattcatcaggttatattatggaaatgccaggcactaaacatgttggtaaaaaaaagaatgctcgaattgtaacaaaaaagcatttctttaagcaacattcaggtggaagtgcgtatgttatggtgtatcggattatgcaccatccacatattgcaaaaaaggcggcaagatatgcttattataaaatgctgaagcaccataatcctgaatatagcatttttaagggggaacaattgtataaaaagagcccaagttattgttcaaagtatgtgtatttggcttatgattgggggggaactcgaaaggccatgaaacaatggtggggaggagttcatatagtgtcgccttatggattagttgggaactttaagggttcctataaacccacagcaattcatcgagtaattgcatataaataggaggataatatgaataagaagcggactattgctacatggtttaacgtcatacttggccttttggtactattcattgcactagggaatggattggatatcttaggaagcaacgggggggcgggaacgggcccttggggaataaagtggactattgtcaatgttcaagcatggataaatatattatgggggattttaattcttattaaacgtattccaaattggattctgttaacattaggaatacttggaacggcactttttatatattttaatttttacatcaagtatttttcttggattcaaattctgtcccttgtggtcatctgtctctttttcgcatatgagacttacaaagattacgccgttaaataatatttgtatgagagtattgaatggggagcactaattaggtgctttttaaggcaatgaggaaccggatttagccttgaacaaacagttataggaatgctacagctacactgcatcaagcagagcgagtgggagattgacaattatgaacgctttaagcatattttacgtatttgattcaatatacgtcattgtgagcatattaattcttcttcttttggtagtgggggtcgcttacgttatttggaaattataccgtaaaataaagtgattctttatcaaaagaagttgaaaaacgatacgaatccagatcatgaagtgttttaaaatttcgtgattgaatgtagcacattttatccttgtttttttgtggaaataaatggggctgtggcataagtcgctataactaaggctgtccaatgggaacctttggattctcatgggacagccttttgatataaagggtaaaagaataggacgagaaaccaaaattcggtttctcgtcctatttcactatgcgaggactagctatgtcacagcctcatttatattgaacgtattctaattaccagattttcacccgttcatcaggtgccaaatacatggcatcttctggttgaacgttaaaggttgtgtagaagtcatccaagttcttgacctgcacgttggcccgcagtttggctggtgcgtgaacgtcaatggacaacaggagttgcatatattcggttgtagctttcatccgccaaacattggcccagttaataaagaaggcgcgtaggtcgacgtctggttcagacttagcagcttctaaggcgcagctaagtccaccgccatcggcaatgttttcggaaacggtgagtttaccattgaccttttgtccagcaaagtcgatgccatcaaattccttaatcatcgcttgcgcgagttcttggaagtgtttcaagtccgcttcggtccaccagttattgatgttcccgaactcgtcgaattgagaaccattgttatcaaaggcatgggaaatctcatgcgcaatgacggcgccgatcccaccataattagcgctacttgattgttccaaactatagaagggtgcttggagaatcgcagccgggaagacaatttcgttatttgacggcgagtagtacgcattaaccgtttgagcactcatgtcccaccgtttacgatcaacgggttgaccccagtgaccaaagtggttagcgataatgatttcactaatggcctgaagattatcaaagagcgatttgttctcgtcaatcctgaactggctgtagagtggatcgatttcatctgggtaacccactttaatcgtgagcttttgcagtttaacgatggccttatcacgtgtagcggcgctcaaccaatcgttggttttcaaacgttgttgatagacgccagccatcttcaaaaccatttggcgcacgtcagctttagcggcctcaccaaagtatttgcggccgtagtaatcacccacgacttgaccaaaggtgccggttgccaggtagtaagccgccttttcgcgagagcgggcctgcttttgaccagataatgcccgaccataggtgccaccgacttggcgatactcttcggttaaagcgccggtcgcatcataaactaccccgactaacatccaactcttcaagagctcaaagttctcgggagtgagcaagtcattaacggcgtcaaagtaggtcggttgtggcaagatcacttgcttaggggtgtcgtgaagtagttccgtgatggttcccgtcaagtcgagatggtcaatcttattatcgacatcagctaacggatagggattgtacatcttcacgtaatcagctgattcttctgctgatttgacgtgtggcgcaatcaaggcatcgaattgcttggcctggtcaacgatcttggcagcagtggctgcatcataaccagctagttgtagtagcttcgtgattgtttgggtaaagattgggaggagctgtttagctgcttcgttacccggttcgtagtacgtcttgtccggtagaattaggctaggggcatcgacgtataaagcgtattgactggtatctttcatatctggttcaacactaagttctactggcgtactcagacctagtcggtaccattcagctaaatgggcgttcaaatcgtcgaaatcctttaacccggctactttatccaaaaatggcttgagtggcgcggtgccgtcttgttcgcgcttagcaaagttacgcgctaacgtgtagagctttttgaattcagccatctcaggattggctggtgtgagtttgccagttaagaggtcggcaaagtcagccatcagcgtgtgttcgatattatcgaccagatccatgaagcccccggtagaggaatggtccccgggaatctcagcgtgttcagcccattggccgttcacggcatcgtagaaatcttgcgtgagcttggtttcgtcaaccggataggtggctgctccaccggctggtgtatcagatgtaaaatgattaagtcgcatactgaatcctcctcaaattagtgattaccaacagattaaccctttcagcgacaaaagggaattgttttatcatcgaaatctcatcaaaatactgacacgaaaaggagggctgagttgcatctcagccctccaagctttagtgaccacttagttcgtccttcttagcccgtaacacggggcgttgaaacttgggacggttgcgatcccaaacggcaatgctttgttgatactgggtgaagaaactggtaatgtcagcgggtgtcagactggttgggatttgctcccaagtctgagcgctttgcaaaaaggcttgccgaatatcgtgctcaacgtcagtccccttatcggttaagcgcaggtattttacgcggcggtcatcaagcttggcttcttgttcgacaaagccatctagcagtagggcccgtaacttccgagcggcagcggaacgggtcgttcgtgttgaatccgccagttcgctcagtgtgatattacgttgctcatgaatctgtttaagcaacagatactgttcaaagctgacggcatactgactggtgatctgttcagctgcattgatcagtactcggaagataccacggtactgccgcagaaatgtttcaaatactctatcctcgttttgcataataactcccccttggaaaacgaattcggccgatttagcaaatgacgcggcgccaacgcgtcgggtccttcactacctcagactaccgttattatgcggcctaacgggtagggatgaaaataattgaactcgaccattgtcactaagataggtcaccttgtattctaagtgaaggtggtttgctgtaaccccaaaatgggctattcagtaattgatatactgaatagcccgcttgagtatggttagaggattatttcgtcatataaatatacaaatgatcggtagagaaaccagtattgaagcgcacaccatttgagtaaatggtcttggtcgtcgtggaggtactcttcttcttagcgtccttcagtaccttttcaaactttttgatcacgtacttaggtttagcgtctagcgaggtacctaacagagcgaaggtcgtcccaaattgtttcttgccggccgttgtcttcatttgcttggttggggtgattaaggctaatcccatcagttgaccgttttgaacgttgccccgaatagtcacatccttagtggcaactaggttcttaacaccagcggatgtactggtcgggagtaactcatctttagcctgttttttagctgttgccatcttggcttgcagttgtttggctgctgcttgctgtttttgcgctgctgcggccgcggctgtcggatttgtcttagctaaagcggtcagctttttttgcgtcgtcgcttgatttttctgtgcggcttgcagttgtttttgaaccttagctggcaaatggctagcaatggtcatttggttatacttagcggccaacttgcggtagttgccaagtgctttgacccgatgaactgtcacggtcttatgggtcgttccagcgctaactttgaccgtttgggtcttagtggaagcgggaacctggaagaaataagtaccgcttttcacgttgacggtctgagtagccccattattgatccgatagtggaccgtcttagtcttggcgtcacccttaataactgccgttaaggccgttggatggtaatcggttttgttagtggttaaagcattatttgaacagccggctaaggttagggctaataatcccagggcgctcaacagtaactttttcatgattttatattcatccctcaatgattaatttacttggtttatcttaccacattcttctagggaagcgagtatgagaattggctaacattttagcggtgaacctaaaaatctcgtgaaagcgtgtgcaaatcccttttacgtgaggaaaagaattggtatgataaaagtgttgaaagcagaccacatcgatggtttattatgggaaggacgggatattatgtatgaacggatcttagtaccaatggatggtagcaagaatgcccatgcggcattaatggaggccaccaaactcgctaaggaattgggatcgaaactgttcatcgtttccgtcgctagtgatcagacctatgcccactacggcgcggaatttggcagtgagattgtcacgcattttaaagatgcagcggctgagtttttacaaagcgcggtcaaggaagttgaggcgcagggggtacctgtagaaaccagcttcaaggttggtttgcctaaaccgacaattgctgaaaccctcccgaatgaattaaagacggatcttaccgtaatcggtcgttcaggggttcacggactaggtcgggccattatgggatcaacaacgacctatgtggtgaacaactctaagagtagtgtcctagttgttgattaaactttaaatgcaaacaaaaatgcactggcaattaacttgtcagtgcatttttacgtatatggcgtcaaacttactttttgttctttaaccaacgttgtaagtctgaaatttcgtcgcgccgcttccggtcctttttacggttaaccttccgccggccttgaacgccatttggatgtgcttttctcattgtaaaaaccctcgcttaactaaaataacaatcgactgtcattctactggatatttacggaaaaagcaagggcctacggagtttctatgtaaatcaatgaatgttcaagcttactggcacgcggtttactgcaatttgcttaaaatttttattacgggtcaacgcccccgtcagaaagtggtatattgggaataattcagcaacaggtaaggaagggacgggcaacatgcattttttgacaacgaagcgcggacgtctgtgggcctggctagtcacgctactcattggtggcctattggtttggggaacgcagcacgatgctcgcatttatcatgatccgatcttacaagtgacccaggttaagacggggacaccaactaaggagaccgatgatttccataatgtcgatcgccagactaagcagaccttaaccggcaagcttttaaatggttctcaccggggacggcaactgacaattacgaatacctattcgcaatcgggggctatggaccagcgataccatgtggggagtcagctcttcgtggtcctacatacgcatgcggatggtcaccttagtgcgacggctaaggatataaagcgtgatacaccactcgtctttatgctgtggttagttgtggggctattactgctcatcatgcaatttagtggatttatggcctttctcagtgtggccgccaatggggtcttgttcttattggcgattttactaaatggatcgacgcaaggggcacaggtcttatggatttttggtagcttggccgttgtttttgcggcgctgacactatggttggtgttaggggccaatcgccagatggtgattaccttagcgacgacgttagggggaacggcgttctctattatcgtggccttactcgtctttcatttcacccacgaaaagggcatgtattatgaatccatgcagtatgtgacgcaattgccacgaccactgttcttggcagaaaccttacttgggtcgctaggagccgtcatggatgaatcgactgatatcatctcgtcattatttgccttaaaacgagagcgtcccgaattatcagctattcaagtctttaagtctggtcgccaaattggcagtacgattatggggccactgattaatgtgctcttcttcatttttgtggcggatacatttcctatggcgatgttgtacctcaaaaatgggaacagttggggctacaccttttcgatgaacatgtcgatgggggttgttcaaagcttgattagtgggattggcattgtcttggccgttcctctggcgagctttttggctagtcggttcatggaaaagaaggtgatggcatgagtacaattacggcgttaggattagtcctgctagtgctgatgattctggtcgggggcaaagccggggcccagtcatttctagccctcattttgaactttgggctcttgtatctcgctattgtgctggtggcgtttcacttctcacccttgattgtgacgttagtcgtgggaatgttagtgttagcgctgaccatcttcatgagtagtggggatgatctgtcgagcacggtcgcctttattgcgtcggcggtggtgttagtggtcttaattgctttgattgtcccagttgagcattgggcactggtccaagggttcggtcccgaagatagtgaggacttagaagggctgtcggtcttggtggggattaacttcattcaggtaagcaccgccacagccattttaagcacgctaggggcgattgcggaggcagccatggcaattgctgcgggcttgagtgaaatcctcgagcagcacccacaggtcccgttaaatgacttgttaaaagatggtatcgatgtcggcaaacaaattattggaacgacttttaatacgctattctttgggttctttggtggcttcttggcactattcatttggtttaccggcgtgcactactcatttggggaaattctgaatgataaaatttttgtagcggagattctcatgatcttgtacgcaatggtcagcgtgattctgacggtgccaattacgacttgggtcatgacccgcgcggtagctggtaaacgaaaacgagcggcgaaagaagagactcccaagtaaggattaactgacgataatggagaaaaaacatgagaattcactgtatggtaagaaacattaatgttaaacgaacaagaaatttgtctgtgaaatattctgaattggagctttcagattatgagatgctgggtgaatttccggcttatgatcgattggctgattttatgtggcatatttttaaagaagaaattatgccagaaggttttgaaattgaagacgatgatgatcccgaagatgaggcgactattattcaaggggattttttgggaagatgatgactattatccgcctgtgctaacttcgaggggacctggaaaggccgctagatatttgttgtgctgtacgagtaaatctttggcaacaacttatcagattcggttcactttggataaaagacgagttggactgtacgcctttgatatgagaaatttgcatgcagtaattactgataaggacaagacttatacgtttgatgatgaaggaaataaggccgaaggatttgaaatatttgaaaatattactaggcctttgtgggaattagcagctaatacaattatgtttgctcaggatggaacagaagatgaaggaactctggattttgcaaaaccacgttgggttgatgctagtaatattttgacaagcttaagcagggacggcaataagtgccatttgactggtcgactaccagacaatagttatcacgctgatatgaccttcgaatttcgagagttgttaggagacgaatttgatgaatttgtagatgcgagtggtttataacaagattatcgtaaacgaaaagcgttaggagatacacgtcctaacgctttttatgtggaattagaaaattagtgaactaacaacctaaataaaaaccgcctaacgtaatcgttagacggtcattattagttactgctgcttgagcttgcaacacttgaactagcagcactagcattggatgattcgacgctagcagatgttgcagttgccgttgtggtagcgacatccttgatgctggttaagttaccagagtagacccagtaacgtttcgtactgttcttagatggccgaatacggtaccacatggacccagtactcttcttagccgtcatgtcgatgtagtaagccttaccaaccttaggtgaaatcttggaccaactttgtttagtggcattcttgttggaccccttgacgtggttgtataggtagtagctcttgtacttgctacttaacttagcttgtttattcactgacgtgtaggttgcgtttaccaatttggtgtgtgaggtactgaaaccgttatagtactttttcaccatctggtagaacattgccatcgtgtagccttggccaaaatacttcttcccagttgctgagtaataaccaacggggtcagtatgcgttgagccacctaagtgactggcaacggacccatgtgaccatacggtacctttgccatcataagcagcatcgttaggcttaaggttatattctttcagcaagtaggcggtgtaccaagcagcgttagcaacttcgtgtgcaaaggcagacttactgtggacttcaacttgttcaaattgaacgaaacgagagttaccaggggaaccaacaccccaagccaggtaatccgtattagcgatattaataatccgggaaccatcaacgaagctatgcacgaaagcgttttggtaattattcttcatataggcaatttcattatagatcgttgatgaggggttagccgtttcatgaacaacaaccccttctggcttacccttaccgtggcgatacttgtacttcgggaagccattccaaattgatttggtaattttagctggcgtgatgtttttacttgaaatatagctattaaccttggaagtcgctgcggaagcggtcgttgtggacgttgataatccaaaaattccggcggcaccaagggtagccagtgtggttaaaacgattttgtgcatgttcaccctgatcatccctcaaatctttctagtcattaattacgacaaccaataaattggttgctcagtcggtggttgtacgattcgttatccactataacatgttagacgctaacgacaagcgtcaaatcaggctttctgcgtaatattacgcgggaacgcgcggtggtaacagcatttacctagcgtgtttgcaaatagattaaaacttcacgacaggacgtaacctatctgtaacattgacatagcgccgtttgttcccattcacgaggcgtagtgcacgcaaaaaacagatcgtccgttgcgtcggcgacctgtgcgtaatggttacttagttggttgggtccatccctgttgttcaggatcgatgtgcagctttcgttgacattcagggcagatcccgtgaagttcaacgtgattgctagtgaccaagtagtgggtttgttctcgcgtttggtggtttaagttagcctcaactgcggcgatattaggggcaaaaacatcggtaatttttccacaattttcacaaataatgtggtagtgtggtcggccgtaaaaatcataacgcagcccacccttatcgttggggagggcaatgacgatgcccagatcaacaaagagatttaatgtgttgtagacggtcgccatgctgagattaggcagttcatcctctaaggcgtgaaataaggtttccactgaagggtgattgtgatgtgcgaccagatactttaagataatctggcgttgcggggtgacccgtacttgatgttcccgcagtaattgaatggccgcattaagttcttgttgttgcgttgccaaatctaaagtctcctttctaagaatcactctagtttaagtctattaaaacacattttaacaggacttccagcagaaagctctagtttagaataaatcgtcacaaaaatgaaaaataaaatctagagaggtttacttttatgacggatagagtacaatggattcagtagcagataagaactattctaaagagagataaaaattgactatccctaactttttgaaagtaaagctgattagatggggattgttgcagatggggtggcgtaagaatggaaacaaaagtgaagaagactgcaacgttggcacaacggatcaacgtcttgcgggcgagtgtcatgggggccaatgacgggattttgtcggttgccggaattgttgttggggttgcgggtgcggcaaccagtagttttgcgatttttatttctggcatcgctggcatgattgccgggactgtgtccatggccatgggggagtatgtgtcagttaatacgcaaaaggatgcccagcgaaaggcgattgagacgcaaaccaccgctttagacgatgactatgaggcggagtttggctttgtgcgtgataaatatgttgccagtgggattaagccggaattggcagagcaggcgactaaagaaatgatgacccgtgatccattaaaaaccacggtacgcgagcgttttgggtttaatgttggtgaatataccaatccattttctgcggcgattgcatccatgatctcatttccaactgggtctattctgccattggtctcaattacattattgcctagaggctatcggatcgtggggaccttcattgcggtggtcgtggccttagcgattaccggctatattgcggcggtattagggaaagccaaccgacggaatgggacgatgcggaacgtcattgcgggaattttgacgatgctagtgacttacggcatcgggcacttatttgcttagggggcagttaaatggcagcaaatcaacaggtacaaatcaagaaggttaagcaacaccagacgatggacgagaagctcaacacgctgcgtgctggggtattagggtcaaatgatggtattttaacggttgttggtgtgctattcagtgtggccgccgcaacgaccgatcagtttacgatttttattgcggggctagccgacttactagcctgtgcgttttccatggcgtcaggggaatatgcttcagtcagtacacaaaaggatactgaaaaggcggccgttgctaaggaagaacggttgttaaagaccaactatgccgaccaactggccgccgtgcagcaattctatgaagatcggggtgtgactgcggaaacctcgttagctattgctaatgacttaatggctaaggatgccctggcaacggtcgttaacgtcaaagaagatattcaattagggcactacatgaatccgtggaacgcggccttctcctcgttgtttgccgcggccttgggcggaacttttcctttagtcgccatgtcactctttccagcagctacccagtggccggcaacgattgtagccgtattattgtccgtgacgttaaccgggtatttgagtgccaaattgggtcatggactcgtgaaaaccgcaattatcagaaacgttatcgtgggaattatcacgatgtttattcactattacgtgggtcagttcttctaacaaaactattgttcttttcttattgcaatgtcagaaagctagtgtaaaattagtcaaatatcttttggaaatgaggaatttggcttgaagcgtaagatgagtttgttttcgttagtcatgctaacgctgagtgccatcatcgggtctggatggttatttggcgcggggatggcagcccagatcgccggaccagcggcgattatctcttggattttgggtgccgttattattggcttaattgctttaaattatattgaactgggaacgatgtttcccacgagtggcgggatgagtcaatacgccgcattttcacacggtccgctgttggggtttgttgcggggtggtctaattggctatcgctactgaccattatccccattgaagccgtagctgctgtgcagtacatgagctcttggccgtgggcgtgggccaattggacccgcggctttttgcggcacggggacatcactaatgaagggttagtcattgttttcttatttattctggcgtttaccctgctgaatttttggtccgtcaagttgctcacgcggtttaccagttttatttcgatctttaaattagcgattcctacgttaacgattctggtactgatcgggacgggatttgagccgcaaaattttggtcatgcggccgggtttatgcccagcggcacggcagcaatcttttcggcaactacggcggccggcattatcttttcatataacgcctttcaaaccacgatcaacatgggcaatgaaattgcgcatcccgaacgcaacatcttatggggaattgtgattgcctttgggattagtgcggtgatctacacgttgctacaggtcgcctttattggtgccgtgccagctagtgcactgcagcacgggtggcaaggggtgaactttgagtcaccgtttgctgacctggcgattttgctgaatctagggtggctgtcaacgttgttgtacctagatgcctttgtttcaccatttggtactggggtttcatttgtggcaaccacgagtcgagcactcgccgcgatgactggtagtaagcacatgccgactaagttaggtgaagttaatcgtaaataccaaacgccacgacgagccatggttgtgaacatgttgctgggggttgtgttggtggctggttttcgtaattggagtgcgctgtcgaatgttatctcgacatcgacgctgattgcttatttaacggggccggtgacggtgacagctttacgacgacaagcgcctaattttagtcgcccctttcgcttagccggtttacggtggtgggcaccactcgcttacgttttagcgagtctagcaatttactgggcaaagtggcccacgacgattgaggtgtttggcgtcattgcgctaggcctgatcttctatatttattatgaaattcgtcgtccagctggttggcaggcgctgcaagcaagtctgcggggcagtcgctggctgttgttagagatgatctggttaaccgtcatgtccttgattggaagccatgaatttggtggtaccggttgggtggcttatcccttagattttgttttggtggtcatcgggagtctggtgtgctactacttaggggtacgagacgcttaccgcagtgagtcttttgagattgcggttgatttgaacaggcgggttaatgaagattaatctatgcaattaaatagccaccatctgcggtagtgggtctaccgaggatggtggctatttttaatgttgttgccaaatccagtcgttattctgagtggtgaaaccggccgcagctaacaccgttggttcaacgtgggcactttgactgagggtcatggttttgagttgtaactcgtcttgaccaaagtgcacgagacggtcaatgatctcttgttgttccacagctgttagtcgtcgtccttgaatggtcagctgacttgtgcgtgtgttgagatctaagtgtgtaaagccaccccagccaattagtttgtgtgtttggcggcgttcaatcccccaagtcagggcagtttggcccatcgtttgttgcatggttgcgtttacccagtcagccgtttcggccagatcttgtttggtcaattcggcgacatttttaagtttaaactgggttagccaatcaaagcgaaaaatgggggttagtagcgggtgatacccttcaaagctagacatgtctggtgcatcctttccgtttcagttcattaatcatattgtaccggtcttttgctcgttgagccagtgacttaatcgctgtttgactgggagctgtgctatacttgaaagtaacattggtaagttgaaaggggtagcacaatatgacggaagagttttatattgggacttataccaaacggatcagtcgcgggatctatcgggtaagtgtggatacgaccacacccaagctgatggattgcgaatggttagcttctgcaggaagcccaacctacatcgcgaagtctaacgccaagcggttatacgttatcaataagaaagaaactgatggtcaaacacatggtggtctgattatctatgatatgtcggaagacaagccacgagcgattcaacaactcttagatttgggttcgtcaccagcttatgtggccgttgatgaagaccggcaattagtctatacggccaattaccacacagctgcggttgacgtctacgcaatcaatccggatggcaccctgaagcggacagatcaagtaatcgatcaggacccggtcggcccggcaccagaacaggctgatgggccccatccccattttgctgatttaacgccagataaccgattagtcgtgtgtgacttaggctctgatcgggtttacgtgtacgatgtctccgcaactggcaagttgtcagcggttagtcaccttgacttaccagctggttatggtccgcggcacatcgtgtttgatgctaaaaagggtgtggcttacttagttggtgagttgagcagcaacgtggcaacattaagctacgatacggcaacgggaacgtttacggtaaagaccattgtctcaacgattccagacgattggacggcccacaatggggcagcagcgattcggttaagtgccgacggtaagtttgtttatgtatctaaccgtggcaataactcactagcggtatttgccagtgatgaagctggtcagttgacgttggttcagcggatttcaacggaaggcgattttccgcgtgactttaactggactgccaaccagcgactagtgttagtggtaaaccaaaactcggataacgcttcgttatttgaacgtgatgcgcaaagcggcaagttaacgttagttcaaaaagactttatggtgccagaaggtgtcagtgtcttacccgctaagtagcatggtgtgctagtttgttacgccaaaagctcgagacaattggtctcgggctttttgttacgttacatctgaaaataattggcaatcgattaaaagacagtagcgacaagatttctcctgatgctttgttagtgtctcgtcttttaacacacggttaaagtcagaccattatcagcatcgactcctcacgttccgagtaacgcatcaaatagatcgaccagatcgacggatcaatgacgtcacttcaaatcctaggcgtcagtctgtttggtcgacgctaatgctaaccggtttggcccttacagctggcgtcaagagtcctggcgtcacggcacactctaggtccaataactggaaattaaattaatagagaagtcgtttgaaaatagatgtaatttactaggggaatttcacaaataaagagtgtctccccacagatcgctatgggcgagacactcttatttgtgaaaatttccgacgaatacctcgccggttcgcacttaattcattttgttgtttccggaacttctcaaaagttgcatcacgttgtttctggttcttatgggtatccacccgttttgtatacttcatttttttcaccaccgttttcattaattaactgtaagtactatacagcgaaaaccccgtttacgcaagcagaagtccctgtcgttacaggttcccataaacacaaaaaaggccgagacaattgtctcgaccttttcaacttatctagttattcaactgtcacactcttagccaagttccgtggcttatcaacatctaagcccttatttaaactcgtgtagtaagccaacaattgtgctggtacgacacttaagagtggcattaacatctcatcgacatccggtaagactaagtcatcaccatctacggctaaactttcccggacaatcgtcaaggtttgtgcaccacgggccatcgtttcttgtaagttactccgggttaaaccagccgtcttcgcctgcgtaataaacccaataactggtgttccagcctcaattaatgcaatcgtaccatgctttaattcaccagacgcgaagccttcacactgaatgtaagaaatctctttcagcttcaaagctgcttctaaggaaacggcgtggtcgattccccggccaatgtaaaacgcccggttagtctttaacaagtacttggaagacatctcttccagcttatccttttcatccacaatagcttgcatcccagttgcgacgagtcccaactgttgccgaatattgaaattctgcgcaatgatctggccagttaattcacctaaagccttggccaagatagcttccaaagcaatttgggccgtgtacgccttagttgaagccaccgcaatttctggaccggcatgtaacaacaatgtgtaagtggcttcacgtgataacgtggagttttgcacattggtgattgtcaagcttgggtaacccgcatcgttcacgttaaccaaaacttcacgactgtcagctgtttctccagattgggtcaggaaaataaagaatggcttctcagataacatcggttgttcatacgcaaattctgatgacacgtgaacttccgttggaatgtgagccaagttttcaaagaggcgcttaccaatcagcccagcgtgataactcgtcccagcgccaatgatatacaatcgatcagcggcttccattgcttgtagcaattgcttgtcaatattaggttcgccgtgttctgacagatacgtttgggctaatttacgcatcacattaggttgttcatcaacttcttttaacatgtagaatggataagtgcccttgtctgcttcatcagcgttcatgtcaacgtggaaaggtttccgctcaacagtctgaccatcagcgtcttcgattgccactttatctggcgtgatcgttacaacttcaccatccattaattccaagaaatcgtgggtttcccgtaacatggccaaggcatctgagcagacaacgttgaagccatcgccgacaccaattaataaggggctcttgttcttagccacaaataatgtgtctggttgttcccgatccatcattaagaaggcatacgaggaacccttcagcaggcctagtgtcttcaagaaagcctgcttagcatctaagtgatcttctaccgcaaacttatcaatcaactgtacgacaacttctgtatccgtttggctccggaaaggtacatcacttaaatattgcgccttaagttcttggaagttatcaattacaccattgtgaaccaagtaaaagcggtcgtcgttggagaaatgtgggtgcgcattatccacgctaaccaccccatgcgttgcccaacgcgtatgaccaatcccagttgatccgtgaacttctggcgtaatcttagcacttaattcggaaatccggcccttggactttaccaaataatcctggcctttttggtcattaacatagattccggctgaatcatagccgcgatattccaacttttgtagcccattaactaaaattttaacggcgttatcgttacccgtcactccaacaattccacacataagtttatcttcctttgctcgacaccacttccggttatccggtcgggtcggttagtttgattagcgaaatgtatcagttttctctaaaattggtatagactgaaatgttttgaaaatcatctctgaatgactatactttacagcgttctgttagggttgtcaattataaaaaataaaaccggtctatcatttctaacggatggcaatcaccgacacttttctgaaacatctctgccatcagtttaccatagctatcctaaatttggacacaaaaaatggcgggaaccatccccgccacacaaacatctttactttattcgacacccacttcagcccgaaccacatccgcaattcgaccaacataggcggccacagtttcttccgttggcgcctctgccatcacccgtaacaagggttcagttcctgaaggccgaactaacacgcggccgtcaccattcatttccttttccacagtcgcaatcattgcctgtacctgcggattcgtcaaggccgcttgcttatctgacaccttgacgttcaccagcttttgcggataagtcttcacgtctgcggccagctctgataacttcttaccggtaacttttaagatatgcagtaattgtagactagtcagtaacccatcaccggtcgtattaaagtctaaaaagacaatgtgaccagactgttcgccgcccaagttatagcctgacttccgcatttcttcaacaacataacggtcaccaactttggtcttcaccgattgtaaatcatgagcttccatcgccttatacataccgaggttactcatcaccgtcgtcacaatcgtgtcttttttcagacggccatgttctgccatgtactttccacaaatgtacatgatcttatcaccatcaaccaaatggccttcttcgtcaaccgcgatacaccggtcaccatcaccatcaaaagccaacccaatcgctgcgccctgatcaaccacaaacttttgcaattgttcaggatgcgttgagcccacttgatcattgatgtttaacccattcggcgtcgttgcaatcgtatcaaaatctaaattaagatcggcatataagcgagacactaatccactggttgatccattggcagagtcaacggcgatgtgcaaaccatccaagtcatcggcaatcgtttgttccaagaactgaatgtatttctgactaccttctgagtaatcctcaacggtgcctaaaccatcagtcgttggtcgcggtaagtcatccgttggcgcatccaagagtgcttcaatttcctcttccatctcatcggacaacttgtaaccatcattaccaaagtacttaattccgttgtattcaactgggttatgcgaagccgtaatcatgacaccggctgcggcaccttgcgtccgcactagataagccacagcaggcgtcgtaatcacacctaagcgcaatacttcgatccctactgataatagaccagcgaccaaggcattctctaacaattcgccagaaatccgggtatcgcgagctaccaaaacttggggatgggcattttgactatcagcgtgttgcgtcaagacatacccgccaaatcgaccaactttaaatgccaactcaggtgttagttcctgattagctacgccacggactccatcagttccaaaatacttcatcacaaaattcctcatttctcaaattgtttgcttactttgtcgtcgccttgaccatcactttaatcgaggtcggatcaaacgccgttacgttattatcactcgtgtccaatgtgaccgtcttagttgcttgactcttgacgtcactgacatctacgtccacatcaaccttactaagcttctttagctgtgtcgcactgccgtaagcggtgaccttggtggtgtcactgcttagtttatatgtcattccggacgagccattcttcgcgttcaagttcacgccaacctttttactttgaccatccgaggtaatgggtaaattcacggtcgtggttgatggcgtcaaaatgacattcacagttttaccactgcgatcaatggcctcaataaccgcctgactactaattgttttcttggtgttagcgggaaccgtcaattgggcaacgacctgcttaacccgtgatatttcattagcggcgcccgttgctttgaccgttgtcgtatcggaagttgccttcccagctgagtaaccagccgcaatattttggctattataacgaaccttaaccgggaaagagactgtgcgccgtggttcgatatctacggtaattttctccggcttaatcgttgactcaatttcatgattaagtccctcttggtgtaaggtgactttatgcttgcctacgcccagatcgcttaaggctgcataaactttaaaattctgggtgttagcagttgttgtaaccaatgccaacggtccctttaaggtcaccttcaccttttgcggatatcccgtaacaaaatacttattactgttgacattaagctgtaaaggaaccgataccgtcatcgttttggtggccgtcaaagatgtggtactgccggtcgaactcgactgattgttgctagacgacttcgtactattaacgtacgaaaacagtagaatcgctaagatcagcgccagaatacggtagagccacgttgtataacgctcgtttttcattagcgccgcccccctctaaaccgttgatccacccaatctaacgccttaacaaaaatattgttcgtggtggctggtgcctcttgattcatgagttcatttcgcaagaacttcaggtagtcggtctgggttaatccccgtaaaagctcgttgttcttggtgatggacacttcacccgtttcctcagagattacgatggtcaatgcatctgtaacttccgaaattccaacggcggcacgatgacgcgtccccagttctttaggaataagattactttcggatagtggtaaataggctgcagcgaccgccacgcgattatcgcgaatgatcacagccccatcatgtagcggggtgttgggaataaagatattaatcaataattcgccggttagttccgcatccaaatcaatcccggtttcaatatagtcttccagccccgtatctcgctgaattgtcatcaacgccccaattcgccgtttggacatatactgaatggctttgtctaaaccatcgatcactttattagcagcttcattttcatgtcggacccgcacaaatagtgagcctcgacccagatgctccaagccgcgccgaatttccggttggaaaacaatgatgatcgcaataactgaccagttaatcacctgatccactaaccatgaaacggtgttcaagcctaaataagcgctaataaaccggacaattagaattaagatgacgcctcgaaagagttgaatcgctttcgttccccgtaacatgacaatgagttcataaatcacgaaccagacaactaaaatgtcgagtaggttcaccaaatgccccaaagtcaggagatttccccaatccaggttcataactttccctccaaattgaattcaaattttattatagcacggccccgcaaacatttcgccctgattcacataatccagcgtaaagtcccgttttaaccgactaaaatgcttatggatttcttaaagtctatattagagggtcattattacttggataatctgttaacatagaagtcatattctgtccgcttacagcgccggcgctgtaaaatagaggtagttagttgtgaaaggtctggtgattgcttatgagtcggcgtgcccgctgggaaattcggggctttttcattgtctggttaatttttctctttttccgggcaaaagatccctttggatttcttgtccttaatacctttttgggatacattccaattgaactgagcttccatatcggtaaacaacgtccgcgtagtggctggcttttttggccgttggtcttgatctggttgctcttttatccaaacgcgccttatttactgactgacctctttcacctttcgcttctgcaaccatacgcggttagtggcttactccgagtaacaccatacttatggatctatttcacctatatgctgaccagtgccgttagttgcgccttcttgggtttctggagtttgaactatgtcagtcacgtgttaaccgcccgaatagctcatgataaccgtggcgtacggttgctcgttgtcttaaccttaacattcttaacctccgttggtgtctacattggccggttcttacgtattcataccatctatctcttcttgaatcctgaacaatttattcgaccactactaaatatgtggaccagtaatttatggattttcgttggtctaatgacctttatccaactattctgctattgggttttgcatattattatggcgaataatccttctaaattggctgaatgactaacaccatccaaaaactcggtgacccccatcagggaccaccgagtttttatttagccatcttcactattcaaagacatcacgagcacgttttctgagtaattcacgtattgccgcaaatgtgacgccatattccaagtaatgtttccggcttccaacaaggtctgaataccggaacgctctgctcccaaggctctgacccgcatcttattaatctgatgctgatactgttcctcatgaccgggcgccgtttctgccttagctcgttcaatgcgatttcggtattgaaccaataaatggtagaccgcttggttatcgaactgggtctcatcaacgtctgaactcgccaaatattgcgataacgccttgatggcggccttagacgtttctcgttcaatcaagtggctctctgcatgtaaccgctccgtatcctctgagtgcagccagtaagccgcgttacggaacatatgcttgaaaaagactcgccaatagcgcataacactgggcatcgtatttcctgctacctgagtcaaccgactttctaggttttcaattcgacgcaaggccccgacataactagtttgcgtaattttttcggcctgtcggagttctttaagtgaggcccgttcaccagccaaggccacttgtcttaatttaatctcatcggctaaaaccttttgcatagcagtatccgcgcgatagttcatttccaaccgacggataataaattgataatccaaaatcaaatcataggctgcccgctgattgtccggtcggcgcatctcttcaatcttcgagatggctaaccgcatgatgtatgcccgcgcttcgtcctcactaatctgtcggacttgatcggcgggaatctcatcgccatcagcatctaaatcaatctcattggcaccttcgtcactagcactcgcccgtgtttgtaacggttgcttagacgtcgaaattaatggcaacgtcaccgtggcagccaccaaactaatgataatgacccccgatgccacaaacagcatcaaagaacgggtggggaaactcgcaccagaagcaatggttgctggcaccgatagtaccccggccatggtcacggcacctctaacgccagaaagccccgacagaagagacatccgaaaccctggacgatccttgggtgctttgtgatttaaccgttcaaataacacgtaaccatacgtccaagccgttcgaatggcgaccaaaataatccacgccataaacgcaaagaacaaggcttcccacgtattgaactggccgcccttgatcacttcagaggttgcgactggcagctcaattcctaagatcacaaagacaatcccattcaaagaatagataataatgtcccagactttttccgtaactaactttaactccggcgaatcatcaacgatccggttctcccgagcatgaaataacacacccgccgtaaccacggcaatcacgccagaagcatgcgtaatctcttcggtcactagataaatcacaaacggcgtcgcaatttggagcaccgtattgaaaatcacatcatcgatgccttggcgccgcaagacatccattaataactgaatagccgtcataaaaattaacccggataagaacccgacaatactgatatagaagaaatcccccacggccgttcccgccgagaaagttcccgtaaccgtcgccgcaatcgcatatttaaacgcaatcaggccactggcatcattgattaagctctcaccgctgaccaaatgcatcagactcgctggcaatttggcttgcttagaaattgactgcaccgccaccggatcagttggcgacaaaatagccgccaacgctaatgccacggtaaatggcatcttcggaatcaactcatagatgagaaacccaccaagaattgttgttagaaataccagccaaatggcattggcgaaaattggcccccgcaaccgccacaattcttgtcttggaaagcgccggccatcgttatacagtaatggcgcaatgaatagcaacaaaaaccaatccgtttccagcggcacttcgaattgccacactaatgcgaccactaggccaagtgcaatctgaattaaactaaccggaataaacgtgaggtagtgactgataatattggaaagtaacactaacacaattaacagaatcactgcttcaactataggcacataaggtcactcctttttatttttgagtcgttggctcttcaccaataatgcggacctcagtttctaaggtcacaccatctttttctaaaataacggcttggatatggtgaattagttccagataatccgttgcagttgcatggtcaatgttcacaataaacccagcatgtttggtcgacacttgggcgccaccccatttcaaaccttgcaacccagcttcttgaatcaactgacccgtataatgtccaactggacgcttaaagacgctcccacaggatgggagttctagcggctgtttagcggcccgccgtgcattcaagtcatccatttgggcttgaattgcggcaccatccccaggagtcagcgcaaacgttgctgtcaagacgatatcatgataatcctgaatcgaactatgccgatagccaaaatcaagttctgcttgatttaaggtccgaatctcgccttctggcgtcaagacctcagcggcaactgccacggtgctaatctcaccaccataagccccagcgttcataaagattgcccccccaacactaccagggatgccggcggcaaattccaagccacttaatgcatgtgcttgggccacctgcgtcgtcgtaatcaatgccgcccccgcctcagcggtgaccgtattaccggctgttgtaatggccgccatctgtgtcagaatcatcactaaaccacgaataccaccatctcgcacaatcagattactagcgtttccaaccactgtgacgggtaagctaatctgattggcatatgctaacagtgacttggtctcctggacatttgttggaaaggccaagtagtcggcgggacccccagtcttcgtgtgggtgtaatgcgctaaaggctcatcacgcaaaatcttaattgctggaaatgccgtcgctatatctgccatcatcatgaattttccctcgttccgcaaagatttaagtaccgtttggttaattaccgatcaaactttttgaacattaatagtcctattttaccatgaaacaccccctgttcggtaatcaacgcttcaattacagtaaaatctaacttttctggtatactaacaagtagttggaggtgccacatgaaatttatttcttggaacgtaaatggcttacgggcaattgtcaaaaaagggtttgtcgagacctttcaggagcttaatgctgatttcttcggcattcaagaaactaagttacaggccggacaaattgaactcgatctgccaggctattatcagtattggaattatgccgaacgcaaaggatactccggaacggcactctttaccaaacatcaacccctgaatgtcatctatggcatcgatgcgcctgaatttgaccacgagggacgagcgattacgttagagtatcccgacttttatgtcctaacctgttacacccccaactcggggagcggccttaaacggcttgactttcgtctaggttgggaacacgccttcttgaccttcattcaaaagctagatgcccaaaaaccagtgattttttgtggtgacctcaatgttgcccataccgaaatcgatttgaagaaccccaaaaccaatcatcataacgccggttttaccgatgaggaacgagcgaaaatgaccgcgctactagcggccggctatacggatacatttcgttactttaaccccgatgtgaccgaacgttattcttggtggagctaccgattccatgctcgcgataacaatgctggttggcgaattgattactttatcaccagtcagcgcttgcaaaatcatctgcaagacgctaaaattctagaccaaattatgggttctgatcattgtccagtggagttggacgtgactgatctcactgtttaattgataatcgaaaggaaagatgaccgtgaattttgttgcaatggactttgaaacggcaagtggcaaacgctacagtgcctgctcgcttgccctcactattgtccgtaatgaccaagtcgtcgacgagttttactcattaattaagccggataccgacttcttttggcggaatgttcaaatccacgggattcatgaacgagacgttgccaacgcccctaccttcccagaagtttggcagcacgttgccccattctttcagcgggatcgcctagtgattgcgcacaatgccccatttgacaatggcgttttacgcagtagcttggaacactataacctgccacccgcccggtacctgacattagacaccgttaaaacgagtcgcaaatttttcccagaatttccaaaccataagctagacacagtctgtgacgaacttgacattgacttacatcatcaccacaatgcgctagatgatagcctggcatgtgcgaatattctgctttatgaagcccagcattttgggacacaaccactgaaatcctttgtttcagtcaccgcttagccaaagctggtgcgacctgctatatattaaaaaactagtatctgccaatttatttttggcgatactagttttttgatcacattattttgcggaccagtcaatcggtgcttgtcgatccaagattgtatcaatttccgttaattcagcgggcgtaaagtccaaatgatctaaggcctgaacattagcgacaacctgttctggacgactagccccaattaggacgctcgccatcgttggttgccgtaagttccaggccaatgccatctgcgccaaactctgatgacggcgttgagccacctgattgagcgcctgaatcgtctgcaaggtctggtcaacttgtaccggatgtaagaacggaatcgttgccttattggcccgcgagtctgctggcacaccatgtaagtatttatctgtcaatagtccctggcacagtgaactgaaactcaccgcagcttggtgctggttggctaactctgggagtaagtccgtttcaatctgccgatttaataaattataacggggttgattgataatatagggggttcgtaactcccgaaaaatctgggccatttgccgcgtttgttccccattataattggataatcccacatacaatgttttaccggaacggaccaattgatccaacgccaaagcggtttcttccggatcggtttgcgggtccggtcgatgagtataaaagacatcaaagtagtccaagcccgtacgccgtaagctctggtcagcgctggcaatcagactcttacgtgacccccaattaccataaggcccaggccacatcacgtagcctgccttactggcaataaataactcatcgcgataagcgtgcagatcccgggccagaatccgaccaaaattggtttccgcgctaccaggttccggaccgtagttattcgccaaatcaaaataggtaattcccaaatcaaacgcttggtgaatgattgcggcctgccgatcattagcatcgacactgccgaagttattccacaatcctaatccaatggccgataatttaacgccacttgttcccaaagaacggtaaaccatccgctcataccgctgtgaagctgcttgatagatcatcatctttgtcgtcaccttaatttgctgaatgtcgttgatacaccatttcaatagcggttactgattgcccactggcatcaatgaccgttgtggccggattagccgtccgctcaaagcccaatttttgataaagcttaacggcgggtacattacgtgtttggacttctaaaccaatcgcttgcaagtcactcgccgtttccaaccaatacaaggcctcatcaaccaatgcggtaccaatccctacatgccagtaggccttagcaactgccacgcctaattcccccacatttccctgtggcgttggcgcaaccgaacacacaccgatcaactgcggtcccacgctggcaaccagcaataagtggcgggtactctgctggatctgaaccagctgatctgcttcttgagcagcgctgagtggttcatcagcatctactaaactaaacgtatgactctcctgttggagctgatccatcagagttaaaagcgcctgggcttccgttgcttctggtagccgaatgctgacttcttcactcatgagccaccgccaattgtgcaactaatttttcaaaatgcgcactgactggctcaaagcgtaaggttcgttgagactctcccgcttcatcatcccgtttgaaaacgattcgtaaataagcggccggtagttcgtccgcaatgaattttgaccactcaataacattaacaccatcgccattaaagtattcatctagccccaattcatctccaccaccattttctaaccggtagacgtccatatggtacaacggtaaccgaccaccctgatattctcgaataatggtaaaggtcggacttttgacgtgccgtttgatgccaagcccgactgccagtcccttagtgaatgtcgttttaccagcacctaaatcgccatctaacaaaataacatcttgggcatgtaacccagctgctaattgttgtccgagtgccatcgtttcttccggacttgttaccgttatttcaaacacgcctgtcacatccttttcttcttaactatctgattacccataaataatacccggaccgctaataaatcgcaatccgggcacctcttttatccgttatagtgattgtgccgccgtaatgatggctaccttgtacacatcttcttcattacacccacgagataagtcggaaactggcttgttcaagccttgcagaattggtccgatggcttcgaagccgccaaaccgttgcgcaatcttgtagccaatatttccagattgtaattcaggaaagacgaagacattggcatgcccagcaaccttagaatcaggcgccttttgcgtcccgacactgggaacaaaggccgcatcaaattgtaattcaccatctaatggtaggtctggcgccgattcatgggccaaagccgttgcctcttgaaccttcgtcaccatatcacctttggctgatcctttagtggagaagctcagcatggcaactttgggatcaatatcaaagaccttagccgtgtgcgcactttcaacggccacttcagccattccagctgcatccaattcaatattaatcgcacagtcggcaaatacgtagcgttcgtcacccttttgcatgataaaggccccactaatacggtgaacgccagctttagttttaataatttgtagggctgggcgcactgtatcaccagttgcgtgcaccgcaccagaaaccataccgtcagcctgccccatataaaccatcatagttcctacgtagttcggatattttaacatttcggcagcttgttccggtgtattcttacccttacgacgttcaaccaacgcatctaacatcgcctgatgttgatcgcttggcatctgggctgggtccagaatcgttaactggctcagatcaattgcatggttcgttgccgtggtctcaatctgactttgtttgcccaagacaattgctttgaccaacccatcagcgaccaatcgactagcggcacctaagacgcgttcatcctccccctcgggaaagacgatggttttattttgaccattaattttttgcttgagactatcaaaaagttccataaatgacgacctccaaataaaatatcccacgaatcaattctcttatggttacccagttaatgtgtgtctgaggttgactcatcactgatggtcacctgctgcggcaactgccagtcaatgggtgtttcccctaatgatgttagtgcgatgttggttttagaaaacggtttggacccaaagaaaccacgataagctgataagggactaggatgtggtgactgtaacacaatatttgtctgggtatcgatcaatttaatttttgaccgcgctgcactcccccacaaaataaaaatcacgggttccggccgggctgatagcttttcaattgctgaatccgtcagttgttcccaaccatgaccccgatgcgtgttagcggttttaatcccatcccgcacggtcagcaccgagttcaagagcaagacgccttggtcagcccaatgtttcaaatagccgtgttgcaccggttggacgcctaaatcatcttgtaactctttataaatattcaccagtgacggtggtatttcggttcccggtaaaaccgagaaactgcacccatgcgcctgacccggattgtggtacgggtcttgacccaaaataaccacttttacctggctaaatggcgtccactcgaacgcggtaaaaatgtgatacatgtctggatcaatccggtaatgttgatactcctccaccaagaagcgccgtaattcttgataatagggcttctcaaattcgggttctaataccggccaccaatcattatgaataaacggtttcattcccaacacctcggttttattttagcatacccgccgcgcaaatgatattattcatcgccgaccgatgaaacatgttagaatgaacacagtgagttgttcatttactggataaggaggatccccatgcgtgtactttatctcaatcaagctgcactatcggctaaggcgacatccgttgttcgtgaccaacataaccagtcacgctatttactggttggtaaatggggactgcgggctgacgttgtctcggtttacaccattgccgggagtttggaagctgaggtcaaacaagaaacccttggcctgctccccaagtttcgcctcctttatcaccgccaactcgttggccgcgtcagcaaaacgtttggtgtcattcgcgaagtcctgtttgtccgaggattaaactggattatcatggggaaccttaaccatgggcactttaaaatttatcatggtcgcgacctcatcgcatccattgatcgggtctccgcctccggtaacactgtcaccttaacggttgaccatccagaccatgaggccttagttatctgtcttgcgacgattttggatcgttgggccaagcatcaacaacggctaccgaatccgctgaaagcttgggcaccacgaaccctgtctccgggtgaagtagcaccaagcatagcgcgacaacctgtaaaaaaactagctgactaattatgatattaataaaaacaatcgctatcttcagaattcgtggctttctgaaaatagcgattattttttagtttccttgaagccgccaccggcatgcgctggctacacattcaagattttattcaaaaaaacctttgttcgcggattctgcggatgctcaaataccgcagtcggtgtgcccaactcctgaatgatgccatcatccataaaagcgacccggtccgccacattttttgcaaatcccatttcgtgagtaaccacgaccatcgtcataccggactcagccaattgctgcatcacggccaaaacatcaccgaccatttctggatctaatgccgaggtcggttcgtcaaataacataatttctggttccattgctagagcgcgggcaatggccacccgctgttgctgaccgccagacagtgcatggggcatagctgcggctttatcagcgaggcccacttgcgccaacaacttttttgctcgtgcatcagcatcagcccggctcaacccattaagttgtacggggcccagcgtcacgttttgtaaaaccgatagatgtggaaataaattaaaatgctggaaaaccatgccaatgttttcacggatatgattcaggttaacgtgcgggtcaccaacccgttgaccgttcaccatcaccgtcccactcgtaactgattccaatccatttaagcaccgtaaaaatgtgctctttcccgacccagatggtcctattaaacagagaacttcttgttcctgaacatctaatgtgagtccttttagaatttcgttttgaccaaacgacttatgcaagtcgctaacctgaatttttgccaccatccctattaacctcccgatgaaaaaaggagacaaccaaacgaaccacgttctgttgtctcctctcagtattaataatgcttcatcacccgtgcaatttgccgatcttgttcacggcgtttaatggtttctcgcttatcaaattcgcgtttaccttgggctaccccgataaggaccttggcaaaaccatgcttaaggtacatccgcaatggtaccaacgttacccctttatccatggtcgcctgtcctaaccgccgaatctcttttttatgcaacaagagcttacggttacgcaatggatcatggttaaatcggtttccttgaacatactcactaatgtgaacattcatgagccaagcttcattattgcgaatttgggcaaaaccatcttgcaagttaacccgtcgttcgcgcaccgacttgatttccgttccagtcaaagcaataccagcctcgaccgtttctaacacggtgtaatcatgacgggccttacggttctgcgctaaaacattatctggtgttttcttggacttcttttttgccaagttgtgtcacctcgcttagtgccggccaccttgcgaattgttccgttgttgaccaccatggttattgttattccgatggttgccaccattgtgcgaattcgttgaccgttggttattgttccggtggttcccgttactatggttcccaccatgctgattaccattgcggttgttgttactccgcccgtgataattgccaccacgtgagcgatgttcacgatgcggcagtaagtcactgaccggtgcggcctctggatttaacagttcaaagtcaatttcactttgttctttatcaacgtgaatgaccttgacccgaatttcctggccaattcggtaagttcgccgcgtattccgaccaaccagcgccatatacttttcaacatattcgtagtaatcatcttgcatccggctaatatgaatcaagccttcaatcgtattaggtaattcaacgaacatcccgaacttcataaccgaactaacaaccgcatcgaactcttcgcccacatgatcggccatgtattcagccatcttcatgtcattcgtatcacgttctgcatcaattgcgcgccgttcagcctcagatgtatgaacaccaatttcttccaaaattggggcaaacttttgcttgctggcatcgttaataccgtgatcttcataatagtgaatcatccgatgaaccatcgtatcaggataccggcggattggtgaagtaaagtgggtgtagaattccgcgcccaacccaaagtgtcccaaggattgatccgcataccgcgcctgcttcaagctccgcagcatcataaccgacaccatggtttcttcaggcttaccggctacttgctttaagaccccttgcaacatctttggccgtaggtgattaggatcacccttaacattgatcccaaaggccgttaagaattcgaagaaactcttgacccgatcaccatctggcgtttcgtggacccggtacaagaacggtaccttcgcccggaaataatgttccgccaccgtttcgttagctgccaacatgaaggattcaatcatgcgttcagcaattccacgagtccgcaactgcacatcaatagcgtggccttgtgcatccacaatgatttcagcttcacggtcatcaaagtcaatggccccgcgttgcttacgatgcttgaccaaaatccggtgtaagtcacccatgtcttcaaacatcggcaccagttccttgtaacggtccatggtcaattgatcgtgggcttctaagacctggttaaccgccgtatacgtcattcgtgcttttgaacgcataactgacggatgaatccggtgcttcacaacattcccggactgatcgatttccatgtcacagctcatacataagcggagttcaccctcgttaagagaacaaatcccattagacaaacgccgcggcaacattggaataacccgatcggtcaagtagacactcgtcccccgcttgtaagcctccttgtctaagatagaatcttctttgacgtagtgggacacgtcagcaatgtgaacgcctaaatgatagttaccattaggcaacttccataccgttacggcatcatccaagtctttggacgactcaccatcaatggtaaccaaatcttggtcagtgatgtcttcacggcctttggtttcctcaggcaagacgtgatcgggaatttcgtcagcggcctgcatcacttcttctggaaattcagagggaatgttgtgttggtagaccacttgtaaaatatcaattccggggtcatcaacactaccgatcacttgcttggcaattcccaccatagcgtcgggatgctctgcactcggatattccgtaatttcagccgtaacaacttcgcccggggttgggtttaagcccacgttggtcacatagaacttatacttcatgaccttcttgtccgtcaaacgaacttgccccaagtaacccgcatcgtcgtcggtttgcataaactcaccgacaacttgttcgtagtgatgctccacgatttcggtcactttaccttcgggtcccttaccgcttcggggatcgcctggtcgaatgatttcgattttgactgtatcgccattcaaagcccgcaaggtattgtcaggtgcaatgtaagcgtccggctcgatcttattttcatcataagccacaaacccgaaccccttatcattgccatgaaagattcccgtcaaggttcgttggctgggatctaattggaaatgaccgtgatcggtaacttgaacaagcccgtcacgttctaattgcgccaattcctgcacgatgagcttaaatgcagctgaaccgtgataatggagcgcatctgaaatgccttcaactgtataactttggtccgaatgtgatcggaagaaagctgttaaatctgtttttaaagtattatcttgcactatctattcctcgttatttttaaagattgtttgtaaaaacgccaaaatgtctgtttccaatacatggtgtgccgcattaaccgtcagcacgtggccggcaccggcatactcatgaaaatcaatttgttcagatggataagcatctgctagccattgcccagaacgggggtcaatcatctgatccgcgtcaccctgggcaataaagaccggttgtttgacacgctccaagtgggtcgccgtggtatctgcaaatgcctgaattgctgtcaattgtgctggcagctgttccttcagccaggccaagcgcttagtctgttcatcgactgacaacccttgtgactgataatccgcctgggccatttgcataaatgttgctggcacgttagtctgcccccgaaagataacgggcgacgcaatcgtgccaccaccttgcaactctgggtcagccatcaaagcccgcgtcgcaaagaggccgcccaaagacaacccaaagatggcaatctgttggtaacctcgctgccgcaaattggcaatcgctgtttgcgtgtcttgccaccattgctgtggtgaaccctgccgtaaaatatccgcgggatcaccggttgcgtggcccgaaaagatgggcgctaagacggtataattctcgctctgaagtcgccgagccaataaccgcatgtcgttggaactaccggagtaagcgtgcagtagaatcactgcttgaggtccctgctcaaagaagagcggggttggttttcgaatcatgtaaaaccaccactttccgctattttaaagttactctgtaaaaaagccccctgtaacaaacaaacaggaggcccacattttactctagtgtgatgataaataaactaaagccattgccaatccaaaaaacaggattcccaaaacaactgtgactttttgcataaaagcttcaaaccctcggggtttctgctttgcaaataagtcatccgcaccaccagataaagcggataacgcgtcgttggtcttggcgggctgcatcattactgcgataatgatcagcactgcgacaattaaaatacaggtcattaaaaagttatacacgaatttgcctcctacctatcgaataggtctaataggtctaactatactccatctaatttatcataatcagccacgttttaccagcccccggcttcgttaatcgctcggctgggtagaagaatcgtttaagtgggtgagttgttgtcggacaaatgcccgattatgctgataggtaaaaatcaacagggtatctcctgctcttaagatcgtgtcaccgttcggaatcacctgtcgttcgccacgacggatgcctaccagtaaggtatccggtggccaagctaagtcccggacctgccgtccagcaagcccggccccctcattaacgggaaactccaattgatcagttggcccatctgactgggcctttgcgggaaccaccatttgttgcagcatggcttcataaattggtgccccgcccaaaacatcaaccgtaatgtaagccacaattgccaccactgccagtggcattaaatgttgaagcgtgcccaccatttcagtgattaataaaattgctgtaaatggcgccttggaaataccggcaaaataaccagccatcgcataaatcataaaattagccacatacatagtcggtaaccaaccaacagcaacaaagcaccgcgcgccaatagcgcccaacaatgcgcctaaggttaaaatgggcagaaaaataccgcccggtagccccgagccatagctaatcgtcgaaaagacaaaccggagaataaaataaccaattaatggtaccaataacggtgtttgctgggcaaactggacaatcaattgattaccgccacctaaagtaatcggccaccaaagtcccactggaataaccaataaaaaggggatgattccgtcaaactggcgtggcagccaagttaatcggccataccactggccaacacggagcgttacccactggtaaccatagcctagcccgcctaaaccgatccccaataggagcaacaggccataatacttcagcggtagggcctgccgataaacaatatgtaacaccggcgtcaatccaaaaatttcgttagacacgaagttggcaacaacggcacttgtcagtgatgtgagccatactaacgttgaaaagttgtgataaacttcttccaaaataaacaaagttgccgcgattggtgcgttaaaagccgcggaaagtcccgcggaagccccgctggctatcatcaaacgacgccgactgccactaaaacctagccggtctgccaacccctgagccacggtaccacccaattgaattgatggcccttcgcgtcccaagaatagcccggacccaatgcctaaaataccactaacaaatttcttccagaggactggccaccaagtatagtcaaattcaccagccaattgcccttcaatttggggaattccagaacctttaatcatcggtgtttgtttgacccaatgaccaatcataagtgccattaacaccaatagaatcgcccagggaactagtccccacggatgctgacccaaccagccatagactgcctgaaccaagcttaaaagatgttcaataatcaatcggaacgtactaacgacaattccggcaaataacccgactaaacaccccaaaacaatggcatttaatcgggttagatcatgctgtgttcgttgctgatgtttcatgagtcgcttgcacccccactagtaaataaatgtctatttaccagtttagcacacatatttctaagaataaaaacgaattcgccgatagacaacgtatcctaaacatcccccaataccggcgaatccccaccaacttgcggcacttgcccgttcgttggtctggggcagccgacgagttgcatggagtgttgtcgccttagctgttgcagtatcagaacttggcacggacgctctgactgtccgtaatcgcgacgtctgtgtattccgtacccggcgatgattgtccctaaattctttaggtttggtcatagacggtgagcgtaggacttgttttgctgcttgagtcgtcggaatggactgccaccaatcacgcggagcttgatgaccaaccgaagccgagggacgaactggcgttggctgtttagttggcttatctcctgtcgctccaacagtcgtctgatctaaaatgggctgcggcattggtgtcggggtcggctgtggcatcggcaagggacttggttgcggtttgggaatatctggcgttggcggttcaggtgttggttgtggcttgggaatatctggcgtaactggttcaggtgccggttcaggtgccggctttggtggagtaggtttatccccaccagatggcgtttcggcgcccgtcactttctgaaccccaatggtccacgtgtcttccggcagtaacgcaaatcgttcagcgacttgcgaggccgccagttggtacccggttggtgctgtgatatagacgagtccaccaatttgcaacggtgcctttgattcacgctgactgacaacggtcttttgttcatcaacgaagcgcaaatgaactttggccacgttgtatgccatcgctacatagcgaattattctagcgctactacctggacgatcggccgcaggtggtatatatagcggttttaactgtgataactgggggtgcccgggaaatggttcccccggaatcacttgctgcttaaccgtcgcaaagacacgtgaagctttaacgcccaattcatcacgcgcttcaactttatacatgatctccaactcgtacggttcagcagcctgagcgctcaggctctgacttccccaaaccattcccgttaagatcacggctaggtgacgcactattcggtgccatttcatcatcaattcctccctcgttagcaataactccgtagaaattaagactaggcatgccaaacaacaaaaaaagaagcaaacccatcactgagtctgcttcttcattttcactttggcttacttgttgacgatggccatccgcgcatcttcatccaagttgtagaaggagtgaatccccttgtattcggaagtcttacctaattggtcttcgatccgcattaattggttgtacttagcgatccgttcgccacggctcatagaaccagtcttgatttgaccagcgttcaaagcaacaaccaagtcagcaatcgtggtgtcttcagtttcaccagaacggtgagagatgacagccgtgtaaccagcttgcttagccatttcaacagcttcaaccgtttcagtcaaagttccgatttggttcagcttgattaagatagagttaccaacgcccatcttgatccccttagccaagtagtccgtgttcgtaacgaacaagtcgtcaccaaccaattgaaccttcttgccaagacgttcagtagccatttgccagtcttcccattcgttttcatccaaaggatcttcgatagaaacaactgggtacttgtcaacgatgctttcaagcaagctaacgaattcttcggccgtgtattctttaccgtcaccaactaattcgtacttcttcgtgtcagcattgtagaattctgatgaagcacagtcaaaggcaatggcaacatccttaccgggtacgtagccagcgttcttgattgcttcaaccaagatttcaaatggttcttcgttgttcttcaagtcaggggcaaaaccaccttcgtcaccaacggcagtagagtaacccttttcgttcaacaagttcttcaaattgtggaacgtttctgagcccatccggatagcttccgtaacagacttagcaccaacaggcataatcatgaattcttggaagtcaaccttgttgttggcgtgcttcccaccattgataacgttcatcattggtgttggtaaaacatgaccattgaacccgcctaagtagttgtacaaaggttggcctaattcgtcagcagcagcacgggcagcagccaatgaaacacctaaaatggcgttagcacctaacttacccttgtttggtgtaccgtctaagtcgatcatagcttgatcgatggcccgttgatcagtcacatcgtaaccaatgatttccttggcgatgatgttgttgacgttatcaacagccttagtaacacccttacccatgaaacgactcttgtcgccatcacgaagttctacggcttcatgttcaccagttgaagcaccagaaggaacaatccctcggcccattgcaccggcttcagtgtatagttcaacttcaacagttgggttaccacgagaatctaagacttcgcgtgcgtaaatatcagaaataatagacatttttgtattctctccttatgagtgtttggcttcacgggaacaaaacgacaatcccatgtttcattctataagtttaactttgaactttcaatcacattttgaccgaattacaaattttggtagttagccagctgaataaatgaggtttcatccaaactggaaccacccgctaacacaccatccacatttgatttagccatcaaaccggcaatattatctggcttcacactaccaccatacaatacccgcacaccgttggccaaatcatccgagtagatgtcagctagtgtctgccgaatcaaataacaaccctcttcggcctgatcagatgatgctgaggtgccactaccaatcgcccagctaggttcgtaagcaacgacgatcttagcggcatcttcggcactaaccccttttaaggctgctgaaacttgattaacgacccaatggatcttttcaccagcagttcgccgacccatcgtttcatcacaacacagaataggtgtcatgccgttacgaaagaccgcttgcaccttacgattaatcacatcatcggtctcattaaagtaccggcgacgttccgaatgacccacgatcgtgtagggaatccccatttcatgaagtgcccgtgggctggtttctcccgtataagccccttcatcttcgtagtaacaggtttctgcagcaactcgcagtgtcccttcagcattggcatccagcatcgtttgtaaaaacaacgctggcgccgccacggccgtttcaataacatctgcctgcggtaattgaccctgtacggcatcgatgaattgacgtgcctcagtgaccgacttattcattttccaattaccagcaatgagtggtattcgcaacctcatccaccccttctaaataataaattgattacgctccccatcttaccgaattcccgccagattagccagcgaagaccctttattggtagtagcaatcacaacaaaaagccatggtgacacccaccacagctcttcattaatttatttgtcagaaattgcagcaattcctggtaacgtcttaccttcaaggtattccagagaagcgccaccaccagtagaaatgtgggaaagcttgtcagcaacaccaagttgttgaacagcagcagtggagtcaccaccaccaacaatggtcttagcattcgtcaacgtacccaagaacttcccaatttccaaagttccttcggcatagttgctcatttcaaagacacccattgggccgttccaaacaaccgtcttcgcatccttcaagacatccttgaattcagcaactgacttagggccgatatccaaagccatgtagccatctggcacgtcgccttcgactgtcttatgtggtgcgtcgttgtcaaacttctcagcaaccacggaatcaactggtaagaccaacttgtcgccggccttgtccaagatttccttagctaagtcaatcttgtccgtttcaaccaatgaatttccaatcttcatccccttggcagcgtagaaggtgtaggtcatcccaccaccgataagaatcttatcagctttagccaacaagttatcgataacaccgatcttatcagacaccttggcaccacctaggatggcaacaaatgggtgttctgggttatcaacagcaccaccgataaaggtgatttccttttccattaagaaaccagcagccgtttggctcatgttagaagcgataccgacgttagaagcatgtgaacggtgcgccgttccaaatgcatcattaacgaagacatcacccaatgaagcccagtacttgcccagttcagggtcgttaccagattcacgcttaacgttttcgccatccttgacatcttcataacgcgtgttttccataaccaaaacatcaccgtcatttaagccatcaattgcgtcttcaagttgcttaccttccgtggttggaacgaaagtgactggcttgtttaacaagtttgacaagcgttctgcgactggacgcatggacaaaccaggcttgtcttcttccttcttgatccggcctaagtgggataagagaatggccttaccaccatgttcaatcacatacttgatggttggtaaagctgcgacgatccggttatcgttaccaataacgccgtctttgattgggacgttaaagtcgacccgcatcaggacttttttgccctttaagtctaaatcggaaactgttaatttagccaatttggaatcctccttgaaaatatcatttaaaagattactttcacaatatacagcacttatcccagaaattcaaaggacttatgcattttttaatcgactaacaaaaacgtggcggagaaattacctccctccgccacgttcgtgagtcttattttaaaatgttgaatcagcttgtagattagagcgttgcaaagtgcaataacgtccgaaccatgttacaagtgaagccccattcgttgtcgtaccaagcaactgtcttaacaagttgcgtgtcaccggcagtcgtaacttccgtttgggttgggtcaaagacagaaccatggtcgtcgtcgatgatatcagttgatacgatttcgtcagcattgtaaccaaaggcttcgttaccttcagtgtgcttcttcattgcatcgttgatttcgtcagcagtaaccttcttgtccagaacggcaactaattcagtcaaagaaccatcaacaacagatacccgttgtgcatggccttgtaacttacccttcaagtcagggataaccaaaccgatagccttagcggcaccagttgagtgaggaatcgtgttaacactggcagtccggttgttacgcatcttcttgccacgagggccatctaagatttgttgcgtagcagtgaaggcatggatcgtcgtcatagtcccggccttaatcccgaattcttcattcaagaagtaagccattggggctaaacagttggtcgtgcaagaaccagcagaaacgatgatgtcatccttgctcaaaacgtccaagttaacgccaggaacaaccgtcgtaacggcaccggctggagcagatactaatacccgcttaacaccagcatcgatgtgggcgtgagccttttcttcagaagtgtagaaaccggtacattcaaggacgaagtcaacgccgtcgttcttaacccaaggaatatcttgagcctttggttcagcgtaaactgggtattccttgccgtcaactacgatacccgtatccgtagcagaaacttcgccagggaaacgaccatgagttgagtcatactttaacaagtaagctaacattgagggcgtcgtcaaatcattgatggcaacaacttcgatgtcatttgacttgagttcgtgaatccgcttgaaagctaaacggccgatacggccgaaaccattaataccaatctttacagtcatactgtgatttcctccttcaggaagcaaacaaagaatatttttttaaaaagcagtacatgttaagtgtatcacttttttaaaacaaagtcagcagcaccttcatcagtaattaaccaagtctgtgctggcgccaaacgcatgtatgcagcaatggctgtgcccttttcggcaccaccagccaccgcaatcactaattgtttagcggctaaatcgccaatttccaatccaattcggggaaatttgctcaccacgtggccctcagcatcataaaaatagccaaaggcttctccgaccgcatgggccgcagccagatcagcaatcacgtggggcgccatcttgcgccgtttggccatggcaaacgcctgaccaattccgtgaatcacgacgttactctgcccaattaattgcaacacctcatgaatggctggttctgcaaataagggcttataggttgctgtcgttaactgttctggaacatacaattgccgaaaatcactattggtctgctgggccatctctgcggcaaccgtgttagcttgaatcgccggagactccccaacaccaccacgggcagggacaaacaacaattgacgattaatcgacaaggccggtgtgagcgcctgggccaccgctgccaacgtatgaccgcccattacggcaactgtactgtgtcccgttggcatttcgtcggtcaagactcggttagctgcttgggccatggcgttcaatgacccattagcggctgtactatcacccggcacaatcgtacaatgggcaatatctaactgttgcgccagtgtctgttcccgttgttgccgaccagccaagtcattcattaccggtgctaagccctgcaaaacgcgttgcccagccgccgtaacttgcatgcctttgaccgacatttgaatgtagcccaagctagctaaggcatcggttgttgttcgcacggttcgctccgaacaggccagattagtggctagcgtccggcgaccaaccggttgaaggttcgcaacgccctgtaggatacggaaacggctggttagctttgtaaccatttgaggcatgatggcctctacccattgccaatcctcatgcatgtcggtaacctcctagtgggacgacgtccgaccagcggtggctaattatcgcccaccctgaccaaaaatttaaggccaacttccgccaacctttaacgactactagtataagccccaccccgccctttagcaagtgattaacctggagaattaatggaagcctttacatgattaaatgccgaaaatttgcacaaaaaaaagccgagatcatcctctcgacttaccgatgcgcccggagggaatcgaacccccatttcaagaaccggaatcttacgtgcgatccattacactacgggcgcattacaacaacacctcaactactataactgattttggataaaaatacaagccaaattctgcttttttacgtggctaatcatgctataatgacgacattaagttttggtggaggtttcatttatgacgcgacacaaaacatttcgcctcgtggttgatgcactattaatggcgattgtacttttgcaaaatctggtcccgtttcttggatatattccttttggcccctttagtatgacactaatcggtctcactgttattgtcgctgggagtgctttaggtccacgcgacgggttgctcatcggtggcttctggggacttatcacctttgttcgggcctttacttggccttctagccccgtggcaccgttaatcttcactaatccactgatttccattttaccccgtttgctgatgggacttgtggctggtagtctttatctttggggacgtcatcgacagtggtccatgcgccaagctatgcaagtcgcggctggttgtgccgcactaaccaatacagtgttagttttagggttggtctttttattttatcaaacgcctgctgttgccacagctttcggcgccacgggtaaccaaacattggggtatgttttgatgatttcacttttcactaacggtattcctgaattaatcttggatgtccttgtagccccattaattgcaatgccattacggcgacaatgggagcgacttaagccacagacaaccaagtaactgcgatgatttcatcgcagttttttggcaacaaaaaaagccgcaacgtcaacaacgtcacgaccactgatgcgcctggagggaatcgaacccccatctcaagaaccggaatcttacgtgcgatccattacactacaggcgcaaaacaacatcggtgcttttgagcacttaattactatacccgatgctgaatataaattcaagtggctgggtaaatatttttcaatttcccattaaatgtagataatcgtcaccccaccaaaactcaccttgccggtaattgaaacagcaggcgcctcgttctgggcttcttgaatccccttttcctccaccgtaccaaaattaacatcaacattcgtcttcacgttccacgttcggggaatgtataattcggcaccgctaaacgacgtctctaacacaattgacgcaccagccgggttgagctgcacctcatcaaaatacactttggcattgcccatagataccttaatcactgcctgacgaaaatccggggactgaatgtagcgaatgctactgctcatgttaacgtccaccacggcatcttgatcactgatactttcaacatcatcatgattttccgcccaatgatgatgccattcctggcggttaacatacgcgtgataccaacgcggcttaatgattaacgacagcccgatcgttaacagcaaagccgctcccaaaatcgtccacggcgccaaggcagcaatacctaagggccgagcaaaaataatcgccagaaatgctagagaaaacaccatccccggtaccgctaagtgaattaagctagccacaaaacccgccactaaaaacatcgcaatgacgatcgtccaaaagccaatatgcaggctaaataatcccaattgactgacgaccaaaataccggccgccaggactaagaaaataccccaaaaccaatttcgtcgcataattgttacccctttcgttccaatgctaatttcaatgcttgataataacgtcgtgacacgtacaactgcttgtgcgagtgcttaaaccgaaccaaattaccggtaactgatttagttaacgaaaaaatctgttgtcggttcaggattgccgatttggagactcgttgaaagttggctggtaattcatctgctagctcgtataggcgctggcgcgtattaaaaacctggtccgctgtatgagccatgacttgatgatcggtagcctcaaaaaacaaaatatcctgtagcgcaatttggtaattctgcccgcgttgacgtaaggctatctgctgatattgtggcgtagcattttgaaatgccgttgccaatgcattagcaacctgtggactattggcccgaattgtaatctctggctcattggcctgatcatcaacttccaatcgaatcttcaaatcttcaccccctattgctacgtttaagttaaccatattgcttcaacaaagaaaatgattttaccgtaactggttcgttttcccccgtaagtggtcagggactgacagaatacgtgacctttggacaaactctgttatgataattctagtcaattggctgtcagaattaaacgaagtgtttttgtttgacctactctgaccttagcggtacactaacatcatgttagctatcgctagccattcaaatgtaaaagggaggctaccttgtcatgaatttagtaccaacagttattgaacaatcatcccgtggcgaacgggcctatgatatttattcacgactattaaaagaccggattatcatgttatctggtccaattgaagatgacatggccaacgccatcatcgcgcagttactcttcttggatgcccaagactcaaccaaggacatttcactctacatcaactcacctggtggtgtcgtttcttccggcttggccatctatgataccatgaacttcatccaatctgacgtgcaaacgatcacgttagggatggcagcttccatggcaagtgtcttggcttcatctgggactaagggcaagcgttttgctttgcctcacgcccaagtgatgattcaccaaccatctggtggtgcccaaggacaacaaacggaaatcgaaattgctgctcgtgaaatcttgaagacccgtgaattgatcaacaagattttagcagagaattccggtcaaccgattgaacgcctcaatcaagatactgaacgagacaactacttgagtgctcaagaagcggttgattatggattaattgaccacatcatgaccaacagtagtgaacaaaagaagtagtgattaaccccaaaagtgtcgtcattcgacggcgctttttttgcgtttttgggggccacatactaatgccaattacgacaaaaagaccagtcaatcgtttaaaacgattgactggtcttttaactaggccgtagcctcttcacgtagttgcttagcgtaatcattaattttacgtaaccggtgattaattcccgattttgagatgggaccaccaggaaccagatcccccaactctttcaagcttacttctttatgttctaatcgggcctctgccacttctcgcagcttagttggtaactggcctaacccgacagtagcatcaataaactcgatattatcaatctgacgggttgacgcattagctaccttgtctagattggcattttcacaattaactaaccggttgaccgagttgcgcatgtcccgcataatccggacatcctcgaatcgtagcatggccgtcgtcgcgccaattagcgaaagaaagtccgcaatcttttcggcccctttgaggtaggtaatatatccactacgacgaacgatggtccgcgcatttagctcatagcgattcatcatgtcagcaatcacttgattgtgttcttcatacaaagaataaatctccaaatgataccggctggtttctggattgttcacagaaccaccggctaaaaacgcgccgcgtaagtaggaccgcacccgcatatcatcatccaaaatttcgttaggaaccgattccagcagctgcatcccgtcaaaaatcccaagatcggaaagaacctctgtaacgcccgttttgacccgaacgatgtagagattatttttcttgagcttcatctttcgccgaaccagtagctcactttccaaatcataaaactgtttgagcaattgatacattcggcgggcaatcgctggattttctgtctgcacgttcaagacaaaatgccgattagcaagtcccaaagcaccgttcattcgaatcagtgcaacgagttctgctttagcattttctcggtggacctccaacgtggtcaattccttttttacttcactggcatacgacaccgttaaggcctccccttcattcgataacgcggctgaccaatcaggttcaagagttcacgcacgacctcttgcccgttgtgaaaggccccattatcacgtaattgcaagaaatcggttgaaatgacccgacatccctgatcacgtaacccttgaaaatcatgccgtaccggttgggacatttcatcccaccgctgatagtcaatgtactgatctggcactttacgcgtgttaaccaacaccgtatcaataaagttcgcatccaaatggtggttaagcacccgaacatggtcagcatcggagaaactttcggtttcccctttttgggtcatgatattacaaatatagacaacctcagcagcactatctttgaccgcctgaccgacactatcaatcattagattgggcaaaatactggtgaatagacttccggggcccaaaacaatttggtccgcattcatgatcgcatcaatgaccggctgaacggcctgcggttgctggtggtgattactggtttcaacccacacacgtttaatcagcttatgagccgctgtaatttccgattcaccacttaacgtactgccatcggcaaattgcgcgtgtaactccaatggttcgttggcggcaggataaatatgcccattaactcgcataagttgtgacaattcttgaactgcatcaaagatgccccctttcatttctgaaagggctgcgataatcagattcccaatcgcgtgaccggcaaaaaaatcatctgtggtttcaaaccgatattggaacaattctttataaatatcaggaatttccgctaacgccaccatgacgttacgaatatcaccaggcggcaccacgtttacgtaatgccgaatgatgcctgatgatccgccatcatcggccaccgtcacgacagccgtgatgtccacattctggtcccgtaaattgcgtaaaatgactggcaatccggtccctccgccaatgaccacaatcttaggtcggcggctagtcagttctctcatgagcgattagcggactcctttctcttttcaatatcccgatgggtcacgtgcaccgggtaagtgttaccaagggcttgccccaatcgttgcgttaacgcaactgatcggtgttgaccacccgtacatccaattgcaatggttaagctggattttccctcttgcttgtatccaggaacaatcgtcgtcagcagacccaagaaacgttgatagaactcttccgtttgtggttgattcataacatagtcatagaccggttgatccattcccgtttgattccgcagctccggtaaataatacgggttaggtaagaaccgcacgtccatgacaatatcggcatcaataggtaatccatatttaaagccaaatgacatcaattcaatatgaaaggcttgggttgtttctgtttcgtaattatggaaaatttcttcgcggagctttcgtgggcttaacttcgtagtatcaatcaccaactgagcagcttggcgaattggcgctaagagttctcgttcacgcgaaataccttcaaggacccggccattccgtgccaatggatgggaacgtcgtgtttctttgtagcgcgaaaccaattcagcatcggaagcatctaggaacaagacctgcgcattcatggttccgtgaaccgccacgtcatttaacatccgcacgatctcatcataaaatgcccgtgaccgcaaatcgatcaccaaagcaattttacttaatttaccggattcacggactaaatcccaaaacttcggtaatagcgaaggcggcatgttatcgatacaaaagtaacctaaatcttcgaagctttgcatggcaacggttttccccgccccactcatcccagtgatgatcaccaggcgaatatcctcagtcatggcacttccgctcctttttgaaaacaatctttatgcagtatagcacaccgggcgtgtcttttcctaacaattcccttaaatctactgaatttttccacaaaaaaacgctatgatgcgctaacaagcacacaccatagcggtttaatttaggagcgactccgggcaatcgcaatccagatcgcattaattccaaagacaataaagaacatggcaatcaaccagtttaaagatagcgccgcaatcacgggatggataaacaacataatccctaagatcaggctgatgacatctagaatcactgataaccagaagaatccgccaccgaaatctcgtaaatgactggcaaccaatagtcgttcaatagaatcaaagataaaccacagcgcaaacaagtagcctaacgttacgattgcgctattcatatcaaagaagaaaacgactgcaattaaaatatccagaatacctaagactaacgcgaagttagcccggaaccccgttacatctcgcaattttttatatccggcgatcgtggtcaaaccactcaacaaagccatcacagcaaagataatggctaaacttgtcaatccaatcttaggggatcgtaagaggccaccggcagccacaataaataagataccgaggataaattctccccagtcaaagccccaacgggaccgattcatattaaacatcgtctgcatctcctcacaacaccggtcacatgacgaccggttttcaactattgtactggttttttccagttctcacaaggggggcaggactactagcccgaccaagtagacctaaaaaaggccatgactctcgccacggccccatctttaacaatctatgcttgctgatctgcttctgtccgttgccggtcccgttctaagactggcttcaaatactgaccagtataactatttgtgacttgtgctaattcctctggggtacctgttgccacaatattacccccagcttcgccaccctccgggcctaaatcaatcagatggtctgcggttttaacgacatcgagattgtgttcaatgactagtaccgtattacctttatcaacgagtcgatgcaagaccaccagcagacgtttaatatcatccgcatgtaacccggtggttggttcatctaggatatagaagtttttcccgttttgttgcttgtgcaattccgacgctaatttcatccgttgggcttcgccaccagataatgttgtcgctggctgacctaattttacataacctaagccaacgtcttggatggtttgcaacttacgcgtaatcttagggattgcttcaaagaattgaagcgcctcactgacagtcatatccaagacatcagcgatgttcttccctttgtattcaacttccaacgtttcagaattgtaccgggttccatgacaaacctcacaggggacataaacatctggtaaaaagttcatttcaatctttaaaataccatcaccatgacaggcctcacaccggccgcccttagtgttaaagctgaaacgtcccttttgataaccccgcaacttggcatcgttagtttgagcaaagagtgtccggacatcatcaaaaacaccggtataggtggctggattactccgtggtgtccgcccaattggactctggtcaatatcgaccagtcgttcaatattctttaccccggcgatactcttgaactttccgggcttttccgagttattgttaagcttttgcgctagtgcccgcttcagaatcgtattaaccagcgttgatttcccagaaccagaaacccccgtcaccacaacaaactcgcccaatggaaaatcaaccgtgatgtctttgaggttattttcagcagccccagtgacccgaatgcttttgccattacccgtacgtcgttctaacgggactggaatatactgcttacccgacaaatactgcccagtcagtgacttacgtgaccgcatgacttgcttcggtgttccggcagccatgacgtgaccaccattctcaccagcccccgggccaatatccacaatataatcggcagcgcgcatggtgtcctcatcatgctccaccacaatcaacgtattgccgagatcacgcatctgttttagagaagcaattaaccgatcgttatcgcgctgatgaagaccgatagacggttcatctaaaatatacagcacaccagaaagattcgacccgatttgagtagccaagcgaattcgctgggcttcacctccagacaaggttcgggctgaccgactcaatgtcaggtagtccagcccaacgttacgcaggaaggtcaagcgatccttaatttcttttaaaatcggttgggcaatcacttggtcttgttcaccaaagttcagttccttaaagaagcccaactccttatcaactggcaagttggagacttcaccaatgtgttggtgattaatcttgacactcaatgcttgacgattcaaccgataaccatggcaggtttgacaggtcagttctgtcatatacttacgcatcacatcgcgggtaaaatcactattggtttcgtgataacgccgatcaatgttcggaataaccccttcaaaagctacatccacatcccgaacaccaccgaaatcattttcataatgaaaatgaaattccttaccttgtgagccatacaagaccaaagcttgatcgttcttggaaagttcttcaaatggcgtatccatgtcaacattaaacgccgtacaagcctgctctaacagtgctgggtaatattgtgagctaattggattccacggctctaatgccccttcacgcaaggtcttcgtcttatcaggcaccactaggtctaagtcaacttccaacttaacccccagtccgtcacagtcgggacaggcgccaaatggtgcgttaaatgaaaataatcggggttctaactcacccacggtaaaaccacagacgggacaagcgtagtgttccgaaaagatcattggttcgccatcaattaaatcggcaatcgcataaccaccacttagccgcaatgccgcctcaaatgaatcaaatagccgtgagcgaatccctgacttgacgacaacccgatcaatcacaatagcgatatcgtgactttggttcttattaagctctggcactgagtccaaatccatggtttccccatcgacgcgaacccgcacaaaaccttctcgttgaatcttctcaaaaatctttttatgttgtccctttttagcacgcacgattggtgataatacttgcagtttggttcgctctggtagcgccaagacttggtccaccatctgctcaacactttgactggtaatctcagtgccatcattaggacagatgggtgtcccgacccgggcccaaagtaaacgcaaataatcattaatttcagtcaccgttcccacggttgagcgcgggttcttagacgtggttttttggtcaatcgagattgctggactcaatccatcgatagaatccacgtctggtttatccatctgacccaagaattgacgtgcataggaggacagactttcgacatagcgccgttgtccttccgcatatagggtatcaaatgccaacgaacttttgccagaaccggataagccactaatcaccactagcttgttcttaggaatcgtcacgtcgatatcttttaagttatgggcgcgggccccgtgaatcacgatcttatcgtttaacaaattgtcgtctccttactcactaatcaccaatctcagtcttcatatccataatggtatcgcgcaatgaggccgcctgttcaaagtccaatttcttagccgctgcacgcatctcatcttcaagccgagcaatcaacttttcttgatcttccttggtcatatcttcaaagtcactcgctacgaaatcatccttttcacccgcattgtcgttcttctttgaaacggcaatgaggtcccgaattggcttgatgatggtcgttggcgtaatcccatgttctttgttataagcgatttgaatctgtcgccgtcgagccgtctcatccatcgcagcttgcatggaatccgtaactgaatcagcatacataatcaccgatccgtgtgagtttcgggccgctcgaccaatcgtttgaatcaacgaccgttcattacgcaaaaagccttccttgtcagcatctaagatggcaactagtgagacttcgggaatatcaatcccttcacgcaaaagattaatcccgactagcacatcatatttacccagccgtaaatcccgcatgatctcggtccgttcgagtgtcttaatgtccgaatgtaaataagccactttgatacccagatccttgagataatccgtcaaatcttcggccatttttttcgttaaggtcgtgacaaacgtgcgctcattcttctcaatccgctgattaatctcgccgactagatcatccatctgacccataatcggtcgaacatcaatcgtcggatctaacaagccagtcggccgaataatctgttgcaccacgtgatccgtttgctcggcttcgtacggtccgggagtcgctgacatgtaaataacctgattgatatgctgttcgacttcgtttagcttaagcggccgattgtctaacgcactgggcaaccgaaatccgtaatccactaattgttgcttccgtgcccggtccccgttgtacatcccccgcacttgcggcatagtaacgtgtgattcatcgaccactaggagaaaatccttggggaaaaagtctaataaggtatacggcggttcgcctgcttgccgaccatccatccagcgcgaataattttcaattccactggtgtaacccatctcgcgcatcatttcaagatcataggtcgtccgctgtttgagtcgctgtgcttccagtaatttaccgtcattttccaattcagctaatcgctcttttagctcgccttcaatcccggccgttgcttgggccatgatatcatcgttcgtcataaagtgggttgctgggaagatggccacgtgttctcggtcacctacaatttccccagtcagcgcatcgacttcccgaatacgatcaatctcatcaccaaaaaactcgactcgcagcgcccgctcatctcgcgacgctgggaaaatttccacaacatcaccgtgaacccggaagcgaccccgttggaaatcataatcattgcgttcaaattgaatattaacgagcttacgcaacaaagcgtcacgttcaatctcctgaccgacccgtaatgaaaccacatgattcttatattcggtagggtcccctaaaccaaaaatagaggaaacg

SEQ ID NO: 55 - DNA, 2543988 bp, unidentified (residues 1,271,995-2,543,988 of 2,543,988)
  source 1..2543988: mol_type = genomic DNA; note = Levilactobacillus brevis
gaggccaccacgatcacatcattccgttctaacagtgaactcgttgccgaatgccgtaacttatcaatctcatcattgatggacgaatccttttcaatgtaagtgtcactagaaggcacataggcctccggttgataataatcgtaataactcacaaaatattccaccgcattattagggaaaaattgcttgaattctccatataattggccggccaacgttttgttatgtgacaacaccagtgtcggtttattcacgtttttaatgacattggaaatcgtgaacgtcttcccggtcccagtggcgcccagcaaaatctgagccttctcaccggcctcaatgccgtgtgttaattgattaattgcctccggttgatcgccggtaggttgatattttgagaccaaatcaaaggcccgatctgtttgtcgatcgatcatgactggtaacctccttacccatttttattcatcagaaaagatgggaaacggctcgtttcccatcgtgctcaaatattctaccataccgaacatactttcgccagtttgccggtccgttaccgaaacttatcctgatagatcgttacattagcggcccggcttcccttagtcaccgttgtcgtttgtaccgctactaatccctgatcttcccagaattgtttcatttgccgatcacccatgaaattacttagttgtaattgtaccgcaccggctgtttttaacgtggttactaagctctgataatagctagctaattctacggatgacacgccctttgccggtaaccacatcccaacccacaccaaacttggtagcgggtaatcaataattaaatcaactaaaacaatcagttgctgatctttaaaaatccccaaataggccttttgatcaactgttgcgttcaacggcacatccgttacatcttgaatggcctcttgccgtgtcaccggatgatcttgaaagtgcgcaaaatacgctggatgactagcctgaaactgataaatcaactcatcatcgtcatgagttaatggccgcaccgttcctgtagtcagatgttgattccacacttctgctaatttcatttagatggctcctccaaaagttggttagtcagttgtgccagcttctgccggtcactgaaatcagcggccagcatttctggtaagacttccgctaagaaatattggacacaggctaactgtttaaacttcaaaatcgtggtcaaactttcccgatagatttctgtaaaaacgggttccggattacccttttgaatttcgccaaacgattcataaagcaaatccactttatcagcaacggataagatctgtccttccaaagtttcgtctttgccttcccccaaccgccgcgtataagccgcctgaaactgggacggaatttcattttgaatgaagttagctgtcagcgaatcctcaacatcagccaacatttttcggagttccggagttgcgtacttcactggcgtcttaatatcgccgataaagcgttccgtgtaatcatgattcaaggccttttcatagactaatcgccaattaaccgtatgcccagcctgttcttcaacgtcggccaagaattgggctacttcggccactttaaacgaatgtgctgcaactgaatgttgctcaaacttgaaatatcccggtgctcgatcaatcgtttctagatcacttaaactctgtaagaactgattcattcccataaacccgccactcccttttgattattatttgtgtctccacgaccgcaaaaaaagcggaaacaccggttaaggttgtctccgctaagtttaccattattgtgctgaagctgcttgtgactttagatcttccaagtagctaaagactgcttgaccggcaataccgccatcgccaaccgccgtggtgatctgccgcaaatctttttgtcgcacgtcaccgatagcaaagatcccgggaaccgccgttgccatatgatcattggttttaatccaaccagcatcgtcggtaatgcccaaatcagtaaaggcgtcggtcattggtaaggttcccacgtaaatgaagaccccactagccgcaatctcacccgtttcaccggtttgattatttttagtggcaacaccggtaaccttcatatcgtcacccaagatttcagtgacattcgtattccaaacaaattcgatcttgtcatttgcaaaagcccgatcctgtaagatcttttgtgcccgcaattgatcacgccgatggatgatcgtaacctttgaagcaagacccgctaaatataagccttcttcaacagccgagtcaccgccaccaatgacgaccacttcacggttcttaaagaacgcgccgtcgcagaccgcacagtaagaaacaccgcggccaccaaatttatcttccccaggcacgcctagcttcttgtattcggaaccagttgccacaataacggccttagtctcgtaatcaccatcatcggttttaacgatcttatgatcaccatgatcctcaatcgccgtcacgctaccatacgcgtactcggcaccaaattgggtcgaaccttcatacatatccttagccaaatccggccctaagactgacttgaatccaggatagttttcaatcgctgccgtattgttcatttgaccgccataaatcccacgatctagcattaataccgataaattagcccgtgaagcgtataacgcccccgtcatgccgcctggtccggcaccaatgacaataacatcgtaacttttcaaggttaacgctcccttccactcttgtgctgtgataatactgacactttactagtaaaaagtaagtttgtcacctattttgacttgggtgtttgttcatcttccttggcaagctgagcgcctaaggtcttaatgtactcgcgtaactgtgtttttgtttctggatgttgaagaccatacgcaatattggtctgaatccagccgaacttattgccgacatcaaaccgtttgcctgtatattcgtgggcaaacacgcgttgtgttttattgaggttatcaatggcgtctgtcagttgtaattcattgcctaagcccactggggtgctttccaacgcttcaaagatttctggcgtaaagaggtaacgaccaataatggctagatcactaggtgcttcatctggttctggcttttccacaaagttggtaacgttatacaaacctggcgccgtttcttcagacggattaatgactccatacttcgccgtatccttatgtggaactcgcatcacagccaaggttgaagcccccgtttgatcatagcgatcaatcaattgcttggttaagggcaccttgctatctgtcatatcatcgcctaacatcacgataaatggttcatcaccaataaaggccttcgccgtcaatactgcatcccccaacccacgtgggtacggttgtcggataaagtatagattcatgccagtcgtttccttaacttgtcgtagcatttcatctttgtgcttagcttctagattagcttccaattctggattggagtcaaaatggtcttcgatggatcgcttagatttcccatcgacaatcacaatatcttcaattcccgatttgcgcgcttcctccacgataaattggatagttggcttatcaacaatcggtaacatttctttagctaaagccttcgtggctggtaaaaaacgggttcctaatccagctgctggaatgacggcttttctaacttttttcataattaaacgttccttcctcagtatccccagagcattcctaaaattcagatcgaccttcgcgttgcattaaatcagaaattgcggtgcgaatgtcctttccttcatagatgacttgatagatggcttccgtgatcggcattgagacaccacgttcacgggaaagctcgtatgccgccttggtggttgctaagccttcaataaccatccccatatggttaataacatcatctaaagcttcaccacgtcccagttcatcaccagcgcgccaattacgtgaatttgagcttgtcgccgtcacgataatatcaccaacaccggatagtccaatgaaggtcataggatcagcgccaaacgatgtccctagtcgtgaaatttcagctaggccacgcgtcatcaaggctgctttagcattatcgccatagcccaagccgtgtagtgcaccagcacccaacgcaataatattcttcaaagctgcaccaatttcaaccccaataatatctggattagtgtaaacccggaagtaggatgtcatgaacaacttttgcacatatttggcagcctctgggctagcactggcagcagtaaccaacgtaatatctttacgggccacatcttccgcgtgactaggaccagacaagaccgtaaccgcctggcgattctcagctggaatttcttcttccaaaacttgagagagccgcttataggtctgttgttcaatccccttgctagcatgaattaattgtggttgtaagtgctgatcttgcaaaatagttgccacttgacccgccaccgaacgaatggctttcgttgggacaacgaataagatcgcatctacatccgttaaggcactcgctaaatcggagtaagccactagcgaaggagaaaacgtaaagtccttgatgtagtgggtattggtatgttgcgtattcaattcttcaacctgtttggggttgtatgaccatagccgaacatcatgtccgttttcatccaagacgctcgctaaaatcgagccccacgaaccggcaccgagtactgcaattttctctgacatagtaatggattctccttatttagaaagattggttttttcgcgaaatggattgcccgctagataatcaattggtggcgttgttgcgcgccgacggtaaatccaaatcactaatgcaccgacaaataatacgacagacaacgcttgcgaaatccgcaacaggtggaataaccacaagctatctgtgcgcatgccttcaatgaaaaagcggccaaacgaataccacatgacgtaagccaagaatacttcaccctgcttgaataaaccaggatagtgccgcaaactcattaacacgacgaatcccatcaaactccacgtggattcatacaaaaacgttggttgacggtaggcaccgttaatcaacatttgactaataatccagtgaggtagatgaagcccttgtaaaaaggctaaactcgtcacgcgaccaaacgcctcttgattcatgaaattaccccaacgaccaatagcttgacctaaaatgaccgtcggtgcggccacatcaagcatcagccacgtgggaatgaaccgtgaacgacagaagagaaccaccacaattccagccccaattaaggacccatagatggcaattcctccatcccagattgcaattatctcactggcatgctgcgcgtaataactccaattaaaaatcacataatatagccgggcggcaattagggctgccggcagagcccataaaatcatgtcataaatatcatccggattaatgcctcgacgacgaccctcacgcaccgctagtgtcaccgcaatgatgacccccgtcgcgataatgacgccgtaccagtgaaccgcaattggtcctaaatgaatggcgatggggttaagcgccgccacaattggtgaaaagataacgcccatctcccttatgatttattcgcattttgtttaattaagcgctttagattgtcatcaaacactttggttgcatcgtaacccattgaacgtgcgcggaaattcatcgccgccgcttcaatgatgattgctaggtttcgccctgtcttaacggggatactaatcttaggtaccacgacgtcaaagaagcgttgggtttcactattattgcctaagcgatcaaaatgattatcatcttgccacaactctaggtggacaatcaggtcgatatccgtttcgcttcggacagcgccagcaccaaagagattcatcacatcaataatcccaatcccccgaatttctaataggtgactaagaatggctggtgcagcaccaactaaggtttgttcatcttgttgataaacctctactcgatcatccgcaatcagtcgatgaccacgtttaaccagttccaaagcagtttcacttttaccaacaccagaatctccggtaatcatgaccccaacgccatagatatccaccaagaccccgtgaacagattgacgttcggcgagtttgccttctaagaagttggtcatattactcaaaacccgcgacgttgtcagcttggtacccaaaattgggattccggcctcttcggcagactgcgttaattcctctggtggatctaattgggtggaaataacaaacgcaggtgtttctggctgacacattttacgcataacatttaacagttctttatgactcatccctttagcaaaggatgtttcggtaattcctaatagttgaacccgtttcgccgggtagtaattaaaataaccggttaattccaatccaggtcgtgaaatatcactagtcgtaatttttcgatctaaattgtctttacccgtatatacatccaagcggttcgctttgacgagttcggccactgtgacactttcggtcatgggcgctcctccttactacatcgtaaactactttaattttagcactttccggtagtgactcctaccaaattaaatcgttattcacaacttaatgctgggcaaaatgatcactgataatcgcattacataacgacattacaatcgcaataatcaacgtcgtgccaaacgaggcaaaagcaaagctactcccgacaaaccacgacgtcaattccagcatggccgcgttgatcacgacactaaataatcccaatgtgaggatggtaatcggcagcgacaaaacgaacagaatgggcttcaccaccgcatttaacagggctaagactaagctcgcaatcaatgccacccagacactggagacataaaatgaattttgaaacgacccagcaagcgagctttggaagaaaccagctaacgcaaggaaaattaaggcattaacaaaaatccggggccaaaaccgcatttaattttcccccttatgtgaatccttaacatcttgttccgtgacatcatggataactttacggtctggccgttgcggctcagagctaccacgaaagagatccttaaaaccaggaccagctggccgggaatcatccagtggcatgaagctcatgaccacgacatacaccatcaaccccaacaagccatgagtaggaatggcaagtgaaattaacacataaatcacccgtaataaattagcattccaatcaaaatactctgcaattccgcccaataccccaccaatcaaacgattcgtacgagaacggactagacgctttttttctgccataggcggacactcctttttatcagttattagattaagtctatcatatctgattaactgtgttaaaagccaatcatttaaagggatttttttaataacttccctgataggctcagaatagcgaaagcggccactgaaagcaagtcttcagtgaccgttgtcgtaaatcttcagttttggttaacgtttagggtgcttaatcagtcgtatcagattgactagctgaatttaactcaatgatttggcctgacttgaggtaaataatccattcacagacattagtcacataatcaccaatccggcttaaatcctgcgccacattcaagtaaattgaagctcccgtttcaaatgctgcatccaaccgcatttgctgatagctatcggctcgtacttggtgattcaagtcatctagctgccggtcaactgccgctaattcgcgggcttcgtgctcatctttgttaacgtaagcactcaaaacatctttaaccatttgggtcgtcaagtgtcccatctgcccgatcaattgctcgatcactggaattttttgcttatcaccaaatttaatggtggcatgcgcgatgttacgcgcatgatcccccgctcgttctagctccgacactgcttttagaatcgtcacaatttctcgcaggtcagtggtcaccggttggtataacgcgatcatttcaaacgtctttttttccaacgcaatttctcgttcattaatttggtggtcctggtcaattattttttgggccgctacagcatctcgattggtaaacgattctaccgcctgctcgatcacttcgctgaccaacatccccatttcagtaaagtccgcatctaaatctgccaactcgtcatcaaatagtctacgcataaactgcctccttatccaaagcgaccactaatgtagtcttccgtttgcttatttgctgggttcataaagatgttcttagtttgatccacttcgattaactcaccattcataaagaatgccgtccgatccgcaatccgtgatgcctgttgtaagttgtgagttactgtaataatcgtataatcgtggcgtaaattcaagagggttgcttcgatttgactacttgacactggatctagcgcactagttggttcatcaagtaagataatctcaggcgaaaccgctaaaacgcgggcaatgcagacccgttgttgctgtccacctgatagcgctagtgcactttcatgcaggtgatctttcacctcatcccacaccgctgcttgacgcaaggatttttcaacgaccgcatctaatttttctttatctttttctccagcgatacgtaacccgtaaatcacgttatcgtaaatggaaaatgggaagggattgggttgttgaaataccatgccaatctctttacgaatctgaaccgtgtcggcattgggtgaatacagatcggctcctttgaacttgatggttcccgtaatcgtgacgttaggaattaaatcattcatccgatttaacgtccgcaagtaggttgacttcccacaccctgagggaccaattaaggcggtgatgcccttctcattgaagttcaaattgatgcccttcaaggcttccttgtcaccgtagtataagtgtagatccttggtcgttaaaatttccttactcattatttgttcctcctcttagccaaagttccccgaaacataatcactcgttacctgtaccgatggattggtaaagatatggctggttgtatcatattccagcacacgcccttggttaaaaaaggccgtatattcactaattcgcccagcttgttgcatattgtgcgtcacaataatgatggtataatgctgctttaattccaacaacgtatcttctaattggctcgttgacactggatctaaggcactggccggttcgtctagtaacaagatatctggcttaacggcaatggcacgcgcaatacacaaccgctgcgcttgccccccagacaacgccaaggcactcttattcaaatcatctttgacttgttcccacagagccgcttgtttaagtgacgtttccacaatctcatctagctgttgcttattcgttaccccccgtaactgcaaagcaaaagcaatgttgtcgtaaattgacttggcgaatggattgggccgttggaaaaccatgcctactcgccggcgcatctcgtacacgtcaacggccggctgattgatgtccacgccacgatacataatccgaccggttaccgtcgcaatccgatcattcattcgattcaacgagcgtaaaaaggttgattttcccgaacccgacggtccaatcagcgccgtgatttgattactagcaaactcaaggtcgccctcaaatagtgcttccttttttccataaaacacatgtaggtcttctgttgacaaaatgactggatgttttggatcggtcatcttaatcacgtgccgttcttccatttcggccgccttggtaacatcattattaataaacatggcgtgtcctccttaggccgacgttagtcgtttgtataaacgcttgcccaggtaacgggcggcaaagttaaacaataatatagccagaaccaacacggccgatgatccagacgaaatggctttagcgtctggcataatcccttcagaattaattttccaaatgtgtacggctaaagtttcggctggtcgcatcggattcaagggactggaaatgttgaagggattccaatcagcgaaattcaaagctggggcactttgtccggccgtgtaaatcaacgcagccgcttccccaaatacccggcccgcactcagaataacaccggttaagatgctgggaacagcagctggtaaaatcacacgggtaacggtctcccatcgtgacaatcccaaggctagtcccccctcacgctgaacgtcactaatcgtccgtagcgaatcttcaatactccgcgtcaataacggtaaattgaagaaagttaaggcaaacgcgcctgaaagaatagaaaatcccaagcgtaactttacaacgaagaagagaaagccaaacaggccaaccacaacagacggtaatgaactcaaaatttcaatggccgttcgaatcgtggtggtcacccaattatccttagcatactcatagaggtaaatcgcggcaccaagagcaataggaaacgagatcagcatggccaaaatcagtaaataaaacgaattgaatagctgaacgcctacaccaccgcccttgagaaaggccttagcgggtgccgttaaaaagtgccagtttaactgtggcaacccactgattaagatataacctagcagcgccaataagatgagaaccactaggcccgcaatgccgtaaagtccgccaatggcgactttattttgtgttttggaattcattattgcaagcgcccctttcgaccaattaagcgaataatcaggttaaagacgagtgacattaataacagcactaatgctagtgaccacaaggcgttattttgtagtgaccccatcaccgtattaccaatacctgttgttaacacagacgttaaggttgccgagggggacactaaactacttggcattaacgccgcattcccaatcaccatttgaacggctagtgcttcaccgaatgctcgcgccataccgaatactacggcagtcatgagtcctggcgtagcagctcgcaggacaactttataaatcgtttgccactgcgtcgctcccaatgccagtgatgcttctcggtagtaacgggggacggcctttaaggcatccgcactcatggatgtcactgtcggcaagatcatcacaaacaacacacaagttcccgataaaatcccaaagccactaccaccaaagatggctcgcgtcgccggaacaaccacggacaggccaataaacccataaacaactgatggaattcccaccaatagctctgttactggctgcaagatcttggcgccacgattaggcgaaatttcattcataaagactgccgtaccgatcgcaaatggtgttgcgacaatggctgacagaatcgtaatcagaaaggagccaacaatcatgggcagtgcgcccacttctggtttaccatgcgcgtccgtgatacctggattccaatttttgccagacagaaaatcccaaagattgacgtgattactggtaaacgtcgcaattccctttgaagccacaaatccaataatggcgaccaccacggcaacaatcagtaacaaggccgtcagactgatggttcgcccccagatttccaatttagcggctttcgaacgccgctttaactgttgctctaattgcttgttatccatctaggcccctcctgtcttagtaatatgtccattagcatcccgttccaccaacatttgatccggtgacaagtaacctaattgccgcaccaacgtattttgaatagccggcgactgaacgtaagtgataaaagctttcgtcaaaccggttggatggcctttggtgtagagatgttcataagaccagattcgccaatcatttgtcgtcacattcacctctgtcggtgcaacatgatttaacgacaaggcttgcaccgttttattgacgtaagaaaaagcaacgtaactgattgcaccgggggtcgtcgccacaattgagcgcaccattccagaagaatcttgttcctgagctgtcttagaacgatgattggccaagccaaattgttcaaaagtggcccgagtgccacttccttgcgcccggttgatcaacacgatgctctgatccgcccctccaacttctttccaattggtaatctgacccgtaaaaattttgattaattgattagttgagaggtttttcacgcccacttttttattcacgatgggcgtaattccaacaacggcaacccgatgatccaccaattgccgggcgttaatccctttttgttccccagcaaataggtcggaattaccaatctgaaccgcgccttcttgaatctggctaagtccggttccagtaccgccaccctgcacgttaataaacgtcccgagatgttcacccgtatactgttcgccagctgcttctacgagcggttgtagtgccgtagaaccaactgctgtgattgattcacccgcatgactgacctcgcgcgtctggtaagcataaattcccaatgccattaagataaccagcacgagtccttgcacccagcgttttttcgacataccgttgacctcctagtcagttgagcgtcgcggctcaaccatttcaaaagctagtatagcggagcaatgtaaatgtcatgtagacgtattgtaaaggttgtgtaaatataacccgaattggtcaatttaatcgtctgcgctccaaaacgagagtgagacaaaaggcggttagctggcgcccgtttcagtacctaatatttggaaacacaaaaagagcccgaggcttttgtctccgactcgtcatttagcgattattgtcttgaaaacgtcatcgttactgtcgttcctgtacctaactcactttgaaggtcaatcttgccgtttagcgactggactaactcccgtacaattgctaggcccaatccggttccactaaccaattggttggaatgtgacacatcggcccgatagaatcgttcaaagacccgctgctgatcttgcggggcaataccaatccccgtatcttgcacaatcaattgccaatcgtgggctgtcacagtggcggtgacggtcacccgcccctgtggtcgattgtacttaatggcattactcaaaacattctttaaaatctggtccaatttacgttgatcagtcgtcacctgtaactcactagcaacctgattgtgtaaagtgatgtgattaaccgttgctagtggcgttaataaattcacctgacttgctaccaggtgccctagcggtaccgtggtcatctccacattattgcccgattcaatatgtgagatcgtcaaaacgtcattaatcaattccactagtcgttcgctttgctgatcgatgatctgtaaaaactccacggacttttcagggtcgtccttagctccagccaacagggttttagcaaacccagagattgcagtgaccggcgtttttaactcgtgggacgcattcgacataaaatccatctgcatctgttcaaccgcgtacacttccgtcacgtcatacaacaatacgagcacttgaaagtaatcttgtgaagtcgccgtataaatcgctcgggcatcaaccgtccgttcgtggggtgaccccggtaacttgagcgtttgatgttgggtttgccgttcactgagcgctgaattaatcaaactggccagttcaaactggcgaacgtcttgtgtgaatgggtgtcgacgcggtgaaatgggctgttgtaaaaactgttccatcgccggatttgccagttccactttgcgataccgatcaataaccatcaccccaatcggtaagtaatccaatagtgtcgcaaattcttgattctgcccggcaacttgccgctgaaccttgcgttgatgcgtttgcaaataattaatctgcaacgccaaccggtaaaagggatcgcgcggtgataacagaacgtgagctggcgtttctgcatgccgaattccctcaacttttttggttaaaatcgtgattcgccgttccgcccaacgccaaccataaccaatcaccacggtctccaataacgtgagtgaccacgcaatgagtaatgctggttccaaatgagctggttgaaccgcccacaccaaaaaagaattaaccaccccgctaatcacaaaagcttcgccaagtcgccgaatcatggctgaacctcaaaggtgtagccaaatccacgaacggtctttagtaacgttggatgcttcgagtcttgctcaattttttcacgtaaatgagagacgtgaatgtccaccatccgcgtttgcccactgtaatcaaagccccaaacgctttctagtaattgttcacgactccagacttttccgggacgcttagcaaaaaacaacaacaattcaaattccttaggggttagttcgatcgcttgatttccccgtttaacctggaatttatcttggtcaatggtgagatcccccacctgtaatcggtgtccttgttgacttggaaccgtatcggtaggctcttcttcatggtagcgacgcatcacggctttcatccgggcaatcacttcccgcggactaaatggcttcgtaatataatcatcggcccccaactccagaccaaagacggtatcaaattcgctggttttagcggtaatcataatgatcggcgtcttgactttttcttgccgcaatcgtttggtcacttccaccccatccattttgggcagcatcaggtccaataagattacatcaaatttttcatgtaaggcgagatttagggcctgctcgccgtcgatagcggtaacgacctgataatctgcttgttccaaattgtattgtaacaacgtcacaatagcgggttcatcatcaacgactaaaactcgactcataagtttacccctcctgatctctaaataggacaatgccaatttcgtgcggtgcgccagaataaatagccgtttcggtcatcttcaattcaccagccatgttgcgaactcgtaaatgacaatatgctggattcgctagtaatgcctcataaaagcttgtttcactcaccaccgattgatgattacattccaaaataatatcacctggctctaaatctaattttacggctggcgtccgtggccgaatagctaaaacgcgcaccccatcatccacttgagaataccagaagggctgacgggcatcatagcgtttagcttgccataacacagccacataaccaactaatagaattattatgccccaaaccgcatcctgaggtcgccaatagctccacccgatcccgatgattgccgctaaagctaaccaaattaatcggcggcctaaagcgtgatagacctgctgcggcgcttgacgaaagacggtaaatcttagtcccaagattaagggtaacacgagaatggcaaattggtgaccttgccaggaaaagaccggccaaaatgcccagtgactggtgatccaatcgccgggaaccagcgtcaccattggtaatactagtagttcacgccacggataaccggcgatttgtttgccccgttgcttcgcataaatcttgggactggtgaaccgcccgccataatgagtgatccaatggcccatcaacaaaaagaaagccaaggctagccagaagtaattttggacgggtacgttggcccatcgcaatccccatgcactcagatccggttttggcgttatgtaagttccccccaaaagcgtgattaaggtggccccgacaatcaaggtcaatggcagaatcgttgttggtaataaaattaacgtcagaattgctaaaccctcatatgctaagatccagatcactggtagactgaacccaattaataaattaatcactgacaagccaaggcctaaaagcagtccctgcgtcagcatatgccgtaactcgtaatgatcgctatacactgcacttccaaaatttcgccgttctgttgtgattcgtgctcgactggccagccaaacccgtaaaatagctaaccaaaccagcggttgcaataaaaagcttccacatgcaatcaaagtccgcatgaaatcgacacctttcctgaaaaaattgctgtccccagtatagcatgaaataaaaacgggtaacacgacattcgcgttacccgtctaaccgttcgattgcaagatggttttagtctggatttttttgactcagttgccattgcaagaaagcatcaatgaatgggtccagatcgccatccatcacagcttgtccgttacccgtttcgtaattggttcggtgatctttaaccatggtataagggtggaatacgtaggagcgaatctgtgagccccaaccgatttccatttggtcaccttctaaagccgccttttcttgtgccttcttttcctccgcgcgttcatacagcttagcgcgtaacatagccaaggcggtttggcggttttgtaattgtgaccgttgcgcttgactctgtgtcacaattcccgttggaatatgggtaatccgcaccgctgaagaggtcttgttaacatgttgaccaccagcaccagaagcccggtaaacatcgaccttcaattcggcaggattaatatcaatgtccactgaatcatccagttctggtaagacatcaacagacgcaaatgacgtgtgccgtcgtcccgccgaatcaaacggcgagattcggacgagtcggtggacccccttctcagaacgtaaatagccatacgcattacgaccagcaattgctaaggtcacactactcaacccagcaacatcccccggctgatagtccagcacggtcactttaaagtcatgttgttctgcccaacgagtatacattcgtagcaacatgtcaccccaatcttgggattccgtgcctccagctcccgggtgaatttccaacagtgcattgttgtggtcatatttttgattcaataataagttcaaccggtattgccgtaaagccgcctgggcagtggcaaagtcagtttcaaactccgcttgcatctctgcatccggttcctcttgtaatagctctagggctaccatcagatcttcaacctgcgtgaccaaccgctgaaactcgtcgacttttttcttcatctcgttggtctcatcgattaaaagctgagccgcctgggcatcatcccaaaaatctggttgagccatttggccttcattgacgctgatactttcattcaaagcatcaaagtcaaagtgaccccctaaagccggttagttgttcttgcatggcggttagttcacgtttagcatcacttaattccatcatgttgggctccttttttgtgttattttaaagacaaaacgaggtcggaaaacttcccgcctcgttcgtcgcccgtttaacgggtaatattctgtcgaatttcagacttcatgaacaagcgcgttgcatcatagtcgatatctgaaatcatttcttcaaacatccggaacccatcctgttggtattcaaccaatggattcaactgaccataaccccgcagaccaattgattgccgtaattgatccatcgcatcgatgtgatcagtccagtgcgaatcaaccacccgcagtaacaccactttttcaaattcaagcatttgtgctggatcataaagttgtttttgcttttctgcgtacacgtcttctgccagttccataaagaaggccttaatttcgtcggctgatttgttcttcagatcatccaaactaatcttatctggtgagaccattgcagaaataccgaagtctaagagtgtatccaaatcccaatcactttgttcaccttgcgtatgcagactaacgacccgatcaacggtccgtttaatcattggcattaatacccacttcagcgacttatcctgattgatgacttggttacgttcaccatacataacatcccgttgttggcgcataacatcatcatattgcaacacgttcttccgggaatcatagttattcccttcaacccgcttttgcgctgattcaacttgcttagtgatcatccgactccgaatgacagcatcttcgccatcaacgttcatccgttccaagaagctcttgacccggtcagaaccaaatcgccgcatcaaatcatcttccaaggacaggtagaattgcgtcataccaggatcaccttgccgacctgaacggcctcgaagctggttatcaatccgccgtgactcatgacgttccgtcccaatgacggccagtccaccgatttccacgacgcccggtcccaatttaatatcagttccccgaccagccatgttggtggcaatggtgacagccccacgttgaccggcattttggatgatgtcggcttccttcgcatggttcttcgcgttcaagaccacgtgcggaatgttttcttcatccaaccgttgtgacaaatactcagacgtttccacggccacggtcccgattaacatcggttgacccttttcgtgtaggtccttgatttccttaacaacggcgttaaatttcgattccaacgttgggtacagcaaatccggttcatcgacccggacaactggcttgttcgttggcacggaaacaacttccatgttataaatttctcggaattcttccgcttcggtcttagccgtcccggtcatcccagaaagtttcttgtacatccggaacaagttctgatacgtgatgttagccatcgtcttggtttcttcttgaatctcgacgccttccttagcctcaatcgcttggtgcaggccatcagaataacgccgaccatccattacccgacccgtaaaggagtcaacgatcaagacttcaccatcttgaaccacgtaatccttgtcacgtagcatgataaagtttgcccgcaacgcttggtccatatggtgggtcaaagccgtgttgtccgtatcgtacaagttcttcaagttgaagtacttttcagccttttcgatcccggtatccgtcaacgccaccgtcttagattccaaatcgatcttaaagtcatctttttcatgtaacgtcttagcaaaccggtcaacacgccgataaagcgcacttgtcccttcggattgaccagaaataatcaatggtgtccgcgcttcatcaatcaagatggagtccacttcatcgacaatcgcaaagttcaatggtcgttgcaccatatcttctttgtagaccaccatgttatcccgcagataatcaaatccaatttcaccgttggtggagtaagtaatatctgcttggtaagcttctcgcttttcttctggtgatttttcggctgagttcaatccaaccgttaaccccatccaattatagagctcacccatttcagtagcatcccgtgcagacaggtattcgttaaccgttactacgtgcacccctttgcctgctaaggcgttcaggtaaacgggcatcgtggccgtcaaggtttttccttcaccggttttcatttcagcaatgttaccttcgtgcagcacgatgccccccatgatttgcacatggaaaggatacaagccaagcacccgcttagcaccttcacgaatagccgcaaaggcttcaggaagcaggtcgtccaacgtttcgccgtcttggtaacgctgcttaaactcaggcgttttcgctttcagatcatcatctgaaagttgtgcgtagtcgtccgcataggcgccgactttatccgctaaattactgaggcgtcgtaaagttcggcgatcactttcgacccatcgtttcaaaatatttggcatgtgagaattcccttcagtacttttaaaataagtctatttaaagttacccatttatttacaataaatcaacctacattctaccactatccgggccaagatgaaacaattcccccacgaccgcccccgttaaaccgctttcttccgccataaatcgacaaaaaagcaccgcgtaaacgcgatgcttcgtaaactgattttacttattcagcgtcgtcagcttcaattaagccataccgaccatcattacgacggtaaacgatactaattccgtcagactcggcatcttcatagatgaagaagtcgtgacccaacatgtccatttgtaaaacagcttcttcagtatccattggcttcaatgaaacccgcttagtccggacaacttctaattcgctaccttcagccggcttatcactttcggaagtttctgttgagaagtcaagattcttgtaacccttctcccgtgacttacggttgactttggtcttgtacttgcgaatttgacgttccaacttgtccgtaaccaaatcaacacttgcatataagtcaggagaggtctcctctgcccgtaatgtcaagtatgggagtgggattgttacttcaaccttcgccgtcttattttggtaaaccttcaggttgatgtgcgcaattgcctcaacattgttgtcgaaatatttctccaacttgctgatccgtttttcaacgtaatcccggattgcgtcagtaacttcgatgttttctccacgaatattaaatgtgagcataaaacttctctcccttcaaccgagatctctcggcttgcttagcattagaaggaccactcttctaatatgctttgcttactattattataatagaaagcgtgaccagacacaattaatctaattattttttccgctctaacgggctaaggtcaagctagtaaccgctttcgccccggtcaaattaatttgcgttgcggcatgccgcaacgttcttcctgtggtatacacatcatccaacaacaaaacccgctggccgtgacacaggtctttcgcctgtggcgctaaggtgaagggctggggagttaataagcgttgcgctcgatttttggccgactgtggcgtcgctttatcttggtcaatcacttgtaggacctggtagtaggcttgaccggtcaaccagcccgtcacctgattgaatccccgcgactgccaagtcgattgagcaatcggaataggtaccaatatgtcataggttaattgggttaacgccgtcgctaacgcccgttgtagcacccgttgcagtgcatagtcgccttgaaatttatactgctgcatgtaggctttcatctcagcatcataacagtatagtgcccgattgaccaacggctgatcccagcgttggcaatcctgacacaactgacaagtcgtctgttggcgcccacactggggacaatgctgaccactaattggcgataaccgcccctgacaaggaacacagatgtcgggtggggttaccgggccccagcgccaaaactgagccaacgtcagggacgtcttcaagggacgctgacaccaaacacagaccgtcatggctgccctccctgacgtctaccttgccagttgaggcgcgcaatcattccccgcgccgcgcggatagtttgcgtatgcgtttgacaataacaaataacgctaccagttgggtcctgactgctccgcccgacacgaccggcgatttgcactagcgctgcagtggaaaagattggatcgtcgccgcccaaaatcaggaccgcgatcccgggaaaagtcacgccccgttccaaaatagtggtagtcactaaaaaagttagctgttggtcacgcattgcctgcaccttggtctggcgttcaggatcactagcatggacggtagctccaccagaaattccggccaactttaacgcccgctcgaccagcaccagatctgccacatgtggcacaaatatcaaaaaaggccgtcgttcggtcaagaagtgctgaatctggcgtaaaaccactgctggtaagccacgtcgttgcagtcttctacgccattgccaggtcacttgcacctgaatttggggcagcaaatggccgtgataccgcaaaggtacataagtcactgtcaattggtggcgcgcgacttgccgttgtaagcgttcatcgggtgtcgctgttaagtataaatgactccccgaagccttttgcgcgtgctgaatggcttcttgtaatagcgggctcatcgctaaaggaaacgcatccacttcatcaacaatcacccagtcaaacgcagccttaaaccgtaatagctgatgcgtcgtgcagatagttagctgacaatagcggtacggctctaattgatcaccataaagaacggtctgtgtgattgcttggaaggcctgacgtaaccgtggtgctaattccaaacagacatcgacccgcggcgatgcccatgccacccgccatccccgttgcaaggcccatgctaacgccggataaacaatttccgtctttcctgccccagtcactgcccataataaatgattgtgctgtgctcgcatctgggtcatcacgtcttgggcggcggtccgttgttgcgcacttaattgccccgaccaagttagtggtgattttgctaacattgaaaaccggttgggctctgaaatagtgtataatttatgttgtgacgtcaaccggcccatttgtaagcattgacggcaataccatgtgccattaggtaattgatcctgtggtcgtaaccactgccagcaccgctgacactgttgtcgttgtcccacccttttaattgccggttgcgcaacaacgttcggcaattgtggtggcccttccaagggcacttgccggccaaacaacgcgtcatcttctatcatttcggggcctcctttaagtcgttatggttaactccgcagcgccccgtcaataatttttaaggatgtttttgattatggaaacagattatctaaccattcggacgaatggtacgcacgagttagaaattaaaaaatcacgctttattgctgacctaggacgggtttcaaccgaagaagaagcaaaggcattcatcgctcaaatcatcgcccgggaacctaaagcaacccaccactgttgggcctacctactaggcgatcacgatgatgttcaacgggaaagtgataatggtgaaccgtcaggaacagctggtgttcccattttaacggttctgcagcgtaatcacctgcataatacgattgccgtggtcacccgctattttggtggcattaagctcggtgccggtggtttaattcgggcctatagtaatgccacctcaaccggtattgaagcaaccggtgtggttaagcgggtccggcagcaagcccttattttaaccgtggactacgcgaattatgatcgactgagcccctacctcactgagcaaaacattactgtcttaggaaccgattatgcagctgcggtaaccgtgaccatcgccgtcgacttggcagccgtcagtgccactcaaggcgccattcagaatttattaagtgaccgattaacgagtcgactcggcgacattgattaccatgaagttccggttgaggttaatgctagtcgccatgtagactaacatccagatataaagaggcgccccagaagtaacttctgagacgcctctttggcttaatctgaatttttagaggttaacttctgtactacgcggttaatccaatgcaacaacggttgtcgattagacccaaccaatccgattgcctccacaaaaagctctaggccaactaaaatcgcaatggtcagtaagactgacccccagatggtcgacaacggatatagcaacgaaataaacgagaaaattaaggcaatcccataaatcaccaaaaccgtttgtcgatgggtaagccctagttgcatgagccggtgatgcaaatggtgcttgtctgcgtgtgagatcggctggcgattcaaaattcgccggatcatcgcataaactgtgtcagtaattggcacacccaaaataatcactgggatcaccacggaaataaaggtgacgttcttgagcccatacaacgaaaaacaggcaatcatgaaaccgataaactgtgcccccgtatcacccaaataaatgcgtgccgggaaaaagttataaggtaagaagcccaacattgccgccactaaagcaaagatcataatggcaacccatgtattggcaacgttcaagaaaaataatccagtaataccagtggttgtcaacgcaatgatggaaaccccggtcgctaaaccgtccagtccatcaatgaggttaatcgcgttcacaatcgccacgatccaaagcaacgtaatgggtaacgccagccagccaaaatgccaaacaccgatgaacggtaacgttaaataacgcatcttgacgccggcaacaaaatagacttctaaggcggctaataattgtcccaaaattttttgctttggcgacagttcaaagacatcatcaatcatgccttcagccacaattatacattcaccgccaaacaacccccacagttgctgtgtgggcatctgatcgcgtaacaaaaacatcgttgaaaatgtaaacgcaatgaagatggctaggccacctaacgttggcatcggtactttgttgacccgtcgctgattaggtttatccaccgcaccaatttgaaacgcaaagcggcgcacaaacggggttaggaccgcggagataatcatggtagcaaacaagctaacaataatctcaaatttcataaggtgtcctctttcttttcattccttttgctaattatacaaatctcagaatttaaacacaaccgccatttgcgagttctacttaaaaatttaaccagatagtggtactttaaataattcacaagggtttacgcatttcgcttgtgaagtatacttcatttgcaaaagtttgtgtaagcgtttccttaacgcctatacaggctatttcgtgcacaagtgtacagtcaaatgcccttaatccgcagatttctcttgtgcaaatcgcctaaaagccatataataagattgtgttattgagaaaggtttcacattttatttgtacctatgctatttatcctatttccttgtgaaacctttcctcgttgatcgtcactattggtttgtatttcgaaaggagatttttctattggctgctaatgataaaacaccaaagacagaaacggctgaagaagaacaagcttcacccatcttaattcaaatggggatcttcgctgccatcctgtttgtttccagcctaatttccccactgttcccagcaacgttccccgtaccaactcctgtgattggtttagttattctctacatcttattagccactcatatcgtgaagttacggaacgtcgaaaaatttggggacttcatgatcagtttgattgcctttctattcgtaccatctggtatccaattagctgctaacttggatatcttgaaggctgaaggggttcaaatcgtcattgttgccttgatttctacgattgtccttttggtggttgtcgcttacacgactgctggctttatctggcttcggaagaacgttttccatcgtgacgttaacgtcgaggaataaaccgttcgcttctacctactttcactagaaaaggatgaaaatttatgattactttaacagcaaccgcccacatggcagtttggggcaaatggctcggtgacgccttagggactaacgccgctggtgcttctgccggtaatgctttatttggtatttttctatcattaatggtctacttaattggccaatggttattcaaaatcggtaagggtttcttcttattccaacccctatttgttgggatggtcttagggatcttcgtgctttacttaatggctcacgccttcgggacggatactgcaacgttctacaagtcagcctacctgcctggtgggaacattatcttctggttcctgaacccagcaacgattgccttcgccattcctttgtatcggcggaatgatgtggtcaagaagttctggctagaaattattctttccttaattgttggattggttatttcactgttcgtcatttacggtgtatcgaagttgtttggtttggacaacatgggaattgcatcaatgttgccacaagctgctacgactgcgatcgcaatgccaattgccggtgcaatcggcgggaacacggcgatcactgcaatggtctgcatcttgaacgccgttatcatctacgccttgggtgactggctcgttaagttattccgggttaacagcgatcctatcggtgccggacttggtttaggaactgccggtcacacggttggttctgctaaggccttacaacttggttccatccaaggttcaatggcttccatcgctgtggttatcatctcgattgtcgttgacatcgtggtaccaccatttgcatcaatgatgggcttgtactaaaactaatttcaatctaaacaccgacctaattgaggccggtgtttttctttacacttaaagctcacttctcagcagcctgacgtcccctaattagccggttaagctgataattgatagcttatgccagaatcggttaaggacttacgctgagccaattaggccgtctcttcgctgcatgttttccggcattaaaaaatgggaccaccagccattaacgcctggtgatcccattttattttgctgagtaactgaactactcttttaagtgataattataagttgaaacaatgatgttttcccgtgagtttaaaatcgcccgtaaacgtaatgccgtttggttatgcaaaacgttctgccaaggatgccgcggtacaaattgcggtaccaacacagtcgttgtaaagttacgctcagcagcccgtttcgcaatcacatcacagaaacgcagggttggcgttgcaattgaccggtacgacgagtgaatatccacgaaacgaatatctggaaactcttctttaaactcttgcgccgtcttatgttccttctctgggttctcatcaaaggacacatgcatggcaatgacataatcaccaattgagcgggcataattaatggccccagttgtcacccgagtgatgttgctaaccaagacaatgacggttgccccatcgtactcatgaatatctgctttttccttcgctgccacccgcaattgtttggcgacattatggtaatgaccgttgattcgataaaacagcaataaaaccagtggcatgatgatgacgtatggccacacgttgccaaagtgtaagaggagtaataacacgactagtcccagtgaaatcccagcaccgattaagttaataaatgctttgcctaaccagaagccctcgcgctctctaaaccagtgaataatcatccctgactgcgatagcacaaatggcacgaaaacccctaatgcatataagggaatcagtagtgtcgtttgaccatggaagatgaagattaggacaattgccccaacggccaatgaaataatcccgttagagtaccctaaccgatcgccacggtctaggtaggcgtgtggcaagaacttatctttggccaaattatacgctaggattggaaatgctgagaaccctgtattagcggcaaccgccaaaatcagggccgttgataattgcaacagataatacaagacaccgtgaccaaaaacgccaatcccaatctgggagagtaccgtttgattactttgaggacgaatccccatgtaataacttaagaacgtaatcccagcaaagaagattgccaagatgccggccataattgctaaggttgccgccgcattgtgtcgtttaggctccttaaagttaggaacggcattactaatcgcttccaccccagttaaggatgatgacccagaagaaaaggcccgaaggaacagcaacagtgtcatcccttgtaccggttgacccactgatgcggccgcatggtaggtaatatgaccactaacaatgttatagaatccgaccccaatcatcacaataatcatgaagataaataggtaaaccggaagggttagaaatgatgccgattcgcgcatcccccgtaggttcagcaacataatcccaatcacaatcagcaccgatactagcaccgaatacggatacagggccggaatcgctgacgtaatcgcttcagtccccgaagtcgttgataccgccactgtcagcatataatcaaccaacagcgacccaccagcgactagtccggctgattgcccccaattcgtgctagccaccacataagcgccacccccagaaggataggcgtgaatgatttgctggtaagaaagcgtgatcgcaaataacagcaccaacaccaaagcagcgacccacaattgataataaagggctgccgccgacaacgtgatgaggacggttgtgatttgctcagtaccataagccacggatgataacgcatcagacgacaatagggccaacgccttaaacttcgttagcgcctgaccgccttcgtccatggtcttgaggggttttccaattaaaacccgctttaaataacgccacatgactatttactccttatctccaataaaaatgaaagcgggccgtaacccgccaataagtgcacatttacatcacatttgaatgtgtggtaagtctactacaactagctccacattaccacaattcaagcagttcgcaacacccgaatgtgtttgcgaacttttctattatccagcaaacggcctgagaaataaagggttgattttcactttaatttattgcgcccctattattgacggcatgactgagttaagcaccggtctgactgtgttttaacgactggctattttctagatttttatcgctaatgacaaaaaaagaagaatcctaccaaattttggtggattcttccttcactttaatgcttaaaatttatccattgatggtcgacgcttacatcatgccgcccatacctggattagctgctggtgcagctggtgctggattgtcttctggcttttcagccacaacggcttccgtcgtcaacaacaaagcagatacagaagcagcgttttgcagagcagaacgggttaccttagttgggtcggtaattcccgcagcaaccatgtcttcgtacttgttgtcagcagcgttgtaaccaacacctggcttttcacccttcaggtgttcaaccacaacagagccttcaacaccggcgttttgtgcgatttgacgaacaggttcttccaaagcacgtaaaacgatgttgatcccggtcttttcgtcgccttcagcttcaagcttagcaacgtcaccgataacattgatcaatgcggtaccaccaccagcaacgaagccttcttcaacggcagctcgagtcgcgttcagggcatcttcaatccggtacttgcgttccttcaattcggtttcagtagctgcaccgacccgaaccacagcaacaccaccagataacttagctaaacgttccttcagcttatcacggtcaaagtcagacgtggtgtcttcaatttggcccttgatttcagccacgcgagcagcgatttggtccttagaaccagcgccttcaaccaccgtggtgtcatccttagtcacgttaaccttttgggcttgacccaattgatcaatcgtcgtgtccttcaggttcaagcctaagtcatcggtaatcacagtcccaccagtcaaaacggcgatatcttgcaattgtgccttacgacgatcaccaaagccaggtgccttgactgcgacaacgttgaacgttccacgcatcttgttcaagaccaaggttggcaaagcttcacccgtgatatcatcagcgatgattaagagtgaacggctttgttcaacaactgattgcaacaatggcaagatgtcttggatgttggcaatcttcttgtctgtgattaagatgtatgggttgtcaaggtttgcttccatcttatcattatccgtgaccatgtattgtgacatgtaaccacggtcgaattgcatcccttcaacaacgtctaagctcgtatcaaccccacgggattcttcaatggtgataacaccatcgttaccaaccttttccatggcgtccgcaattaacttaccagtttctttacttgcagaagaaatggaagcaatctgggcgatgtcatctttagtcttaacgtcatgagacatcttgtgcaaagcatcaacagcggcaccagtcgccttttcaatcccacgacggattccgactgggttagccccagcggtaacgttcttcatgccttcgttaacgatagcttgcgtcaatacagtcgccgtagtggtcccatcaccagcaatatcgttggtcttggaagcaacttcggaaacgagctttgcgcccatattttcaaagtgatcttctaattcaattgctttagcaattgttaccccatcgttagtgatggttgggttgccataactttgttcgagaaccacgttacgccccttaggtcctaaggtggtcttaacggtgttcgctaatttatcaacaccagcaagcatcttgctgcgtgcgtcttcagagaacttcaattctttagccataattcaaattcacctcatattatttttaattgtctcttagatcagtgggaaaggcttagtcgataacggcaactaaatccttttcgtgtaaaacaaggtaagtctggccgtcatactttacttcagtaccagcatacttatcgaacaataccttgtcgccaaccttaacagttggggctaccttgtcgccattgtctaacacacgaccatcgctcacagcaacgacgtttgccgttgatggcttttcttgcgcattacttgctaaaacaatgccgccaaccgtggtttcttcttcttgtggttgatctaaaatgacgcggtctcctaatggttttaacacttaaatccctccaataaacttactttttagcactgttagcacttgactaacataagtgctaatcaacaatatctaatatatggtttttcccagtaaaaatcaaggaatttgacaaagtaattcgcccatctttttcatgacaaccaaaaagtcgcaatcacaatcgattacgacttccaattattctttgctattataatgttccaagaagtaaatgagtgtttgcaactcattagtcaaatcaacgttttgtacgcggacatcttttggtaccgtgattcgtagcggtgtaaagttcaagattcctttgacgccaccggcaacggcgtcatccgtaacagactgggcgacatcggaaggaacggttaaaatagccacttgaatctgttgttcttccaattgtgtccgtaaatccgtcatcggatagatagggacgccactttgaatggtgttggcaatggtctcattaacatcaaaggccgcactgattcgcacattgccatcctgatgaaaattaaagtttaatagggcatgtcccagattcccaaccccaattagggccacattagttagccgatcctgattcaagattttcttaaagaacttaatcaaactctcaacgtcatagccatatccccgtttgcctaaggcaccgaaatacgaaaaatcacgccgaatagtcgctgaatccaccttaacggcttcagatagctctgtcgatgaaacccgtgttttatccgcgtccaacaggatattgagataacggtaataaatgggtaaccgtttcgctgtggcgcgaggaattttttgttctgtcaaaaaacgagacctcctaatcaaccctagtcgtcatcaccaattggcaacaacgctttctctaaaattgtttactgattgtgaaaattgctttcttataaattatagcatagccgcccgctttgtgaaagaatttgcaaatatttttcacaattatttcagaatttcggtctgctctaagaatatgctaaaatagacccatgacttttaaacggaaaaaggaggtttagtcactgtgattctcttacaagtacagcaggtcactcgccgctttggcgccagtgtcctctttgaaaatgttagtttagatgtccccgaacacgggcgcgtggccttagttggccgtaacggtgccggcaaatcaacgctgcttaaaatgattgctggtgaaacaacgcctgatgaaggccaaattaccactaagcgtggattgacgattggttatcaagcccaaaatgccggtctggcttccagtgagactgtttggaatgagatgcttagtgtcttcgctgaagttcgcgccatggaaaatcgcattcacgaccttgaacagcaaatgagtgatccgacggtgatcgccgatacggaacagttccaacaaatcagcgcggcctatgatcaattacaacaggacttcagtgaccataatggttacggctatcaagctgagattcgcggcgttttatatggatttgagtttggtgaagcttactatgacaaacccattaatgaactctccggtgggcagcgtacccaattagccctagccaaactcttgcttgaacgacccgacttgctcattttagatgaaccgaccaaccacctggacgtagaaaccttgacttggttagaaagttaccttcagggctactcaggtgccattttggttgtctcccatgaccggtactttctcgatcacgttgtcaacgacgtctacgatatggcccatggtggcttggttcactaccccggcaactattcccattacatcactgctaaagctgagcgcttacgccaggaatggaaagagtacgataaacaacagaccgaaatttctaaactcgaggactttgttaacaaaaacattgtccgagcgtccacgactaagcgggctcaagcgcgacggaaacaattggaaaagatggaccgaattgacaagcccgagggtgacgaaaaggtcgcccgtttccaatttcagccacaccgtcagagtggtaacgtcgtcttagatgttgtgaacggtgcagtgggctacgaccaacagatcctctgtgcccccgttaacttagacatcaaaaagcaccaagcggtcgccattgtggggcctaacggcattggaaaatcaacgcttctcaaaaccattttgggacgtctccccgccattcaaggacagattatctttgggactggtgtggacactggttactatgaccaggaccaagccaccctgcacgagaaaaaaacggtgctccacgaactttgggatgatcatcccacgacccgcgaaggcgatattcgttcaattttgggtagctttctctttaccggtagtgatgttgataaaagcgttcatagtctcagtgggggcgaacgggcacgcctgctattgaccaagttagcacttcgtcacgataatttcctaatgctcgacgaaccgactaaccacttggacatcgacagccgcgaagtcttagaaaacgctctgaacgaatttgatggcacgattctatttgtttcccatgaccgttatttcatcaatcaagtcgccacgcaagtcgttgaactcggtccaaagggaacgacccgttatctgggcaactatgactactacgtttctaaaaaggcggagcaaacagcgtatgccgagaaggaagcggctgaggcggaagccgcccacccaacaacaattgcccctaagaaaacgcaggttgattatcaacaacaaaaagaacagcaaaaagccaaacgcaaactctcacgtcaagttgacgccttagaagaacaactcgcgcaattagaaactgaaaagtcacaaatcgaaactgccatgagcgctcccgagaactttaacgacgtcgctaaattggctgatttacaggcccaactcacgactgttaccaccacgctcgctcaaactgaagacgactggactgaaaagagtctcgcgttagaaaattttgctgactaatgtctatcacttagtctctctagccactcccctggggtggcttttttaaattgcgtttctttgctggctcatcttgcgaatctcactaaaataggtatacttagttctatgaatatcgaaacagcctcattggtcactgacgatgaacgagccgccatctttaaagcattggctgaaccaaaccgcttacggatcattcgggtgctctatcaggcccaacgtgaattgacttgcagtgagattgggggtcagttgaatattagcaagtcaaccgtgtcttatcatttcaaagcattgcggttagtcggtttaaccaatacccgtcaggtcgcacagaccaagtatctatcgttacgtcaatcaacgttcgatcgcgtcttaccagggttccttgcaaccctgtagtttttgccttcattgttcgataatcatcgaaataagagagaaagtgaagttgatatcatgaacacaccacacgaacacagtcgctacctcaccttagggatgatgttagtggcgaccaatatgcggctccccatcaccatgatgcctgggctcatgcacagtctccagcaaacgattggtctgcccagttcattagctgggcttatcaccaccattcccctcctaacgttcgctgtcatgtcaccattgattgcgcgctgggggcgccgctttggtaatgaatggaccatttatgtcatgctgatcttactggcggtgggcagttacttacgggtcatccccaccgtagccagtctattactgggaacctttctggtcgggatcggtgttgatggcggtaacgtcctcattccagccgtcattaaggataatttccccactaaaattaacgtagcaaccagtgaatacacgctatcgatgttattgattggatcgttgggcaccggactttccggggtcctggctgcacactggccactttcattaaccattgccgtgttatccgcaatcggtcttgtgaacttagtcgtctggttacccaatctaaaattcaatcacccagcacccgtgataacggcacatcatacccccgatacccatcccagcgtttggcgcacccctcgcgcctggattgtcaccgccttctttgggttacaggctttggtctattactctttgctcacttggttacccaccattcttagtacccggggattttcaaccattgcggcaggaaacttggtcacggtgatgcaactagccggcttgccactcgcctacttagtccccaccctgtcaaactctcatcgcggaactgccgctatgattgggacagtcggcgttggcttcattgggggaacggcaggcatcttgcttccccatttctcctttagtgttgccgtgctattatgcttactgttgggctttggctccggcgccgctttcaatctcgccgtaatcttcttcacgcaacaaacgactaatggctttgaaacagcagacctctccggtatggctcagtctgctggctacctcctagctgcagcgggtcccgtcttattcgggtggttaggccagctcagttggtcactggttttgtggctcgccattgggttttcgattctcttaactttggccggtattctcgtttatcggcgggacacgatttatgattaacaaaaagagtgaactggctaggccggctcactcttttatatttatcgcgatttattttcaatcaatcaaatgaccatcaactatttaactggatcagctacccaatcaaactccaagctaggatcggcgttcaagctcgtatccgccaaaacgccatgttgataggctacgtaggcaaacgcaccgatcatcgctgcattatctccacacaacttcaagggtgccttgaccaaatgcgttgtggggttgctggctagatcagctgctagtcgttcccgtaacccacggttggcagcaacgccaccagccagaatcaattgtttaactggataatcggccaatgcccgttgggttttctcggctaacacgtcgaccacagcctgctggaaactagccgccaagtcttgcttattaagcgtttcgccaatctggtcggcatgatgggtggtgttaataaaagcactcttcaatccgctgaaactgaaatcgaagttatcgtctttttccattgctcggggaaatttaaaggtatcgtggccttggtgcgcccagtcatccaccgtcttaccagccggataattaacgcccatcactcgacccactttatcataagcctccccggcggcatcgtcgcgcgtttcaccaataatttcaaattgattttctgccggcatgtaaaccaattccgtatgcccgccagataccaacaacgccatagctggaaattcaattggttcaacgtagcgggcagcataaatgtgacccgccatgtgattcaccggaatcaacggtagattgtgggcaaacgcaacggtcttagccgctgttacaccaatcaataacgcccctaccaatcctggtccataagtaacggccactgcagtcagatcatcataaccaacctgagcttcggcaagcgcgtcttcaatgcacaaggtaatttcttcaatatggtgacgactggcaacttctggcacgacaccaccaaaacgctgatggctcttgatctgcgtagccacaatattggataaaatccgatgaccgtcttcaatcactgccacacttgtttcatcacaacttgattcgaatgctaaaatcaaatttcgcttttccgttggactcactcccatttattttctcgcaaaaagacgagtggccaagtgcctactcgtccttttcggttgctaccgttgcatcagcttcgttatcttttaaatacaaaaccatatcggcggcatcttcgtggtcaccgaagtaatacccccgtttaataccggtttgttcgaagtccaaatcacgataaagtttttgcgcatttttattggatacccgaacttccaagctaacggtcttgtaatttaagtgccgagcctttttaatcataatccccattaaaaagcgacccagtccccgactttgataatcaggcaagacagcaatattcgtaatatgcgcgtctcgcgtccgttcatcaaacgtgctgccaatgaaggctaataaccgatcattcttgcgaataaccaaatacaatcggtctttttcccgccgcaattcgttggcaaacgccgtggcatcccagggcgccttcccagcataaacagcgcgttcaatatcaatcatttctgggatatctgtaaacaacgccttggcaacaaaatacgtggtatcgcgtatttcgacccgatgatttttcacatccatggcttcttcacggacgagttcacgacgactcccaaatacatttttataccagactttaaattttttcaacatacgattcagtatcctcattagggttcttagctcgccattcggcttctgcttgcgttaaacgtaaatagtttggcacgaaccgatcaacgtcagtcaccggactgagctgctggcccaacagaccgatcgtggcagcttgtggcaaattcatccacggactcacgactggtgtcgccgcagagacggtggtattaatcaggtcgtcaaagtgagccgcatcgcccaaaaaccaaacgggttccgcatactccgtcactgccgtcaaaaatgttgtgatattgacgtgcgcatcggcaatcactggtaccggcatgcccgctttaatccggtataacccggcaaagacgttttgattccgcgcgtcaaaaatgggagccaccaacgcaccctcaaccggcacattagcagctaacgtcgctaagctggatacggccactaagtctagatccaaagttgctgccaaagtcttggcggttgtcaccgcaatccgaatgccggtgtacgaccccggaccagcagccactaccacccgatctaaatcacctggttttagagccgccatggctaaaagtcgttcaatttccggcaacagatattctgcatgtttctgatgaaccgtcaccgtaatagccgcaagaacggtcgtatcgtccaataccgcaacgctcagcggtcgattcgacgtatcaattgctaaaatcttcataatatcttgtgttccccttcactgtgctttaccaaaatggggcactcgagctgtccccaattgcccaccgctagtgatacttccgcggcaattacgtccattcactgcttttatcagtttactatactaccacaaactgctaagaaccacagtaaccctgcctgaaattaaccaaaagttagcggttatcccattgaatcgtcgctttaaccgctgtaaggtcgcccactttgatcatatgctgcgttgttaaggccgctgcttgagacaatttgctggtaacttgatgcccatactgaacctcattttcaaatcggatctttacatcagtcggatgatgcgcccgcaaaaaagttgctggcaaaacatctaacatccagtcaaagtaatgggcattattcacgtgcccgttaccatcaatatcaaagtaacgaacggtataaggtttgagcgtttgattcacggcctcgtcaaagtgatcaggtcgtggcaaccgtggtagacgcgtttgctcttcactgtggtaaggtgccatgacttcggcggggatggtggtaatcttgcgtgttgcataactcattgtcacccagataccttcgccataggccaacacttgaccagcgtcatctaataaccagtattcccggtacgcaaagtaacggttataggccgttgcccgcgtcttaatcgttacttgggcacccgttcgtggcaattcatcaatgtggaggtggtattgggtaacgacccaaccaacaccatgactttgaacaaaggccgtactcaatcctaaagcatcattttggtcttctgataccaacacaaataaattgattagcatcgctaaggttaattggccggtatcgtctgcttcatagtaaacgacccggtgtgtttcggaaaattcatttgcggccacctaggtcactcctcgtctaaatgatgatattgtcgataaatttcttgtttcttcgcgccacgtaatttggcgacttctttaatcgcatcattgggcttctcacccgccgcaattaatcgatcaacttgtacatcgattggttcgcttaaatcaaccgccgtcgtggccgccgtcgttggggccggattgccaccaaccaatacgacaaactcaccacgaacggtatccgtagccgcccagtttgctaattcagctaatgagccgcgtaaaaactcttcgtagcgcttcgtcagttcccgacaaagcacggctggtcgctcatcgccaaagccagccgccaaattttgaagcgtctttttcaagcgatggggcgcttcataaaaaatcaacgtttccggtcgttgggcaaggccggcgatctccgctttttgatccttaggcttacgatctaagaaaccataaaagtaaaagggttgtggtgctaatcctgatgcgattaacgctgttaacccagcatttgctccgggtaatggcaccactggaatatgagcgtcaatacaagcattaaccaattcatggccgggatctgaaatcgacggcatgcccgcatcactcacctgagcaatctgcatgccttgttttaacttcgcaatcaattgcggaattcgttcttgtgtattatgttcatgaaaactgatttgcttagtggtaatttcaaaatgatttaataatttctgcgtgttacgcgtatcctctgccgcgattaaatcgaccgccgttaacgttttgaccgctcgaaaagtcatgtcatctaaattaccaattggcgtggggaccagatacaagtgtccccccgtttcagtttgaaaactgcgttgctgttccacgttgacgcctcctattgatcgcgataaataacctctaaacaaaaggcgcactcttcgtcttgtttacgccgagttccgtaaaactcacggcagacgtgaaagccttcctcatacagtttttctaagatctgccgcgatttagacaatccctgcggcgtttccgggtcctccggcaacgttcgttgaagttctcgcacaagttctcggagatgctgattttcaatttctaattcggcattttgctccagtgcctgcgtcatttcaccctggaggtcagcgaactgggcgagcatggcgtgtagctggccttccagatttttaaattgatcataaatttcctgtttatccaacattgccaccccttcatatctaacctaacgtgccgtgatcgtcagtatttccagcgtcaaggcttctaaaattgcttgaaaattcaaattaccggccaattggccccgtgttgctaaggttaatgtcatcacgcggaccaattgatcaattgaaagccgttgggcgacctgttgactggcctgtgccaccttaggaaacgccaatgacgccgcctcaagcgttgcattttgctgccgaagtgcgtcgtgccaagcttgaaccaccatatctaacaacacaccttgacgatcgcggttaagtgctagcggcaccaattccgtttggacccgcacaaaggcccgttcatcacccgtacaacatgcgctaaaccactgaccaaccgcttgctgcgcatcctttagccaatcatcgaccactaagtcttgcgccgctgtgacactttcagtcagggtcgtcaataagtaacgttgactaggggttatccctgcatcagctaaggccgttaacaacgcttgcggcgctactcgcaaaaaatcaacgatctgtgttcgcgacagaatcgttggcaaaatcaaatttttattagccgttagcagtaacgccacggtattcccaacgggttcctcaataaatttgagcagactattggcagcccccgtcgtcatccgttcaacttgatccacgataaagatcttttgattaccctcaaccgcacttttcgtaaactccgcttttaaatagcgaacttgatccaccttaattcgttgcccatcgggaacaacactaaccacatcgggatgatcaccggctaaaatccgtcgacactccgaacactgaccacagggcagattatccgttacattttggcagaataaccgcatcgccaccgtctgtgcgacctgctggcgtccggttccatcagcaccattaaataggtaggcgtgcgccaaacgtttggttttaatcaaagtcatgagatgggtgactaactgtggctgcaatcgttgggccaccgctaccacagattcttcagtcatcgtagcctcctagaattggtgaaactgatcgactggtagtacaaagaccgttgcaccaccaacctgaacttcaacgggataagccgatgtgctatccaattgcgcatccaaattaactggtggtgtcatgaactgttgccgcgtgtgactagctgtcttgatcatttctaagacttcatcgacccgttcatcttccaatccaatcatgtaggttgtatttcccgactttaagaacccacccgtcgttgacaaccgagttgcccgaatatcatgatcgataaattcattacttaagcgatttgcgtccttatcttggacgatggcaattaataacttcatactcgtttcctccctcataccgctacttagtcaaaataattttgtgccgcctgcttaattaaggttaatgccgtggtcacaaccgcttcacgcttctgtgtggcatcaattagcttgatacggtcgggatgcgcggcctgtaaccgtaaataggcagcccgcacacggtcatggaaggccgcctgttcaacatctaagcgatcgaccttttggggatcacggtgagcttgaatccggcgtaacccaatttcagcaggaacatcaaaatacaccgtcaaggcgggcagcagtccatctgttgcaaaagtattcatttgagcaacagcgtcctcaccgatttgtcgaccagcaccttgataggcgactgagctgtcgacataccgatcacacagcaccaacttatccgcagccaaggccggtaaaatggtctgtgccaaatgctgccgccgagctgccgcatacaatagcgcctctgttcgataatccattgccgtattggcccgatccaaaataatggcccggatactttcagaaatcggattgccacccggttctctggtaatcaccagttgatcgcctaataccggtttgatttgcgtggtaatagcttgtaatgcactggttttaccagcaccatctggaccttcaaaactaataaatgttcctgacaatcgactcgaccccattttttattgataggtatattgtacttgaattcagaaatgatgtctatttgcattgccggatttctcagagaatccgctgaggataacctaaccgaaatttacttactggaacctaactagcaccatcagttactgacacgcaaaaaaggcttgagaataatcctctcaagtctcaataccaattaatctcgaaaaacagccgccgaaatatgccgtcctttaacctgacgccgacgggcttctcgatataaaaagagatacgtttgccgggtcaaggctgtattagcggttacctgattatccgcgtccgcaatggcttcttctgtttgcttcgcgtggtcccaacgatctttagcgcgatcaatagccgtcaacagctggtcatcatatgctgcctttaaacggggtaactgtcgtttttttctaccaaacatttgcctagcctcctgacctacatctctgtccgcccttcaacggccttaaataaggtcatttcatcggcgtattcaatatcgctgccgactgacaagccatgggctaagcgcgtcactttaatccccgccggcttaatcagccgagacaagtacattgccgttgcttccccttctggtgtcgcgttcgtcgcaataatgacttctttaatattagggttttgttggagtcgattaattaggctcgcaatattcaaatcctcagggcccttgccttcaattggcgacatgaccccatgtagcacatggtataagccatgatattctttcatcttttccatcaccatgatgtctttaggctgttcaaccaccagtacatgggtttggtcgcgcgtcttatctgcacaaattgaacacggatcatcctccgtgatgttgccacagattgagcaaaaatgaagatcccgtttggcggcaatcaacgccttagaaaaagccgtcacatcatcttcagccatatcaatcgtaaagaaagccaagcgtgtcgccgacttctgtccaattcctggcaatttcatgtacccatcaatcaactgggcaatgggttctggatactgcatgccgcaaacgtcctttcttgcttacattcctggaatattcatcccttgtgtgtacttccctaatgattgttttgtcgcatcgtcaacttgccctaatgcatcattaacggccgctaagaccaaatcggccagcatatcaggatcatcgggatcaatcgcttctggcttgatcgttaaatccgtcatcttccgttcacccgtaaaggtcgcttgtaccatgctatctggtgatacgccggtaaaggactgcgcatttaaattggcttgatcctcttccattttcttttgcatttgccgcatttgtttcatcatatttcccatatttcccatgttccgcatcattaatcatcctttcatttattaatctgctttcacgtcaacgacgctaccaaacaattcttctgcttttgccacaaccggattcggttgtggtgcctgactttcagccggttcatgattcgtattttgcaactcatccttatgcgccgtcaaataattcttccgaattgtcggccattcttctttcggaacaaacaccacaggcaaagcggtcccaatcatccgatccatcccattttctagtgcgtctgtcagttcttgatctgacgtcgctcgttggtacaagaaagaataatcaaacgccacaatgacacctgaatccgccgccgcaaccggttgagagaccttcatcactgcccgttgcgaggttgatagactatttagaatatccggccaaacctcttgcaattgattcaacttatcccgggtagccgcccccaaaactggataaatcttcgctaagttgacctctttaaccggtacctgcttggttgtccgcggttttgctgtagccttaggcgttgccggtgtctgttccagatgcttaaccgtcgtccgtaattgttcaacttcacgttgcaagttggccagttcgctagcgttagcggctggctgctctgttgccgtagctgttccggttggtgctgtcgttgacgcagtcttttgtcgaccaatttcggccaacttgatagtcaagatttccaaatacacatccggatgggtcgtgtagcgcatctgttgttgaatcgcattcaattcattaatcatggcatacatcgccgaagccggtgtttgctgggccaatgtctggaagtcttcactgacactccccatctcggcttcttccaccatctggggcgcttgttgatacagcaacaggtcacgcgcgtaaccaatcacgtcctcgctgaagcgctctgcatccttgcccgcctctaagaccgattgtaaagtcgccaaggccgctttcgtgtcacccgctacgacctgttgcatgtaagtcgccagcaattcatgggtcacacttcccgtcaccagcaaggcattatccaaagtgatctcattatcaccaaacgacagggcttgatccaaaatgctcaatgcatcccgcatgcccccttcggccgccttagcaatgaccttaagcgcctgttcgtcatacgtcacacccttttgatccaagatgtaagtcattcgactataactatcgctggccgcaatccgtttaaaatcaaagcgttgggttcgcgaaataatggttgcgggaatcttatgcggttccgtcgtggctaaaataaaaatcacgttagccggtggttcctctaatgttttcagtaacgcattgaaggccccagttgacaacatatgcacttcatcgatgatatagactttataatccgcaacggttggcgcgtatttaaccttatcgcgaatatcacgaatttcttcgaccccattattggaagccgcatcgatttcaatcacatcattcagggtgccattggtaatcgcctgacaggtgtcacattcattacacggctcaccatccgtttgatgatgacagttaatcgccttagcaaaaatcttcgctgccgacgttttccccgttcctcgagggccggcaaacaggtaggcatgactaatttgtttagtggtaatggcattttttagcgtacgtgtgaccacttcttgcccgatcatatctttaaactgttgcgggcgccacacccggtaaagtgcttgataagccatgccagtcgtccccttctcattaattactgattaaaaattactgttcaattatagcctttttagtcggtcgctgtcacgactcagtcatcagaatttagtagaaattaatccgataattttagacatgaaaaaactcccagtcaatgactaggagttggaattagctcataaacttgaagcacaaagcgaaacaaacttagtgctgcttccttccggacctgacacgattcgtaagcccacccttgctccaaggccttaacggcaagtactactatatcatgatttcttagtgctgtctagcagcttatcaggggcgctaacttgagcggcttttctcgccttcttagccgccttttgtcggcgacgggctgctttaaagaacgccaccattcgctcaccagcatctttagctaacagtccctcatgaaccgccacggtatgattcaatcgtgagtctgtcagcgtagcatacagactatcaacggcgccggccttaggatcacgagcgccataaaacacttcgggtattcgcgcattaatgatggccccactacacatcaaacacggctcaatcgtaacgtatagctgacaatcgttcaaacgccagctttgcaacgtcgcacatgcttcttcaattgcccgaatctcggcatgcaatgttgcatcatgcccgtgctcgcgcagattatgaccgcgcccaatgatttgaccgttatggacaataaccgccccaattggcacttctccaatcactgcggcctgctcagcttcaaagagtgcttcttccatgtagtgacgctgctgcaccgtataagtttgttcccgcactcaggtatccttctttctaaactaacgcgtccttcgtactttccaagatgtagtaacccttgtcttttttgataatggtacaattgccaaaagtagattgcatggtcttttccgccgatggcgccccctgcttcttctgcaagaccaccgtcaaagtcccaccgggtagcagatgatcggcagccccggttagcatagccgttaccacttgcttacccgcccggaccggtgggttcgttaagatagccgcataacgttgtgtgacttggtcataaatatctgaggtcttaatttcaacgttttcaatctgattcgcagttgcgttttttcgggccagctctaatgccaattcattaacatccaccattgtaacctgccgatctggccatcgctttgctaacgccaagccaattggaccatacccggtccccaagtccaaccacaaccctgctggtgttttggccgcgttaaacgcctctaataaaacccgtgacccataatccacccgatttttagaaaacaccccgttgtcggtggtaaacaacaattcgttacctaagagggtaaacggccaatgctgttcttcgtgtaaaacatctggattttgtgtataatagtgattagtcaaatttctccgccaccttttactctttattttaccgtagttagtgcgcagaggccaataaaaaaagattagtcgttcagacaccatatttggtagttattgtatgtttcaactaccaaatatggtgtcttttttgattgaattttttgatatctggtgtacactgaactcattaataaatgaatttttagaggatgtggctcaccatgaaagtaacaatttactcaaagaacaattgtatgcaatgtaagatgacaaagcgtttccttagcgaacacaatgtggagtttgaagaacggaatattaatcaacatcccgaatacgtttcttatttgaaagacaaagggttccaagcggtcccagtggtcgaagcacctggtgtaccagctttttatgggtttcgcccagaccagttaacgcaaatcgcgggctaacacattagctcggcacaaacccgtcttggcgacgtcgtgtttgttcacggtggcgtcatttttatttgatttttaccgctatttttaagagaaggaagagttgattgtatgagtttaaagcacttacccgatgtcacttactatgacctgaataatgaaatcaacatcccggtagatggtcagattccgctaaacaaggatcaagaagcgctccaagccttcttgaaggaaaacgtgatccccaatacgaaaacttttgcttccctcaaggaacgttttgactttctcattgccgaaaactacatcgaagaagccgtcgtaacggcttatcctttcagctttattgaagacttatatgattacctcaaggcccaggatttccactttaagtccttcatggctgcttacaaattttacgcccagtacgccctaaagacggacgataatgaattttatctagaaaatttcattgaccgcgtagcaatgaacgccttagattttggtggcggtgatcaacggttagcccatgatttagctgatgaaatcatccatcaacgttatcaaccagcaacacccagcttcttaaatgccggtcggtctcgccggggtgagttggtctcttgttttttgattcagtcaaccgatgatatgaacaccattgggcggaccatcaactccgctctacaactatccagaatcggtggtggtgttgggattagcctgtccaacttacgtggtgccggcgaccccatcaaacacattgaaggcgccgcctccggtgtggttccggtaatgaagttactagaagacagcttctcttactccaatcaattaggtcaacggcaaggggctggtgtcgtctacttaagcgtcttccatccagatattgtggcctttttgagtgcgaagaaagaaaacgctgatgaaaaaatccgcttaaaaacgttatccctcggtatcaccgttcccgataaattctacgaactctgtgcggctgatgctgatatgtacttatttagcccatacgacgttgaacgcatttacgggaagcccttctcatacgtagacatcacggccgaatatgacaatctggttgccaatcccgatatccataaaaagaagatgaaagcacgtgaccttgagaccgacattggtaagctacaacaagagtctggctacccgtacattgttaacattgatacggctaaccgagaaaacccaattgatggtcggatcgttatgagcaatctctgttccgaaatcatgcaggttcaaacgccgtcaaccgtcaacaataaacaagaatacgtcaagctagggaccgatatttcctgcaacttgggctcaaccaatatcgttaacttgatgtcttctcctgactttggtcactccgtggaaaccatggtacgggccttaacctatgtcaccgatcattcagatatcgatgtcgtcccttctattcaaaagggtaatcagttaggtcataccatcgggttaggtgctatgggcttacacagttactttgctaaaaatcacatgatgtatggatctaaagacagtatcgcctttaccagtgtctacttcatgttattgaactactggacgttaaaagcgtctaacgaaattgctaaagaacgacacgaaaccttccataactttgacaagagtgcctacgctgatggtcgttactttgaccgctacacagaaactgattggcggccaacgtcagccaaggttcaagaattatttgccaacgtttggttacccgcaccagaggattgggccgaactgaagacagccgttatgcaagatggtctgtaccatcagaaccggatggccgttgccccgaatgggtctatctcttacatcaatgacaccacggctagcttacacccgatcatcaatcggatcgaagaacgccaggaaaagaagattggtaaaatctattatccagccccttatctcagcaacgacacgatgccttattacaaatcagcctatgataccgatatgcgacgagtaattgatgtttacgcggccgcgcaaaagcacgtggatcaaggcatgagtttgacgctgttcatgcgttcaaccattccagtcggtctctacgaatggaaagatggtcggactgataagatgacaacccgtgaccttagcattctgcgcaactatgcttttcgcaagggcattaagtcactctactacgtgcggacctttaccgataataacggtgaagtcggcgctaaccaatgtgagagctgcgttatctaagcaccattagacgattaaaaaggagtggtcatccatggcacgaattgaaaattataacgccattaactggaacgcagtttctgacgagattgataaagcaacttgggaaaaattaacagaacagttttggctagatacacgaattccggtgtctaacgacttagatgattggcgcacactagatacggatcaccaatgggtcgttggccatgtctttggtggtctcacgttattggataccttgcagtcccaagacggtatggcagccttacgacgggatattcggacccctcatgaaactgccgtgttgaataacattcaattcatggaatccgttcatgctaaaagttattcaacgatcttttccaccctcaacacgccggatgaaatcgacgagatcttccaatggagtgactctgaggaatttttacaaaacaaaaccaagcggatctatgatctttatcacgatgacgaacacccgctaaagaaaaaaatctccagcgtcttcttggaaaccttcttgttttactcaggctttttcacacctctgtactatcttggccacaacaaactgaacaacgtggctgaaatcatcaagttaattctccgggacgaatccgtccatggcacctacatcggttataaattccagttgggaatgaaagaattaacagatgctgagcaacaacaaatgaaagactggatgtatgattttctttatcagctttacgataatgaagagaaatacacccatacactttacgatcaaattggctggacggaaaaggttctgacctttatccgctacaatgcgaataaggccctcatgaacttgggccaagatcccctcttcccagataccgcagaagatgtcgatcccgtcgtaatgaatgggatctccacatccacagccaaccacgacttcttctctcaagtcgggaatggctacctactgggtaacgttgaagccatgagcagtgatgactatacgattggtgaaccagctgatccgcaagatccaagtaaataagctaacaaaatcccccgctgatacacccattatggctgtattggcgggggattttatctttaattacaaattcgcttatttcacgttaaccggtgcgtgtagtatctctgtgctctcgttatactgaggtcacgctattcgttaaaaattctggctggcggaaagccgggtccggataatgatagaaaccttggccactttcttgccccaatttattttggtccaacatatcgaccttaagtttttgtacgactgtaaccaagtcttcctttcctggttgctggctagccgctaacataatgttataggccgtgcgtaagccaacttcatccaaaataccgaaaggcccaattggtgaaccaccggctaacatccaagtcttatcaatggtttccacatcggcaatccctttaacccacagaatcaatgccgcatcaacccacggaatcaatagactgttcagcacgtatccggattgttccttatgcagttcaattgtaatcatgccaatcgcatgcgcaaaatctacgactgtgtcataaaccaccggatccgttgttgggtgccccataatctcagctgtattattggcccaaatgtggttagcaaagtgtagggctaagaatttctctggacgttgggtaatcgctgcaaactgacttggtaacaaagttgatgtatttgttgcaaaaatagttttggtcggtgcaactttcgccaactggctataaaatttatttttaatatcaacgacttctggaatagcctcaattaccaaatcagcatctgttacggccacacccaagtctgtttcataagttagccgcgcattagtcgcctgaatctgttcaggcgtagcgtgtacctcatgcgcatatgcttgatcccaggtagccattcggctcttagcagcgctaattgccccatcgttaatatcatatagcgtcacatcaaagccactgaaagccgtttgataagcaatttggctcccgagagttcccccgccagcgacaacaatcttcttcatagtcatcatcatgtcctccttaaaagtcatttctaacgattacgaattcagcataagcccacccgtctaaaagaaccactgaggcgtatcactagttaagtttagcaaactaatgggggcaaaatgagtctgcttgctcgccattgacaagtctagcaatgcctttttgcggtatactaaacttaatcaaattttggaggaatccagtatgccaaccattaaaaatgtctgtgttttctgtggatctaatcacggttacgacccacaatttttagaacaaaccaatgccttaggcacttatctagctcatcatgaccatcccgtcgtttatggtggtggtaaagagggcctgatgggcgcgattgctacatcaacgatggccgctggtggtcaggtcatcggtattattcccaccttcttacgcgaactgggcttggctaaagacgatgtcacgacgtttatcgagacggccacaatggatgaacgtaaggatgaaatgcttcgccaatccgatgccttcatcgtcttaccgggtggctttggaacatttgaagaattcaccaccatgctctcgtggagtcaaatcaatgttcatcaaaagccaattgccttattcaatattgaccactactttgatgacctagttgccatgatgcaaaaatcttgcgacgctggctttgccccacaagaaaatatgaatctattcatcaacgcaacaaccattgacggtatctttaacgggtttgccacttttaaacatcaactgccttacaaatatacgaattaagaattaagctacgcaaaagaattcctgttcagcacctctgaacgggaatccttttgtagtcgctttactcattttctcgacttgaccaccgagtcgcattagcaaaccagccatttaaccacttaggcccaaccgctaccgttgatcctggtcggttgatgacaagcatcagctgtagcatactaaaaatcaacgactggcggcgccgataagctaaatacttcggttgccaatctgtcacatatttggctttataggctcgcagtccctgaaaactatagaaattagagccatattcataaattaaatgcgccgctcgttcctcaatgaagctaaatgacgagaccccaacattggctaagggagccattcccaaattgaagttttcatagccttgttgccggctgtaatcgaataggtagataaacagaccatccatgatgccagacggtgcctgcggactagcgcgcattaaatcaatcgaggtcatccgttgatcgcccgtaggcattaagttggcaaaggccactatgtcgcctgccttgttacgcattaccgctaccggtgcttcatctaaataagcggcatcgaagaaccccatcgaaaaacccttttccgtttcgccccgtaaccaggcgtctgaaattcgccggagctcattaacctgatgcgctcgtaacggtggctgcaataattcaaattgatagccttcccggtcaaacttattcatcagggcccgttcgcctcgatgagctttacccgctaaactaaacgtcgataatgcaacgtggccttcctccccgatcttaatgaaatcaaaacccatttcatgcaaccgcaacgttaatgtttcactaatttcatagaagactggccgtagcccagccagattagcgtctctcataaacgcctgtaacgctggctctagttttgcttgattaccgattggctcacccatgaccagtagcttatcagctttttggcggaacagtaaaaacagctgatccgcgccatcttcttgatagaaataggcctgtttgtcccgtaggaaggccaagtgactgacctcattaccaccaaagcgcgcaataattgctcgcatccgcggcgcatcatactttagatgtaaccactgtggctgcgtccacgctaagtaccggtaaacgcctaccatgatcaataatgccactaacaagccacccaaaccattcagccaaacctgcgttgatggtaacagccaggcactggggaaccagggccgatggtgcggaccttgcaaggtcgatagacccagcagcgtgtacatcaaaaaggtgcccacgtaaatgctgccatcaatgagtaacccaccccacgaataatgaaaactagttcgatacagttccggtcgcgcaactaataagcaaatcaaaactaagccaagtaaaagagctagtcctactgggaagttctcccgccataaggtcatcccaatcgccacaacgaggaccaccagtgtcggccagaaagcgcgtttgacgtgagcaccgacccctcgcgctagcccaattagtaagaaggccatcacaatattagtcacctgactcaaaaaataaaacatgtacggcacaaatcgcagataaaaccgattggccaagacaacatccggaattgtggcaaataataacatcatcaccccggaaaaatacataaaggttgtcacgagccagtgggcaccacgacgcaaggccgccactgggagaccatctaagaaccgatttaatcggcggccggtatcatgaatgaagaaaccgacccccactaaaaatggcaataagtaatagaataaccgatacaagagtaaccagccagtcgcatcggcgcgactcacccctaaaaatcctagaccaataatcataaaaacatcgaatgatcccagtccaccaggaatcatcgagacaaccccagcgactgacgccaccacaaacatcggaaaaacggccgctaaggaaatcggtaatcccaacgcccagccaatgactaggaagaagcccgcacagctggcccactccagactagaccctagaatcagctttaattctcgcttcaatgtcaaatccgcaaaaaactcactatcgctaatgcgtgtaaaaagaaagatgcccggaaaatacagaccgccacctaataaccaaatccaatagccccggtaaggctgaccaatgtcaaaaccaaacagtaagattaacgccacccaacaggccaatgatagccccgctaacaggaacaaggcaatcttagagatcgcataaaccacttgctttttagttgccgaccgcgcgtaaaaattggcccgcagactagcacccaacaagccccccattccagccagattagtaaatgtattggtggtccacccactgcgaacaatatacccccaagaaaattttcctggcaaaaattcgacaatcgtgaaatcatagatcaacatcggtgtcaccgccaagaaaccaccagcgatcaacagcaagatcgtgccggtatccaatgttgccaactccgattgcagctgttggccgttcacctcgtgggcaatccgaccaaccgtctgaatcacaaagattaaaattgaaaagataaaaattgctttaattaatggcaaatgtttctgaatccgtccccataattttcgccccatattggttcccccttactcctttctattatcgcaagttctgcggtaaaagacaatcatggctcaccattatagcagttaactttttttaaatctggacacaaaaatacggacccagctacttagcttgagtccgcatgggacgcttaaagggaaccacactcaattcaattgcttctgcttaattaataacgactgattatcgccacgaagcggcgcagactcttcacccaacacaccgttacgtttctaatattgcctaacatcgctacatttttggtaatcctttttgctttttttcaaaacttaaataaaaaattgtacaaaaaaaccgctacccgaagatagcagttcattatttcgtaagtgaagatgattacttcaaagtaaccacggcaccaacggcttcaagcttttccttgatgtcgttagcttcgtcttcagaaacgccttccttgatgacagatggtacgttgtcaacaagacccttagcgtccttcaaaccaagaccagtgatttcacggacagccttgatggccttaaccttagcatcaccagattcagtcatttcaacgtcgaatgagtccttggcaccagcagcgtcgccaccagcagcaccggctgcggctacaggagcagcagctgaaacgccaaattcgtcttcgattgccttaactaagtcgctaaggtcagtaattgatgcttctttaagagaagcgatgatcgtgtctttatcaaaagccatgatagatttcctccaataattgtttttttgatgttacgtaacgaaactttaagctgcgtcgccttcgtcgcccttgtccacgatagccttgattgcgtaggccacgttccgaacgggtgcttgaagttgacttgccaaagtagcgagtaattcttcacgactaggcaaggtagcgtatacgttgatttcatcgattgaaacgatgtttccttcgatgtaaccacccttgatttcaagagcatctacgctatcagcaaacttcttcaaaaccttagctggggcaattggatcctcgttagagaaagcaacggccgttgggccagcgaatacatcattcaaatcgccgtaacccgccttttcagcagcccgagtcaagatcttgttcttgatgacgttcatttgaacgcctgcttcacgcaattgcttacgtaggtcggttacttgttccaccgttaacccacggtaatcaacaacgattgcactggttgcattgttaaacttttcaacgacgtcttcgacgtgttgtgctttaactgcaatagctttttcactcacattgttcacctcccagaatagtttggtgggataaaaaaatccctatgccaccaagacataaggagtcaaaagtttaagtaaacttctgcctcggcaggcggtgattaagaccaatttggtcacctgagtcttaggtagatcaattcataacttaataagaatacatcaccgaacattgagtgtcaacggtatgttagggatttttttatttcacgctttaacttaggctaataaagaagccaagtcaacgtcgacgctagggccaaacgttgaagaaattgaaacgtgttgaacgtaagtgccacgtacagcagcaggacgaatacgaacaatcgtttcagcaatgctctttaagttgccggcaagcttgtcagcatcaaaagaaaccttaccaaatggtacagccacgttaccatcccggtcagtccggtaagtaacttgaccattcttagcatcggaaacggccttttccacgttcatggtaaccgtacccgtcttagggttaggcattaagcccttaggtcctaagacccgacccaaacgaccaacttgggccatcatatctggcgttgcaattgcaacgtcaaagtccaaccagccgtcttggatgcgttctactaagtcttgttcgccaacaacgtcagcaccagctgcttcagcagccttagcttggtcacccttagcgaatacgattaccgtggtttccttaccggtaccatttggtaatactaatgcgccacggagttgttggtccgcttgcttcgtgtcaacgttaagcttgaaagcaacttcaaccgtcgcatcaaacttagcgaaatcaatcttctttactaaatcaatggcgtcgcccatgccgtagaccttgtcagcctcgacctgcttggcagcgtcttgatactttttacctcgtttgtgagccatttttgtgtattcctccttgcaaatgtggttgtaacggataaacctcccacttgacacatttcattttcgtgaagtgtccgactatccgaaactgagcttaaccttcgaccgtgaagcccatgctccgggcagtaccttcaatcatgcgcatagctgcttcaacgtcagctgcgtttagatcttgcattttcgtttcagcgatttgcttaacttgatccttggttacagttgcaaccttgttcgtgttaggttcgccggaaccatgttcaacaccagcagccttcttcaacagcgttgctgctggaggagtcttggtgatgaaatcaaaggaacgatcttcatagacactaatcacaacaggaataatcataccagcttggtcagcggtacgagcgttgaattccttagtgaagcccatgatgttgatccctgcttggcccaatgctggtccaactgggggagctggtgttgctttacccgcgggaatctgtaatttaacgacattagctacttttttagccacgagacaatacctccttgagtccgtgatgtggtaagtggagctgttagtttgctcctcccacgttaacaatatgcgtcacgcatacctgagaatcataccacactttacctactgtcacaagttcttttctaaatcaacaccaaccaacgtcggcattatccaggaacttgtttgaaactgttaagccactgcttagttttaaacgattggatcaacttgatcgaagtttaattcggtactggtttctcgaccaaacatgtcgatattaaccttcagcttcatcttttcgttgtcaacttcagtaatcttaccaactaagccactgaaggcaccatcgacgatcgttactgaatcgccaggtgcaacatccagttcagcatggcgcgcagaaataccaacacgacgcaaaatccgttctacttcatcaggcaacagtggcgttggcttactaccttgaccatgggaccctaagaatccagtgacacccggtgtgttccgcacgatataccaagattgatcactcatgaccatttccactaagacgtagcccgggaaggtcttttccatcgtgaccttatccttaccattcttaacttcgtgttcctcttcttcggggacaaccacgcggaaaatgttgtcttgcattcccattgattcggcccgtgactccaagtttgccattaccttattttcgtaccctgcgtaagtatgcagcacgtaccattgcttttcagctgactcaaccatgtttggtgcactcctttagctttattgacttttcgagcaaaataaaaaaactccgcaatccacgaagttccctgttaccaattaatatagcatatttagtgttatttgactaccgacaattccattaggaaaggaactttaagccaaattgcacgatccagtccacaaccgcaaagaaaatggagaacagaatggaaatcccaaccactgttccagtatcgtgccgtgtctgcttaacaccgggccaagaaacttgcttcatttcggcaccgactgatttgaagaaacggattaaatgcatggtgttgcctccctaaaattaatgtttgtcgtgaatagtcaatttaacgggtttctcgatgtaatgtgtgcttaccacaaaatttacagaatttcataacctctagacgtttcgtgcgcgtcgcactcgcagtgatggtgtaattccgcgacccgcaaactgaacaagccagagcgatctttcgttgagccatcttgccaccacctttgatcaaatccactttaactcataccgtagtagcttaccatcgtttgctcgtgacgtcaatcattcggcgaggagtcggcgtaacttagcttgacttcgctgggcagccgaacgggcctgcttgtacgttagtgcctgatgttgactaatcaattctaaagagtccccacgaagaatgcccacaaaaaccgttcgttctactaccgacaatcgtggcagcaattgccaaatggcctcttttacttctaattgctcccgcaaggcccatcgaaaatcaggtaacgtatccgcaaaataactcgactgggcttcaatagaaaccgctgtatgattcatctgccgcttcagagcttgtgtctgccgaataaggtcaaaaattcggtgcgttagatttagccgatagaaggccccaaaactggttgtccgctccaactggaatttctgaacggcggtatacaaaactaaccgggcttcttgaatccaatcatcttgttcaaatcccggaatatagtaagtctgctgtaaacgatataagactggccgatagcggtcaaataaggttgctaatcccgaagaatccatcgattgctgcagttggcaaattaatgtgcggtccgttaattcagtcaaagaaaaagtcctcctttagctagtaactctagtctaaaggaagactgggcgtgtccccagagaacacgtgttttaatcttttttctttttgggtggccgcgccatcatttgatcccgcagtttttctaacttatacagttgctgatcattccacggtgatttacggacaagtccccgatcggcaaactcacgagctgtttgtttaacctcattttgggcccgttcaatgtcacgtaacagctctccagccggaatccgcaacgcaccttcagagaagatcgtccactgttcagcctggtcactagttgcaaccgtcacttgagtaaaccgtgtttggcgttccttggccagtcgctcgatataactgtcagccgtttcgtcccggttagtccacaccacttcgagatcgaactgacgatagctcttggaaatgcccggaacatacatggcatcaaataccactgtgatactggtatctcgcaacttcttgtaatttgccaacatgttcagcagctcatcacgggcctccggtaaccggtccgttaactttaaccgattgagcttgggccagttgccaatcatgttataggcatccacaattaaaatgtcttctttcattgacgttctccctcactcactgccgcaattaatgctggactggatgccgagagctaaatccctgatacatcagcaagccagcagcaacactggcattaaggctttgaacttcccccaccatgggaatcgtcaacatttggtcgacggtttccttgagcaatcgtgaaatccccttaccttcattgccaataatcagcgcactagcgcccttagcatcccaatcacgataatcagtccctgccatatcggtaccaaagacccagacaccacgatcctttaattcacgaacggtattgaccaagttggtcacgcgcgcaacggggacccgttcaatcgccccagtcgaagtcttagccaccaccgacgtcaatcctaccgctcgtcgcttaggaataataatgccatgaacaccactggcatcagctgtccggagaatcgatcctaaattatgtggatcttctaccccgtctaaaaccaagaagaatggggcttcaccggccgcagccgcacggtcaaagagatcatcaattgtcgcataagcaaacgccgatacgcctaaggccacaccttggtggttctgatgatccgttaacaaatctagtttctgcttgggtacttcggaaatgactaaatgccgtttcttagccaattgacgaatttcatccagtgcttctgccttgagcccactttgcaagaagactttgttgatggtctgctgactccgtagtgctgctactgccggatgccgaccgatgacaaaatcattattttcttcattattctcaactggtttcatttttcagtccgccccgcttctacttgttcaatgcaccactgacccagttcggcaacccgtttttgctggtcactcaacgccagatatcccatcaacgcttcaaatccagttgaaatccgataagtgaccacgtctgtattcttagcatgcgtgtagctcttggcattccgcccacgtttgaacatcgtccactcggcttcacttaacacctcgtcttgttccattaagttaatcaaggctgcttgcgcctttgccgaaacatagtgagttgctgttttttggaggtggttcggtttagccaatccctcggcaattaaatgccgacgaatgatgacttcataagccgcatcccccatataggccaatgcgaccccgtttagttgtcgataatctacttcactcattaattttcctttcgccaacgcgtcccttggggcgtgtcttccaaaataattccttgactcttcaattgctcacgaatctcatcacttcgcaagaagtcccgtgatttccgagcggccaagcgctcatcaatgagggcttgaatgcggtcatcatctagggtggctgcagcggcaaatttaatgccaaagacgcttaacaaatcactcagcgtttgacgaataaagtccagtgtcccggcaaacaccactggccgttcagcataaacattccctaatcgtgctaattcatggactttagcaatcccattttgcacgttaaagtcatcatccatcgcatcaatataatcggcgacaatttgccgcgtttcttgttccaccttaggatcattaccagcctcagcgtccttcagtcgatagcccatgttatcgtaggccgtctgcaatcgttccaggttccgttctgctgtatccaaattctgctgggtatattggattggccgccggtactgtgttgtcgacataaagaaacgcaacgtttgcggatccaccgtcttcaaaatatcgtgaaccgtcacaaagttaccaagtgacttactcatcttttcattgtcatcaccgatcgtcacaaaaccattatgcaaccagtaatgaacaaaggttttccctgttttggcttcgctttgcgcaatttcgttttggtgatgtgggaaaatcaagtcctcaccgccgccatgaatatcaaacgtttcgcccaaatagtgcgtcgacatgacggaacattcgatgtgccaacctggacggccagcgccccaaggagatggccatgaaatttcacccggctttgcgcccttccacagggcaaaatcgacgggatcttctttgcgggcagtttcttcgtcgttggtgtgctgagaagccccttcttcgagatcatccaagttcaaatgggccaattccccataatgactgaacttgtgggctcggtagtaaacgtccccatcaaccggataagcataatccttatcaatcaggtcttggacaaattcaataatttcattaatatgctcagttgcgcgggggttcacggttgctggttcaatattcaacgcggcggtatcttctttaaaggccgcgataaatcgatcacctaattcaggaaccgtaatgccctctttgttggcttcattaatcatcttgtcatcaacatccgtgaagtttgagacatacttcacctgatagccgcggtactcaaagtagcggcgaatggtatcaaaggcaatggcacttcgcgcatttccaatgtgaatatagttatacaccgtcgggccacacacgtacatgttgaccactccgggggtaatcggttcaaatgtttccttttgacgcgtcatcgtattaaaaactttcagcatcccgaagctcctctcgtgtcacatagtttacaatcattttggttaagtcattggtcaactgacaaagtattagctccattgtagcataatccgaccaaaaacaaagaagccgaatgaaggctaactagccctcacacggcttctttaccaaatattagccttttaattgggccagcgtttggtgaatgtgttctagggcagtctcccgcccaactaactcgattgattctggtaattctggaccgtgcatttcgtgcgtcacagcaatccgaattggcatccacaactgacgacctttgatgcccgtcttagcttgaactgacttgattaccttgaaaatttccacggaatcaaagagatccaacgcttcgatctgagcagcaaattcttttaagacaactggtgcggtgtcgttattgatttcatcaaacgcctcaccggacacctgctctggttcttcaaagaagaccgaagccatgtcattgatctgggccatgtagctcatttgacgcttgtacagattgattaattggcgggcccattcgatggtcttggcatctggattagcaggcatgttcccagccttaatcaattgcttcaaagccagatccataatggtactgtcatcggcatccttaacgtaacggttgtttaaccattccaacttgtcactgtcaaaagtggctggtgacgagctcagacgcgtttcatcgtacatcttgataaattgtttcttgttgaagatttcctcttcaccaactggtgaccaacctaacaacaagatgaagttaaacatcgcttctggcaagtaacccaagctacgatactgttcgatgaattggagaacagattcatcccgcttagacaacttcttaccggtgtccttgctaataatcagactcatgtgaccaaactttggtgcttcccaaccaaacgcttgataaatcatcaattgcttaggcgtgttggcaacgtgatcgtcgccccggaaaacatgactgatggccatcttgtgatcgtccacaactacggcaaagttataagttggcataccatcacgtttagcaatgacaaagtcaccaccaatggtatccgaattaaaggacacgtgacccttaaccatatcgtcccaggcaaagacttcatccttaggaacgcggaatcgaataactggctttaagcccttagcctttgcttcgtcaatggcagcttgcttttcttcttccgacatcccggcatattcatactcgtaatggggcatttccttgcgcgccttttgggcttcccggtcggcttgaagttcttcttccgtccggtaagattcataagccttgccttcgtccaacaattgttgaatcaatggcgtataaatatcgcgacgttcagactgccggtaaggaccatagtcaccaccaacatcaggaccctcatcccaatccaaaccgagccactttaagttttccaattggctccgttcaccgtcttcgatattgcgtttcgtatccgtatcctcgatccggatgatgaacttacccttattgtgacgggcaaataaataattaaaaatggccgtccgggcattaccaatgtgcaaatgaccggttgggctcggagcataccgaacccgaattgaatttttcgccaaaccgttacgcctctttctagtttttttcatagcgttaaagctgtaccgtcataaaattatgacggtttaagttaagtgtacaatgactggcctgaaaaataaaggtatggcacctaaatggctttcagaaattcttgaaaggcggtccagactgatcttatcctaaacgcccatagaactcacatgaagccgaaagggccccatgctaaaattttcaaaataaaagccccacggccattgccgtgagacctccattctaccgagaccgcttagttggctttgcggaattacttcctttaccttctttgccagcgttggcctgttcttcaatattcttgttagaatgcaatggtttggcaaaaatcattcgacccgcatccgtttgaatagcactcgtcaccacaacgtctaactgcttattgataaagtaacggccatcttccacgacaaccatcgttccatcatcaagataagcaaccccttgttgtcgttcagtcccattctttacaaccatcacgtgcaggttttctcccggaatcactcggggcttcaacgcattagccaaagaattaatattcaagacctgaacattttggaactggatcactttattgagattgtaatcgttagtcacaatcacaccaccattttgcttggccagtgcgatcagtttgctatcaacttctggaatatcttcgaagtccccctcatacatctcgatgggcataatatgttcattttgcaacttgtttaaaatgtccaatccgcgtcgaccccggacccgtttgactgagtcgctagaatctgcaatgtactgtaattcatagagcacgaagttggggactagtaaggttccttctagaaatcccgtcttagccagatcataaatccgaccgtcaatcaggatattggtatccaaaatcttatagtgatggaagtttggttccgtttccttatccaagacctgcttatcggtctcttcttcagctttcttgcttcgcgactggaacagcttacgccattcttcaagtcgaatcttgctcagccgcgccccaatccggtaaccaaagtacccaaataaaatcatcaaaatccacggaataaccgtgccgatgaaaaatgacggtactcggaacaagaattgtgaaatcaataaggcgagggctagaccaacaatcgttagcaagctaccgaagatcaacgtcatcgggttctgtcgattcaggtacgcttcgattcgattgatcaatcgaaccagcacacccgcaaaaagcgatcccaaaataaggaaaataatagcaccaagcaagatattaacaatgatgttgttgaccaatcggctggtaatgcccatcactaaccaagcccgggtgaaatatgcggcacccatcacgccacctaagatagcgaaaataatcaaaataactgtcttcttatgcatgtttacattcacctcccttcaaagttactttggccttacacgtccaaagccagttttaacgtttgtcgtaacgttgacacgccgaccacatcaattccgggatcgggcgtccacccttgaaggttattcttgggaatgaagatccgcttaaagcccagctttttcgcttccgcaacccgttgttcaattcgattaacccgacggatttcaccagtcaggccaacttcaccgacaaaacaatccgtgggttgcgtagcggtatcacgataacttgagacaattgacagggcgatcgccaagtcaatcgccggttcatctaacttaacgcctcccgcggcttttaagaatgcatcttgattttggagcattagattggcccgtttttctagcacagccatcaacaacgacacccgattacgatccaagccgctggatgtgcgttgcgcattaccaaagaccgatggtgtaattaacgcctgaacttctaccaaaattggccgcgtaccttccattgataccacaatggccgagccggttgcgtccttcaatcgttcttccaagaaaatttctgacggattagcaacttcatacaagccaccttcacgcatttcaaagatacccaattcattcgttgacccaaatcggttcttgaccgctcggagaattcggtacgtatgatggaggtcaccttcaaagtaaagaaccgtatccaccatgtgttccagaatcttaggaccagcaattgcgccgcccttcgtcacatgccccaccacaaaaatagtgatgccattggttttggcaatttgcatcagctcacccgtgaccgcacgaatttgtgagaccgagccaatcgccgactcgattcccggcgcctgcatggtctgaacggaatcaatgaccacgtaatcaggtttcatctgttcaatgttcgcgcgaatactggccatatcagtttctggataaagatacaagtggtcgctattgacgactaaccgatccgcccgcattttaatctgtgacgcactttcttctccagaaacatacaacactttaccgcctgtttggctgagttgccccgatacttgaagcaagagggttgattttccaattccaggatcaccaccgattaggatcaaagatcccggcacaatccccccacccagcactcggttcagttcttccatttgcgtcttcgttcggctttccgttgagtgtttaatctcactcatgagttgggggtgtgaccgttctccagaagcagtggtccgggttgattgtggcttggcggcagccggtgtgacgacttcttccaccatcgtgttccactcaccacaattgggacaacgccccaaataacggggtgagctataatcacaattttgacacacatacgttgttcttggtttcgccacattcatccctctttttcaaattggtctactgtgtatattttagcatatctaaccgataaatccccactagtctatcagggaatttacgaatcaattaagtccgatcagatgagccaaagccaccgatacgttcctgttgcggtgcctgttcatcatcgacccgtaaatatggcatgaaaataccttgcgcgattcgctggcctttcttgatgacaacatcgcggaggccaaaattcaggagttgcacaaaaatttcaccctcgtttttctcgttattataataatctgcgtcaatcacgccgacaccgttgggcaatactaattgatgcttcaatggattgctcgatcgattggctaaaatcaagacttcccccggctgcatgtaggccttaatccccgttgggaccaggtatggttttaaatcatgctgccccgccgtcagttcatcagttgtcaacgcctcacggtgacgtaattgcttaaaggcatgcaacacatcatgtcgccaaatggacggtaaggtaaaatcagtggcacactcaaaatcataacccgccgattgtttagtcgttcggtaaggcagtgttaatccctgatccgcgtacttactcacaatttcaaatcctcgttgcatggttaacagcactcccttaatctttttcgttctgttaccagaataagcaacctgcccgtagattaccagtaaaattcttcgctcttaagaagttttttccatccataaaaggagttgacaagtgtcgcctgatagaccagaatcaaagagtaagactggtcatgaaaggagtgcccgtatgacaatcacggaacaacctggtcaactgagtatcacggttgatgaacagctgttggcgcgcttacactatctaccgttaagcgattcacgttgggttttggaacaattatttgtgcgccccaaccaacctgcggctgaactagctgagcaactgataaatcgttttactaagcttgcaacggccgctaacgtcacagtcaatgtgttggacccctatgccaaacggtacttcgtccagcatccagcaccacaattattggcagccaatcagttgccagtgaccggtgaggcggcaattcaaccagtcgctttacacttagaacacgtagaagaggagtaatttactaatggatcaaaacgcattaaaggccctcgttggtcaagaagcagttaaatacgttgaagatggcatgatcttaggtatcgggactggctcaaccgtccgttacatgattgatgcccttggggaacgggttaaaaatgaaggcctacacatcatcggtgttgccacgtcagaccgttctgccaagcaagctgaatcccttgggattaccatcaaggaacttgacgaagtcgatcacctcgatttaaccatcgacggggccgatgaaattgatgacaacttccaaggaatcaagggtggcggtgccgcgcatctctgggaaaaaattgtcgctatcaactccactaaaaacatgtggatcgttgacgaaagcaaaatggtccaccatttaggtgccttcccactccccttagaagtgattccatttggttccagccacgttctagaaaagctaaacaagatgggcttcaaccccagcttccggatgacagatactggtgaacatgtcttgaccgattccaaaaactacatcattgacttacacctcggccggattgatcacccccacgacttagcgaatacactcaatggcattgtgggtgttgttgaacacggtctgttcttagacacggtcaacaccgtcatcgttggtcggcaggacggtcccgaagttttgaatgctcgcgactaattaaatagttaataactgattgcccatttgccggtttctcgccgtcaaatgggctttttttagctaacgactcaccggaccaggttaacgcccctgtccagtatcatttaaaatgccgaatcacccaataaatcccaaaaacgatcccgccaattaaggcaaagagcaccacaaaacagaccaggtagtaaattgaatcgcctaaattaaccactttcccacccccattcaataatgagaagctaccgtctgtccccgaaccaatgacccacataaccgctcatttttagaagtcatttctgtcaattatcccctatactaccgtgatttactagcgaatcttcgccaacttctctaaagctatacaaaaaatgagaagattggcgtacaatgagagaatagttaggagagtgaagatagtgagtaaagaaatcacagcggatcaaaccgctcgttatcaacaagccttagccagcgatgctagtgccaaggtgatcgaacgtgccgtgacgcatcaaggaatcttagccacagcagccgactatgcttctgaagccgacatgagcccagtattttccatcgacttggacacgggtaaagtggccaaccaaaagcaaagtggtcgttgctggatgtttgctgcattaaataccatgcggcatcatttagctgatctctttaagttaagcgactttgaactatcccagaactacacgtacttctgggataagtttgaaaaggccaactatttctacgaaaatgttttggcaacggcagatcaaccaacgtctagccgtaaagtggcctttctcatgacgaccccacaacaagatggtggtcaatgggatatgctctgtgccatcattgaaaagtacggaatcgtccctaagtctgtgatgcccgaaacttacaacagttccaagtctaacgagctcaacagcacgctgaacttaaagctacgtaaggatgccactatcctacgtcaattggttgccgacaaagcgagcgacgatgaaatcgcagctgctaaagacaagatgcttcaagaagactaccggatcttagcctttacgttgggcgaacccgtaagcgaatttgatttcgaatatcgtgatgacgataaaaactaccacattgataaaggtctgacacctaagaccttcttcgataagtacgtcggttgggatctcaacgattacgtttccattattaacgccccaacagctgacaagccatacaatcacacctacacggtggaaatgttgggtaacgtcgttggcggacgcgcggttaagcacttgaacgtctccatcgaagactttaagcaattagccatcaagcaactccaagctggccaatctgtttggttcggttgtgatgttggtcaagaatccgaacggcaaaaaggaatcatggacactaagtactacgataaagatgccctctttaacgttgacttctccatgactaaagctgaaaagttggactacggcgaaagcctgatgacccatgccatggtcttaactggcgttgacttagtcgatggtcaaccaaccaagtggaaggttgaaaactcttggggtgaaaaggtcggaactaagggttacttcgtcatgagtgatgcttggttagacaagtattgttaccaagttgtggttaacaaacaattcttgccagctgacttgaagaccacccaagaaactgaagaaccaactgtcctagcaccatgggacccaatgggtgctttagcttaattggctactcgaaaaaacgtccgagaatttttctcgggcgttttttatattgtcacgatagtatcgcgcacctatacgtgtaccaatacgtcaataaaaaagtcagcggcacacgttcaccgctgacacctggttatttcaatttcattggtttcataatatgatcaaaggtcgccatcgccaatttttctgttgaccattccggatacattgttttcttctcaaaattattcgataggaatactaccccagtctgaccatcatgactcatcacaaaggtactctcataatcatcacccatgccatggccgtaataaccacgctgattatccaaatgatacatgccaccggcatagtgaatcgattgctgacgttcatgaagcacatccgcgcctgccttggtggtgagcaagctacctgaaatgatcgcccgctctgcgcggaagacatcccccgcactcatggtcgcatttcccgtcgctaactggcttgctaagttagccgccgctggtttatgtggctgactgtagtctcgcggaacggcacccgcatatcccaccgtcatccccttagttgtcgtccgaagttgggcaaaactcgtgtggttcaaattcagtggtgtcaccagttgctgataaaataactcgtagtaagaatcatgggtaacttgatgcaagatccccgctagtagcgcataacaaatcggttggtagtcaaatttcccaatcttttttgcatccactttggcattttgactggcatacttgtacacttcgttttcagtcaaggttgtagcaggccgcagctggccaacaattccggcttccatattcagcatttgccgaatagtaactcgctggctcccagaaattgatgggtaatattgacttaacttatcggtcaattgcaattgaccagtctgagcagccttcatcaccagcatccccgtcatcgacttttgaacagaattgatcataaattgtgatcgaaccgtatttttcttatggtgttgggcattagccatcccaaacgcctgttgatacaccacatgaccctttttaaccactaaagctgtgcccacgaacttgcgattcttcagttcttgccgcaagtgtgcactgaacttcggggccgacttaccagagttagctttatcaaacgccgttttctgatgattgcgctgttgccgactaatcgccgccgctttagcaatcaccgcatgggtttgccgcgcatgccgatgattagtcgccgcaacttcctgcttgtcttgttgatcgatttggtgcatccccaacaccacgccgccaatccccacgatgacagcaagcaaaaccgcccaatggcgtaagtttcgtttattcaatttcctcaatcccccaattagagtcaatctaacctttaacctgattatacgaaaaagccggccaaaaacaatcagatcacctgattattttcgccgactagccgaacttattatttctttaaacaatttaaagtacttgtttgtccaatacattaagccgcgaatcaaattcataacgaatcggttcgccattagccacttctacctggctaatatcggcatccgccacccgatcaagatacttaatcaacgctcgtaacgtactcccgtgggccacaatgagttggttttgaccatcgagtaatcggggggccacttggtcttcccaatacggcattaagcggtgatacgccatttctaagctttcgccccggggctcaacgtgcgatccaaatgcatcgtagcgtcgatcttgactcacatgatctaacagtgggggaacggcggaaaagcttcgtcgccaaatcttaacctgctgttcacctacctgctgttggacggcggccttattttttcctcgcaaggcgccataatgccgttcattcagccgccaagacttatactctggaatatacagctgatcaatcgcagccagcacaatatgtgacgtcacgattgcacgttggagcattgacgtatgcaacgctgaaaactgaatcccggtctgtgcaactaactgtcccgccgcttgagcttgttctcgtccccgatcagtcaaggggacatcgctccatccggtaaaaatattgtcgcgattggcgacactctctccatgccgtaatatgaccagtgttgccattaatcacgcttcctttctatctcaattctcaccgctaatcataacatagccatctacaacttgtgtaaactttcacgcgtaattctactcataaaaaactgaacggctggcagttcgcccccgttcagccttattgtgttaatcaattggtgactctgaatgtgccgccaatttcgctggaacctcatcatccgcttcttgaaattcacgagcatcttcctcagccagagccgattcacgagccttaacccggttacccataaaggtaatcacggacccaattaggataatgacaattccaacaatggtattggtcaagatcttctcatgaattaaaacggctgctaagatgggcgccaaccccggcttgatgaagaacaccagtgacgctgtcgacacgtcggagcgttccattgccaaaaagtaaaaggcgaaaccaccaccggtcacacaaacaccgataaagaacaaaatccagaaatattgcaaactgacattttgcaatattggcagtgccgcaaactggtgtaaccagccaacttgtcgcatgccaccggcaacaactggaatatgcgtaactaacatcaccaccaagagctccaaggcccccgcaaagaatgtgaaacaggtcataataatgccattaaactggtgccgtacagatccccatcgtgaaacgatgctatacaacccaaaagttaacgctgagccaattgccaaaatcagtccgactggattcgtcaaatgtgcgggattaacaatcaccactagcccaacgattgaaacaatcacggctatcaagtttgcacggccgagtcgttcatgcaagatcaggtaagagaagattaaagcaaagactgggttacagctgaataaaacagctaccgttgaggcctcgtcaacagaaattgccagttgataaagggtcatactaataatgacacacacgaaccccgttagaaaaaacaagccccaatcggacttggtcaaacggtgatgttgcttatgtagtgcccgtaacgcgattggcaagaggactaccccaccaataaagaaccgaatcaggttcaattggatgggattaaaggccccacccgccgacttcaaagcaatttccatcgaactaaacattaacgttgaaaacgcgatgtataacagtgtttttctcaaaactagaactcgttcctccttaaaagacaccccgtaacttaagccacgtgctgcacaatgaccatgagaatcggaatcaccactaaacttaggagggtcgtttcggttaccataatggcggcataatcagcgtcagcgtggtacaacttagccacgaccggggcattcgtcatgacgggcatcgctgcctgtaaaataaagacttgtttcattaatattggcataccagttggcaataccaacaaggccattaacaccggcgcaataatgaaccgacctagtaaaatccccaagctatcacggtctaaccgaacgttttgcaacccggccccggcaatcgccgtgccaataaagatcatcgataagggaatggtcagtcctccgacgtattgaaagtcctgcataatccaattaggtaattgaatatttaataagaccagcaagacccccaccataaaacctaataatggtggcgaaaagattttacctaaagtctgcttaaggtcaaattttgacccagcttgcccatcgcgttgaatcaggtacacacccagtgtccagaaaaacgtggtattggccatataatagaccaatacaaatggcaaacttttttcaccaaataaggcttgattgacgggtagacccacaaaaaccgtatttgaattcaaaaacatggactcaaataacccccgccgattgggatgaattcggaaaatatgaaaggctaggatcgacagaccaaacataattagcatcgacaccactggaaaacggagatccggtaaagtccttttcaaggtctctgccgagaatttcgctgtaatcgtactaatcatgtaagccggcaacgcaatttgggtaaccaaccgtgcgatcagcttaggggcttgttcatcaaaccaccctcgccgcgatagaacgtacccgaggccaatcatcactaagataattaaaacaccggaaacactacgaataaagacggccattccgggacctccctgttaaagattgtaaaaaaattagagtttcttaagcaacgcttttaattatagcacgcccctgctatctatccttgacgcaaccggttacaattccacatttatcagccttacccttaccttgacaatgactaagattttttgaaatttggactaattggcccagtttttcacgaatttatccggtccgaacgtttacgaatcgccgtttttatggtctaataaattaattgagtctacagattaattccaggggaattttaagatctggtaaagtcaacgggcctttttaccttataaggccccgttccgatttataatgggtaaagattttgatgaggatgaggaaataactatgccaaatgataacgaaacaagacggcaacatcgaccggaagatttcgaacaggtctatagcagccgtgccgaccgtaactctcactataaagcaccacaggtacatccccatcgccccgtgatgtggactatcgtaattgccctactcgtattgctaggcgggggcctagcttacgggtatcaagcatggaactcggccaaaaaaacgttcagtcaaacctatgaatcttctaacgcagctaaaagtcgtaatgtctcagcggtcttaaagaagaataaacccttctcgattctgttaatggggactgatacgggggccttaggacgttctgatgtcggccgaactgacaccttgatggttgccaccatcaatccgacaaaggaaacggcctatctcactagtatccctcgggacacacgggtaacggttggctctggtgtcaacgcttcggttcaaaagattaatgcggcttacaccattggcggttcgaaaacggctgtaaagaccgttgagaatctgctagatattcccatcgacttttatgccatcgtgaatatgggtggcttggaaaaaatggtagatgctgttggtggtgtcgatgttacaccaccactgactttccattatggtgccgctaatgttaccaagggtaagaagattcacttgaatggcaagcaagccctcgcctactcccggatgcgccacgaagatccgttaggtgattatggccggcaaaagcgacaacggcaggtccttcagaaaatggtcgttaaggccgctggcttatcatcaattacacgctatcaaaccatcctcaaatcactcaatggtaacttgaagactgatttgaccttcgatgatctgatgcagattcgggctaaatatggggacgcttctcatcatatcaagtcagaaacactacaaggacaagatgccatgattgatggcttatcttaccaagtcccaacaactagcgagcttaaaaaagtgtccaatcatattcgtaaaacattggaattagccaatacgactaaatttacaacggatgccgatactgacacgactggttctaccgcatacggtagcagtgataacagtggttacggctactaataaactataaaaaccaaccatttctttgcgaatggttggtttttatttacacgaaattaaaaattccccttgccaatttgacaatttttctataatatttaaatagtaataattactatttagattgaggagagaaatcatgtcatctttttggaaaaagctatccttgttaatcgttttgttcacactcggtggcaccttagccgcttgttcgtcccaaaagaaagctaccactagtcaggcaaagccaatccacgtcgttgccagtctcgacttttatggtgaagtggcacaagccgtcctcggggatcacggtactgtcacgacaatcattaagagtcctagcatcgatccgcatgactttgaccccacccccaaagacgcacaggccgtcaccacggccaatgtggttctttccaacggcatcggttatgatgcctggatgcaaaagctcgtgaagagctctggacgtaagggcgtcaccaatttgcgtgtcggtgaagatgttatgaagaaaaaagttggggacaacgagcatctctggtatgatccacagacaatggcggccctagctaatgcccttgccactcagttcggtaaacaggcccccaagtacaaacaggtttatcaaaaaaacgctgccgcttatattcgccacctagcccccttacagcaacagataaagacgctcaagcagcgaagccatcaacaacgagttgacgttagcgaacctgtttttgactacgccttaacggccctcggctatcggcgtaataattctagctttgaaatggccgttgaaaatggcaccgatccttcgcctaaatccatcaaagctatgcgccaagatatcatcaatcaccgaattgcctttttcgtaaacaactcccaagctagtgacaaaactgtcgcaaccatggtcaaattagccaagcaacatcacgtccccgtcctaaacgttactgaaacactacctaaaggtaagacctacttgagttggatgcaatctcaataccgccagcttgccaagattcagcaagaagcggcacactaacctagcgaaaagcctcgctgacttattgccacatcggttaataccataaatagggtttccaagagctaggtaacttcttggaaaccctatttactattgcaaattatttccgtgccattcagtctactggtcccttaaattaggatttagtctgcgtacccggcaccttatccgtaaaatccatcgccgatatccgaccatgacgtcgtgcataaaacaaaactgccaatccagaaaaggccaccgtaacccccaacaacatgcccatctcaggaagcgctgtatttccaatcatcagcgtctcccgtaatccattgacagaataggtcatcggcaaccagggatgaatggcgttaaaaaagccattcgatagttgaattgggtaagtaccggctgagccacccaactgtaacaccatcaagatcatggcgaaaaaggcccccggtcgtcctaacaccaaattcagccaatacacaattgccatgaaggccgctcctgtgcacaaaatcatcacgaaagttgcccatgcatgaacgggtgccagaccatcaattaattccaaaaggctgataatcagtatcgcttcgcctagaacaaatgcccccataattgatgccttacctgtccaccaagccaccacacttcgcggatatttccgtggcgtatacatatcaaacatcatattgaaggccaaagcccccacaaagagggagacagacaccatgtatggtgccattcccgtgccattattgggtgcttcgtcacgctccgtatggctagtggtcgttggtttagcaaactgccggtaagttagctgagacggatgtaccgtcgcacgatcccccgcctttttaagtgaggtagctaatttttgattacccgtttgtactttggctgtgccagtcgtcactgactcggccccagttgctagtttccgtgtgccagccgttgcctgctgattaccagcaagaatggtttgcatccccgacgttaaccttggcccattagtcgccaaggtcgttaagccacttgtcagcttagttgccccggtatccagctttgtaaccccttgttttaacgctggcgtctgttgcgctaacgtcgtcaaacccgaagtcacttgggctgtcccactagttaactgctgatttttagccgttaactgttgagtgcccgtcgctaactggctacttcctgaagccagctttgtcgtcccagctgttagagaattccccttagtgtgcaacgcttgcgttccaacggccaaagttcctgccccatcagctaattgactgacaccactagttaactgagtggacttagacgccaatgtttgcaaccccgtgttcagtgctgataaccccgaattggctgtcgctaaatgctggctgagcgtgtccgcattaatcgtcaaagtatcaattgccgtcgccaattcattctgcttacttgcggccgtcgtgagttgagttgaaagcgccgcaacattcgcactatctggcagttcactcagatcttggcttaattgttgggccgcgcgttggaccgcatttagggattgatcgttctggctactggctgtgtcggccgtctttagcattgccgccttttgactagccgttaatccagccttatccgcagtcgctgctagttgactgtgcaagctcgactcagctgttgtcttagcgttagtcattgtcgttaaggtcgtctctaacttttctgcatcctgcttaactgcggcttgggttgtcgtactctctgccaagcgactaaccgcctgttttaaggccgcctgttgcgtggccgagccaccaagggtcgtttgtaccttcttcaaccccgctgccagtgccgcgctaccggtcgtcaattgtccgacacccgaacttaacgactgactatggtcagccacctgggtcaaattggtatttaactgcgtcgtcttttgattcagtgtaactaactgctgacttaacgtctgggcaccagcattggcattcgtcacaccagcaacgtactcctgggcaccagtactgatcgtttgtgacccactggctaattgaccagcagccatattcacgttgtctgctccctgcgtataggcgtccacacctttgctgacccgttgactccccgttgccagtctttggctgcccacaattaattgctgagacttctgtaacagttggtccaaccccgttgttagttgctgacttcccgcttgagcttggttgacgccagtaacatacgtttgcaggtgctcggtaagtgtctgttcaccattagttaatttgacagaactagctgctaacgtctttaaaccatcggcgaccttttgatccgccaccgtcagttgacggctcccctgtactaactggtggttgccctttgctgccgtcgtcaatcccgttcccaactttttgattgacgtaaacatcgtttgtgcatagctcttcgtcacctgctcacccacgctttgtgcggccgccttggcggcacttgccgtcatcttagccgcagtaaaattgtgcccggcgctcgtttcataatgtaataccatcttacttggccgtttggtcattaatgtcgtcgcgttgtgcgaaaagttttgtggaatcgtcacaatcatatagtattttcccgccttgaggccccgagcggcactttgggcaccaacaattttgaaatccatcccatgagagtgtcgcaaattggttgccagcgtctgcccggctgccaggtgttgcccctgataatctacagcgtggtcatggttcaccacagccaccggcagatctgatagtttcccataggggtcccacatcgactttaaaaaggttactgcatatatcgacgggatcaacataatcacaaataaaacaatcattagtagcttatgctgttttaaataccgccattctgctttaatcatcgcacttccccccttgtttatgctatagtgtgaacaacttaacctcattcggtcataccgcatacgtattttggcggagaacttccacaacaaaaagacccaacctgaggattaagccacactttcgcctcatttggggtttaactaggaggaactgatgaccgatcgacgtgttcaacgtaccaaaacagccttacgtcaggcctatcgtaaaattgcccgacaatacccttaccatgacattaccgttaagcaactcaccgatgaagctaatatcaatcgcaagacattctatttgcactatgactctatcgacgacttggcctacagtttcgctgacgaaattgccgataaactcttaaaactattgctccctaccccaggaacgacatattcaaccgtcgaacccggcttctggtacgatcgtctgtcggctttttttgaagaagccccagacttctacacctttatcctcacctctgatgactatagctttgcctcgcggcgggttaagcgccaagtcgccatcggtttaactcaaaactttcaactcggttatggtctcagcgaagccgatgctaagatttgcgctaattttcttatcgacggcaccttaaccctgttccggttgcgtattacgggtcaaattgagatgtcgtctgctgagttgaaacaaaaaatagtggccttaaatctcaccggacttcatggatttcttaaaagttagcgtctgtcatcagaataaacgatataggcattgttcttttttgaaaatgcgttaaaatggatgtaaactaacaagccatttaccagcaaaaaagctactaaaaggagcacacggttatgtatcgtttttttgttcaaccacaaattaatcaagataatcaccgagtctttggctatgaagtacttttacgcaaacaacagcatgattgctgggtattacctaaacacttcacagatatctctatcccagaacaaacgaaactattggagaaaaccgctaattcattgcatacagctgtcaaccatcaggttttagcgttcaacattgacaatcagcaactacgaaatccactgacactagggtcgattatcgctttaaaaaagcggattgccccagccgctctaaccattgagttgaccgaagcaccttcgcttgaagagataaaggccttcagtctcgcggtgcatcagtacggaattgatctcgttctcgatgatgtcggcactggatcaaacacttatcaaaatattcgcgacctgttgccattcgtcgatgaaatcaaattcgcgatgcaaaatctccggcaaaccggcgaagaagccctaatcccctcaagcctagctttctgggcccaggttgcccgtgattaccggctacgcttaattctcgaaggtgtcgaagatgaaaaagatcaagctttagccaagaaaaatcacattacactccatcaaggttacctttatggtaaacctagcttggtctaaatactcattcaaaaataagacaacgacagtggccgttgtcttatttttggatatttttttaacatttaaggttatgatatgatattaacagcagtcattaaataattgaattaatgtataactagtggactgattaacactgacacttacagattggaggacaactaaccatgacctggtcacactggttcgtggcgcccgcaattacgagtttctttttcttactgggagtcttaaccttatattggtttttaaccaatcggatcgtccgtctattacaaaaattcggttaccatcccgaccccgaagctgttcggaatatctttggcctcctctatatgattgtgatcatctttggcctccaactctcggttcgtgactcagctaacagttgggtctttagtaactttaaaattttcgcggtcgtctttgtcagttatttcttgttaatggatattcattggtgggagacgcttggtacgattctcatctacatgggtattaatgggacgctaggggtccctctctcctggatttatgccggtgtctacgtcgccttattttacgtcatgaaggccatgcgcacccgtaaacaagatcattggacagactatttccgcttcatcatcccatcactgatcttatcagcaattttgtgggcccttatcggctctcgctttcaccttacgacgactaatattctgtgggaaatgctattcatcttcctattgttaagtatgatgtacctctacgttgattcactcatgaccggcgccgcaactttagcccggttaacctataccaccaactttgacgaactgacacacgttaataactacttcgcttttaaaaatgatttcgaagaacaatttgcccacagtcgtacaaccgatcagccgctaacgctcatgttatttgatattgaccacttcaaacaggtaaatgatacctatgggcatctagccggtgactacgttctcagccacactgcccaattagtgaccaagcaacttggggaactcgatgacacccttcacctctatcgcactggtggcgaagaatttacgattctatttactggctataccactgaacaggcggctcccttagttcattctatcgcacagcgcgttcgcgaggcacacttctctcatgatggtcatcaaatttcgattagtatttcagctggggtgacccaacttcatactgacgatgaccagcgagtcgatatcttccatcgcgcagatcgtaacttataccactccaaacaaactggccgggatcgcgtcacgatccaataactaccaacgcattgcaccccctcgacaaattaactggcgagggggtgtttggtattgctcatcagtagctggttgcattccccattggtggcgtgtaggcttaaagtacttatctcgagggggaataacaacatggtatctgctctgaaacgattttggcaaagtccattaaccgcttattactttgcactaatcttactcatcatccttgcctggaacgcccgggccttcttatccttagcgctgttcacgatcatcttcatctatcttggtaatgcggctactatgggacttgaacatcggcttcacgttcaccatttaattgcgactttattagtgtatctgatctttttagggattctagtagctgcatttgcacaaatcatcccgccactggtcacggaagtttcccgactaccaaacacgctcaaggaactggtcactacctatccccaattagaaaccaccctgaccagatggattaaaaatctgactcaaaatgcctcagtgatcaacaacggtaaaaccttatttacaagtggcattgttaagttgtcccgctttagttctggtgtggaaaccgttattttggccttcttctttagctttattttcaatctcacgaagacccagttacgccacttcgttcatgcatttaccaaaagccgtttttcccgtttgtttgtccccatgggtgagctgattctgaaatttgtgactattttcggtacggttatcgaaacccaattgatgatctgttccatcaatacagtgttgatggtgattggcctttggttagtcggcatgccaagcctcttaattctcggaattatggttttctttctcggcttgattccggttgctggtgtgttaatctcgctcattccactgaccattatcgcctttatcagtggtggcattctgcgcttggctgcggtgttagttctcgtgattttaattcacttgtttgaatcttactttcttcatccccgtctcatgaccaatgcgactaacttgcctattttcgtgacctttattaccttaattgttagtgaaagactcttcggcgcttggggattaatcgtcggcgtgccactggttgccttcttcttagaagtcttcgacgtgcaactcaagccccatcgaccaacgaccatagagtcaaatcatcattgataacgttgccaatcaaaaaaggtgatcactgagtacagaccagtgaccaccttttttcaatagaaaatacctaaccagtagccgccaatgcccaatacaaaaatgcccgctaataaccacaacggtttgacatggcgccgcagcaaccacacacagcccaccgttaagacgaggggaatgagtcccggcagtaactgatccatcattgcttgcagcgataaggttgtccggtggctcgttgcaataattggggccaatctaacgtgggtccatcggggaatgatggcccccatcacaaacatccccacaattgaagctcccaacgtcaattgttgtaagaccccactactgaggctcgtcaccactttcaggccttgccgatatccccaacgctgcgcgccccatcgaaacccaagtcgcactaaattccaacctaagaagaaaaccagtgggccaacgataccgaacccactcagagctaaactagcggcaaaggcactcaggattggccgccaggtgccccaccaaaccggatcagccacaccggccagggaacccatcatcccaaccttaaccgcattgatgtcggtagcactcacaggttttccattcgctcgatcctcttctaaagataatgtcactcccgtaattaaggactgcatatagggcatggtattaaagagttctaggtgtcgctgagccgcagcccgcatttcagcctgatcagtcgcatagagccgtcgaattgccggaatcataatatagcagaagcccagattttgtaaccgcggataattccaagcagcctgttcccatccagagcggccaaaaatcaaaagctggtcacctaaggttaatgtttttggtgctcccgaatctgtcatgtttgctgtctccttacaagtcatctagttcacgatccaattcatcttcatccgtagaagttgggccggtgccaccaccatgcggatggtccaatcgtaagtaaataatggctaagccaattccaatcagccctaaggcgaccagactaaggtggctatccgtggccagggcaaatccaatgaagaaaaacggccacaattgccgcgttgccatcatattaatcacaacggcaaaactgacaatgaccaataaaccggcggtcactcgcaatccaccttgtagtaccgctggaattgcctgatagcctatttgcaaccactgcattgggaccatcattaatagggccgtcggtactaacacccgtagtccttgtaagaccacggcaccacgctgcagccagtcaatttgtcgtaaattaccattagcagctgccacatcagcttgccgaaccagtggtacgatcagttgacgtaatccgcgagtcagcccctgaccaatcagtgctaatgggatcgccacaatgactcccatggcgaccggcaaatgtgctgggccactcacccaccaagcagccaccacagcagccaatgctggatctggtgccaccgccgcaccaatgttcatccaccctaacgtgaccaactgaagtgaagctcccagcgcaatccccgttactaaattccccgttgccaatcccacaagggtacaggcaacaatgggctgatggaattcccattcgtcaatcaccccttcaactccggccaaaaaggcaataagtaatacaccccaaacattcactagctgcttgactcccttcatatcatcttaaatctgtttactcgcaaaaacaccccgctcgatgagagtaacccaccgagtgaggtattaagacaagccttttttagttgccaatgtcaagaaatcctgttgtcgatcggttggcaccgtctgtgtatagacaggtaccccggccgccaccaactgtcggaccgctgcaacgtcggctgcatcggccgacacactgttggtcaacatcgtttttcctgccgtatatggcagattacccacattaacccctgtagcggtcaaattaatgccagcggctgctagttgggccatctcagctaggctttcggttaagataatcggttgaaacccatcaaaccgactatcctgatagatttgggtcattttagccaccgatatcacgttagctttagcttcagcaggcgccgcttgggtaatcaagaccttacgtaactgatcctgcgcaaccgcatccgataccactaagatacgattaggtttaaccgtcttggtccagaccgtagcgacctgaccatgtaataagcggttatcaacccgcgctaatttaattgtcatggtcataataaatcgtcctctcctgcacctgcttgtaaatccaaatggcgaattccgccctgagccgctcgctcaagatggggaatcacttccgctaacgtttgattctgaatggacaatgcttcaattagcattggcaaattcagaccagccacgaggccatatttatctggctgttgggccaccacccgactcgcagcgttaaatggtgagccaccccacagatcaactaaaaacagcaactccgaaacgggttgcatatctgcgatggctgcttggtaatgatttgccaaatcctcaacactttcattagccgctaatgtcaccgcaacaaccttttgggcttttccaaaaatcatttctgcactttgcaaaattccacgggcaaattctccgtgacttgtgacgattatggcgagcattctgccacccctttattcgttccgctaaattagccgttttctgtaaatggcgtctgcatttaatatagcataaaaaagcgtttccatctaccactccggtatttttacaacagatcaagcatggcctgcggagtcgttaggctaacatctggcgtaaaatcccgtggtgttcgtccattccaagcggcaaagccaaaggtgacgcgagctgccgcggaggcctcagcgtcatacaccgtgtcgcctaaatagatggtgtcacttggttgggcggctaatcgctgcatcgccaataaaatcccgtcaggtgcgggcttaccatgcgcaatatcttcagcaaccactgcctggtcaaaatattggtccaatcctaagctgacaacatctcgatcatattcaaatcgacgcttagaggtcataatggccagttgggcccccgctgaccgtaattgctccaaggcaaccggaatcccatcataaatggcaaccgtatcccgataatcttgggttcgtgggccccattcggctaataccccctcaatatcggagacattcagacgaatcaacgcgtctttactaggaatgccaaaggtcgtggcgagttccgcataagatcgctcaatcccgcgttcatgtaagattgcttgtaacgatttcatatacatggcttccgtatctaataaggtgccatcaacatcaaaaataaacgtcttcatttggtcagcactcctcgttcattaaaaatttaagatcgtataaaagaaaaaggtctgacccgaaggccacaccttagtttatcatgctttattgcctaatgggaatctgctgacacagcttttttaggtaatgccggtgtcgccggctccccttcgaccacttccaccgaacgttgcaggttacgaagttgccgaaccgctcgaatccatgatggaatcaaaatcgcacaggaacctaaccaagccaacggttctgcggaaacagccccagcataaccaaatgctttaaccatgaccaaagcggcaaagacccgcatggttagttcaccaacaccggcaagcgtcggcaagacccgccgtcccagtccttgtagcgtattgcgaataatgaagagcacgctcaatagcaggtaagtactcccgataatattgaagtaggtctgggataattggataacatgttcgtctgccgttccaataatcaacgtcacaatgggtttcccaaagaagatcaccaaggctccggcaaagacggcaaagctaccagacagccagagagttttcttaaccccttccatgatccgcccatacttaccagcaccaaagttctgtgcggcaaaagtagccatggttaccccaaatgaggacattggtagagaacacaattgatcgaccttagaagcagccgtagaagcagccacagagtcggtccctaacgagttcagggcggcctgcatcaccatcgtcccaatcgcaatgatcgatagctgaaagcccatgggcatccctgttgaaaaatgctgccacaattcattagcactcactttgaaatcatcccgcgtaatgtgcagcaacggaattgagcgaatgatgtacaccacacacaacaaggaagcaaccacttgggaaatgaccgtcgcccaaccggcaccggcaacccccatgtgaaagactaaaataaataataactctaaaacaacgttaacaacggtcccaatgaccaaaaagattaatggcgttcgggaatcccccagtgcacgaataatattagataacaagttaaacgccatcgatgcaaagattccggcaaagatggtgctgataaagatccgcgcattggcaaaaatactagctggtgtctgcattaattttaaaatcgggtcaacaaatgttagtgacagaaccgtcaaaacaatcgtcatcaaaattgaaataatgatgctcgccgcaaaagattgccggacacccttataatctcgggcaccaaaccgtgtggccgtaataatcgctaaccccgccgtcaacccttgggcaaacccaataattaagaagttaattgaaccagtggcccccacagcggcaagcgccttaacaccaagggtttggccaaccaccactgtatcagagacattgtataactgttggaatagattaccaatcaacagtggaatcgtaaagaagaaaattagtttcagggaattacccttggtcaagtcgctcatgtgcggacctcctttgaattttttgtcaatcaaattgacgcaagaaaactatcataacgcctaaccagacgaatgtcagtctttttgcttgaagtctttgccattaagaaataatcttacacgcttcttaagattttttgaagacccatttgcgttgaaaacgattgcggcaagcaattgttatctgtttgtcatttaactcactggttgacaagtctccaatttaagaatttaatggacttatccactatttttttataaaagaggttactcatgactcaacccattacctttaataaatatattgccagtatttaccgccaatctaagcatgacttcaatgagcaaattgcagccctcgacttgcgagcaacgacaggcgacctgctcttatttgttgccgatcatcccggactcacacaacgggaaattgcccatcaaatggtactggaccccagtctggtcgctcgtgacttacgcgccttaaccactaaacaattggttgagcggacccccgatccacaagacggccgtgcccaacgcattaccctaacaccaactggctaccagcaggccgaccagattcgtcaagtgatgggcgcgtggtggcaggccttatttgcggcaaccccacaggctaatgctcaggtgactggtcaacaacttgcggccatttaccagaccctccaacagcgacaagaaaggaactgaaaactcacgacagcatttatctcttttttaaaacactatagttgtctcacatttggcctaatcctcatggccattgctgtggctctcgccaaacttgccagcttgggaacctcgccaatttctagcattcctaatgttgtaagtctcatgaccccactcacaattgggcaagtcacgattctcttcatgatcgtgctcatcttattagaagcggcctttctgcgccatgagttttccccttgggcctggttgcagctaattccttccgttattttcggtgtcttaattgatgcttttactcactggttaagctggctgccactacagcactacggggcccagctactagccaccttactcagtattgtcattctcgcttggggcgttttctttgaggttaattcgaaaacaatcgtgatggctggcgaaggcatagcaggtgccgttgccgtcgctacccaccgagaattcccccgagccaaggtctggtgtgatggcgcaatggttgttgtcgcgatcatcttggccttattcggccttcacgggctagtcggcgtccgggagggaaccatactatcggccttaatcactggccgactcgtcagcgcttatacccgatggtggccgcaattagtcacttggattcaagcttaatcctgccattcaaaccaaaagaatcagtccgctcagcacacttcccagccagactgattctttttgtcagttattaaaacaactccaagacccgctttagattctgttgtaaaatctggacgcccttgtcaaccggaaatgtgctggtattaaatagcgcaatgttcccgatacacatctcaaaataaaggcgtttgtttatctccaactggctagggtcagtcgtcacctgttcgatgtactgaccaaacatgtcccttaaatcattaagtgcggctcggacttgttggttctccccaaactcgacaattccggcaaccatgtcggcaaaactaattcccatctgtgtttgcgttaaaaataataccccaccgtgtaaaagtgccgtcttacccctagtggctaatcggattccttttgctaggggattaaaccctaagttaacctccgaacaattggatattcaaagtgtcatgagtagccaatactttgacgttgctggtatggtattatcgcagcaattaccggcactccttgaattgattgaccccgacaaattattatacgcatccgacacaccttacacaccaacaccagcagtgattggcttagcaaataaattggaaaccactgatttactatccccgtcccttaagaccaagatgtttcgtcaaaatgcccagcgattattcaagctgtaacttaacgcaagatttctaacgctagatatactaaaaggtacttggcagacactgactgtgttgttctaagtaccttttttgtgaggacgatctgcgccttgcgtcctcattcagtaaaataaaaagagtgagaatcaacgttttaccgctgatcctcactctttttcgttatagatgcggccaagaagattcgaacttccacccggattacccggacaagatccttaatcttgcgcgtctgccaattccgccatggccgcattaactcacaagaaatagtataccaaatgattttcatcctgacaatattttttgtaagttaattcaaaataattggttatttagtcgttaaccgcttaggccaacgtctaagcgtccgtcaaaaccgtagcaccatcagggtccaaatccaagatacgcagactaccggccaaatcaagcttcgccagttttgtccgcaatagcgtcacttgcgccgatgtaccaaaggtcacaactgttggaccagccccacttaggtacgttcctgtgatccccaactcatgggctgcatcccggatttgtttcaattcaggcaccaactgtgaacgcgcttgttcgtgaaattcatcgcgttcaatcattttcgctgctaattcccaatccttggtcagcaatgccgccactaagacattcgccacaccactggcatgaaccgctgtcgcaaatggcaagtcctttggcaaagcctcacgactcttgcgtgctagtaacttttggcctgggataaagactaaaacccgcagctcaggcaagggtaacttgattgccgtagcctcatcttcatttaccgtggcgaccgccgcctgtcccaacaacgctggtgcgacattatccaactcaccgcccaatttaacggcccagtttaactgttccggaattgttaagtccatttcacccaactcattggcaatcttaatcccagcgataatggcactcgttgaactacctaatccgcgagataccggaatatccgacataactgtcaattgatggggcgtcaacttggggttaacctgtaaggccgtcttgaccatcaagttgttttcatcccgaggaatttctgtccctaaggcatgattaacccgccacttttctgtcttttcttcaataatcaccgtcaagtataaatgtaacgctgctccaattgaatcaataccaggaccgaggtttgccgctgtcgctggtacccgaataattgtctttcccatgattttgacctccttatgcatgcggccgagtcgttgctaagatggtttgccgccactttagtcgtccccgacaccgaccacacacgagcttattcacattaatttttcgcgcccggtaatagacctgctgacaccgggtacactgatacatttgccaatggcggggcttgatgaccggggccggtgctggtgcaaatcgtaaaccgccgacttgctttaatagctgtttgaaggccgccgtgcgatgttgtcccgactgcccggctaaatgtaaatggtagtgacacaattcatgcttaatcacgccaattagcgtagctaaatcatgctcagttaacattttgggattcaattcaatgttgtgatcggtcagtcggtatcgcccacccgtcgtccgcagtcgtgcgttaaacgtggcttggtggcgaaacggacgaccaaagctgacttgagaaatgtgctcgaccagccgctgaagttctgcatcagtcacgagcagcctgcttcatcgtcaactgaatgcgttggcgattctcatcaacactcaacacccaaactgtcaccacatcaccaattgtgactaccgtgctaggatcactgacgtagtgatcagctaactgggaaatgtggaccaagccatcctgcttaaccccaatatccacaaacgcaccaaaatcaacgacgttccggacggtgccttgcaattccattcccggttgcaagtcggccatcgtcaacacatcctgccgtaacagcggggctggcatactatcccgtaagtcacgaccgggtttgcttaacccggtcacaatatccgccaaggttgctggtccaatccccaactggttcgcccactgttgctgattgagtttggctaattgctgttgcaattgcggggtgccaacgctcgtggttgtgaggttcaacccggttaatagctgacgggcggctgaataactttccggatggatatccgtgttatccagcgggtcactgccctcaataattcgtaagaagcccaccgcttgttggtaagctttcggccctaaacgcggcacctgttgcagggcctgccgactgttaaaggcgccatgatcgttacggtaagcgacaatgttcttagcagtcgtcgttgttaggcccgaaatatgggtgagcaattcgggacttgccgtattaacattaaccccaacttggttaaccgccgtttcaacgactcgatcaagttgttcatccaacgcttttttgggaacgtcgtgttggtactgcccgaccccgacagctttcggatcaatcttaattaattcagctaaaggatcttgcaaccgtcgaccaatactgaccgctgaccgctcttcaacgtgaaaatcagcaaattcagcccgcgcattggcactagccgagtatactgaggcaccggcttcattgaccaacacataatacactggtcggttcaatgtcttcagtatttgactcacaaattcttcggattcacgactagcagtcccattaccaatggcaatcatttcaacgtgatagtcctcaagcaattttttaaatgctggtgttgccgccgcccgtttcttagcatcggctggcttatgtggataaatgacttgtttagctaagaagcgaccattagcatccataattgctagcttacaaccggttcgatacgccggatcaaaccccatcacaattttccctttgaggggtgcctgcatcaacaagtgatacaggttattgccaaacacttgaatggcatgttcatcggcctgatccgttaattgtcggcgtaattcccgttcaattgccgggcctaaaaagcgcttataagcatccgcaaatgccgctgtgactttttccacagccggtccacgatgctgacccactaaccgaaagtgaccatattgcagaatggacgtcgcatcaacattaattcccacagataggatcttttctcgttcaccccgattaatcgctaacacccgatacggcggcacctgctttaagctctgcgtaaattcatagtacgtcgcgtaaacttgttgttcatcctccgtagcggccccgcgcttaagcttactggttaactctccatgctgccacgtataacgtcgaatccattcacgaaaggcagcctgttcactaaatgtttctgccaagatttcgtggacaccagcccagacactcgccacatcaggcaatcccttatctgcggccactagagcagctgcccgttcatctaagccacccgttgggaacgttaataaccaattagccagcggtgccaacccggcttcccgagcaatcgttgctttggtgcgccgcttttgcttgtatggcaaataaagatcttccacctgttgtagcacagttgcgtgcatcaagttttctttgagtgccggcgttaatttaccttgctctgcaatcagctttaacacatcgtcgcgccgttgattcaatttggtcagccgatgggcttcgtcttcaatatcgcgaatggcgacttcatccagcgatcccgtccgttcttttcggtaccgcgcgataaatggcaccgtattgccttcatccaatagggtcaagacggcttgaatctgccgcacacgatattggctcaacgtttgatgaattggctgagctaattcacttaaagctgtttcttgtttcgttgccatgcaacccctccgttatttcttcatactcgcattataccatgttctgggaacctaacccgctttggtcgttaggcgttatcgtttcggttgccaaatgggcaccttgcaaacccacaagtctcgaagctcaacctcttcgtaaatcgtgtccggtacgttccagcccatttgccgcgaccagagggcgggcaatcacgcctaaaagtagttgacataggtgcactaaactagcacggccagaaggccagcaattctaataccaaaaaagcccgagatagcctcgggctttttaacagcttacattgggctggtcataatccgttgcgttgccgcggtaaccttttccatcgcattttcttgcgtagcttcagctgcgtcaaaggcagcttgatcagctgtttgatgttcaacatcaatgctatcagtcattgcctgacaagcctccacgtaagtccgataagcagctactaaggacttgtgcttgcccaatacacggacgggcacactagtctgttccaatttatttaaattagcttcataaccatcagtcccccgttggaagttatcaacgatcttttgcagctcaacttgcgataattcaccaactgtttggtggtcaatcgccccacgcatcgtttcgaagtcggtattcatttcgccagcggcatcttcagtgccttgtaaaacgcgcgatagtgcttgaatataaccattcatatcattttttcgcatcagttaattccccgtctgctattcttgccaaaacgtgtcataaacatttaccggcaaatgccgcttatgagcggtcttggcgtaccagtcttcaattcgactcgccgctgcctcgctaacagaccgcccttccaaatagtcgtcgatatcctcatagcgaacgcccaaggcagcctcgtcaggtaatgctggtcggtcatcctccaaatcagccgtcggtaccttcttgtataggtgctctggagcacctagttgggccagcatcgcagctccttgacgcttatccaaccgccaaatcggacaaatatcggtcgccccatcgccatacttggtgtaaaatcccgtcacagcctccgcggcatggtctgtacccacgaccgcaccggaccgagcaccggcaatggcatactgggcaatcatccgttgacgcgctttaacattgcctttgttaaaatcactaatcggcttaccacttgcttcaaccgcctgaatcatcgcgtcagtcgccggcttaatattaactcgctggacctcatcggcatccatgaagtcaatcgccatcatggcatcatcctcatcggcctgttcgccatagggtaagcgaaccgcgataaatcgatagtcattatcgccggtctcctggcgtaattccgtcacagcttgttcgcaaagcaggccggttaaggttgaatcttgcccaccagaaattcctagcaccaacgttttcataaagtcatatcgttgcaaataagccttcaaaaaatcaacactccggcgaatctccgttgccggatcaatcgttggcttaaccttcaaggcatcaataatttctcgttgttttgcccgcatttcagacaacccccttcactcatttacctatttattcaggcattttttgaacgtaactatgaatctctttgataatcgccattttatgatcccaacagtcttgtgacaagtcgaccggatacttttgaggattcaagtctcgcttgtattctggccatagattggctagggcaccacgacaccgatcccgaaccgctgatagtgttggtaacttatacaccaattcaccatcttcaaaaattggttgtaaaatgggacgcgcgttgaagtcgttaacggtcttattgatatacgtgaagctggggtggaacatgaagagagagtcttcattccgtggatcttcgtcaatcaaagccacataatccccctcagtcttgccatcggccttcttcgtaatccgccaaacctgttttttaccgggtgttgtgaccttttcagcgttattggatagcttaatcgttccttgcatctgcccggcatcattttcaatggccaccatcttataaacggcacctaaagctggttgatcaaaggcggtgatcaacttggttccaattccccaaacgtcaatcttagcgtcctgcatcttcaagctttgaattgttttttcatctagatcattagatgcaaaaattttagcattagggaagcctgcttcatccagcttttgacgcacccgtttagacaagtaggccatatcgccggaatcaatccgcaccccttggaaattaattcgatcacccagttcttgggccaccttgatggcattgggcacgccgctacgcaatgtatcataggtatccactaaaaagacacagtcatgatgggtctgcgcataagccatgaaggcatcataatcattgccgtaagtctgaaccaacgcatgggcatgcgtgccactaatcggaatcccaaaaatctttccagcgcgcacatttgaagttgcatcaaagccaccaatgtaagcggcccgggtgccccaaatagccgcatcaaattcttgggcgcgtcgtgtcccaaattccataagggcgtcatccccggctaccgaacgaatccgagcggctttagtggcaattaaagtttggtagttaataatattcaaaatagccgtttcgactaattggcagtcggccagcggtccttcaacctgcagcagcggttcatgggcatacaccaactcgccttcaaccgcagaccgaatggacccgcgaaatttaaaattagctaagtaatctaaaaattcagctgaataatcttcagcttcccgtaagtaatcaatatctgtttgggaaaaatggagattttggatataatgaacaatgtgctctaagccagcaaacaccgcgtacccattttgaaagggcatatcgcgaaagaacacttcaaaaacagcgtgtttgtcggcaattccttgttcgtaatacgtctgaatcatgttgatctgataggcatccgtatgcagagtataactgtcgtcaggatacaaattcgtcataataagctactcccttagctggttttcaagccggactcttctcttttagttctcgtactaatagccctattttagcatgaaacaaacagagcgtcataaaatttaatgtggatccgatgacttaggtcattggcgaatcaatccttgaaaggagtcacctcatgcaatcgacctttccaaccgtcaccgttttagatattccctttgtgaagacaactgcggcggaatttctcaccgaagtacagcaccggattatccagcaacaaaacacctttgtcgttactgccaatccagaaattgtgatgtacggtcacgatcatcccgactaccaacaattactactcacggccgattttattaccccagatggcattggtatcttaaatggggctcaaatcctcaaccaaccgctcccagaacgaattaccggttttgataccttacaagctcttctgaaatggggcagcgaccaacatcggtccgcctattttctaggggccaagcccacggtaattgcgcaattaaaagaagtgcttgcccgcgattaccccggcttacaggttgtgggccttcacgacggttactttaaagacgccacaccgattgtcgccgatattcaggcgcaacaaccagacatggtcttcgcagctctaggctttcctaaacaggaacaattcattgccgaccatcgtcacgtgactcacggtttgtggatgggcgtcggtggtagcttcgatgttctggctggtgtcgttgtgcgtgcaccaaaattctggcaagaccatcacatcgagtggctataccgaacattgaaagagcccaagcgtctcaaacgaatcgccgttattccccattatctccgcttggttcgtcagcaagccaaacaaaagccgtctcgttaagcggtccctggggcatcgtcaccgttgtcggtcgaaacccgacgtgccaataaaattgttgagccgcctgattatccgtcaacacccacaagacgactcggttaaaaccgttggcacgtaaggtacccaaggctgcatgcattaagcgctgcccgattccctgacgctgctgtgtcggcaacaagtaaatggaattgatttcgccgtaactcgcaaatcgttgtcgcctggaagggccgtatgaacagacaccgacaaactgatcctgctcattcacagccacgaacaggtgctgccaatgctgttccgggtgccattgagcaacggttaattggttcaaaaagcctgctggtaacatgtcttggtaactcgtctgccacgcagttagatagagttgtgcgagtgccgaaaaatcatcatcggcccgcgctggtctgatcgtgatcatcgcttcacctgcttttacacaaagtgcctcacaatcgcgttaatttaacgcttgtgaggcacttttatttatttttccaaataaaactcaaatcgttcgccaacgtattgggtccgcacatattcaaacggcgttccgtcttgtaggtacgtgacctgacggagccgtaaaatagcgtcgccccgtttaatactcaggtattccgcaatgcgttcggaagcagacatcgctgaaaccgtttgttgggccttccctggactcaattgctttttatcttccaaggctcggtacaaagaactcgtcacttcttttttactcaacccatcgactagcttctctggcacagttgccacttcaaaacagattggcacatcatcaccataacgaattcgttccatccgcaagacttgatcgtcttcatttagtttcagcttttccgcttcactcagcgaaggattcatcacatggtaggaaatggtcttactggttggttgcttcccttgggtcagcatcaaatccgtaaaactggtcacaccggacatcttttcttgaaccttttgattcgcaacgtaggttccagaaccaacctggcgctccaaaataccttcatccactaaggtttgaatggcttgccgtaacgtcatccgactcacatcaaaattccgcgacagctcccgttcagatggaattcggtcgcccactgcccactttccggcttcaattgcccgtttaatgtcattatgaatttgaatataaatcggtgaactcacagcaaccaacgtcccttctaaaatcacactttaaattacttaattaaattttgcatattacgtcccaaactataagtcgttttgacgtttaagctccggtctaacagattcaaatcagcatcccgaccaggaactaacttgcccttttgggtcaacccaaattcagctgcctgattaacggaactcatttgaaccgcttccgctaccgagcagcccgtgaaggccatgacattgcgaaaggcttcatcataacgcagaacagaaccggctaaattgccactttctaggcgggcctgtcgatccttaacaatgaccttttgaccacccaattcactgaccccttcaggcatccctttagctcgcatcgaatcggtcactaactctaggcgttgcgcacccttttgctcataagcgagtttaatcatatctggcacaatatggaacccgtcacagataatttcgcagtatagattatcttccagcatcgcgtggccggtcacccctggttcacggtgccgcagcccccgttgcgcattatagaggtgggttacatgagtcgcccgactcgctaataattgttcacgcgttgcgtttgaatgtcccactgagggcacaattccattagctaaacagtagctttcaaatttctcggcgccagcatcttctggcgcataagtaatgagcttaactcgattacccgataacttgttccaacggtctagcaaagtcacgtctggatccttaatgtacttttctggttgtgcgcccttgaaaatagccgcaataaatggtccctctaggtggacaccctgaattaacggattccgctcagctgcaatagcaatgccctgcatggcatggtcaatggcgtcgttagattgggtcatcgtcgttggaaatacggacgtaatcccctctaaggacatcagattaaccatcttatcaatttgatcggggtccccatccatactatcatacccgtagcccccatggctatgaacatcaataaagccaggaacaatgacttgcccggttaccacgtgaatctcatcagcaggaagtggccgaaaatcagccactgggccaacggcttctacctgttgatcaaaccgaatataaccatcgtcaattacggtttcacccgtataaatctgcgcgtgctttaaaacaatactcatgagtctcctcctcaatatttaccagaagtggtcaatacactcattataatcggtatagaccagaaagacaactcatgttattcttttaggctggatcgccggcatcacgcttaatggtcgcatcaatgcccttaacaacggccgtcatcaaccccgcttcttccatcgctagcaatcccgcaacggtactgcctccgggtgaagcgacttgatcaatcaaggcaaacggaattttgtcactttccaaaaccattttggcggaccccaaagtggcttgtgctgcaatttgggtagcctgtgccttgtttaaaccgtgcttgacacctgctcggctgagactatcaataaagaagtcgatgtatgccggtgaactccctgctaaggcactaaagacaccaaattggtcttctgccaaagtcgtcgttgacccaattgtattgaacacccgtaaagcagcatctaaatcagtaccggtcaagcgaacatttgctgccacagcggtcattccggcccccacttcaacgttaacatttgggagtgtccgtaaaatcggaacgttatctcccaaaatgtcagccatttcagctaaagataatccagccacaatggaaatcactgtggtctgcccatcagcgacttgcggcttgatttcttgtaacacactcgccgcaacgttcggtgtcactgcaaccacgactaagtcgctttgaccaacaacatcgctattttgttccgccgtctgtaatccatgagcttgggcgtaggattcgtagctttctttacgatgactgtgcaccacaatttccgttggcgcaaacgtcttagcctgcaataagccaccaataatggcttgagccatcccgccaacgccaataaatccaatcttcatgccgcttcctccttgatcaataaacattctatcgctaactaaggtcctcataactggtctagcaatgatgaacctaataaactaacgagatcgctagtaaagacacaaatggtctggagcaattgttagtttgactttagcgaaaattgtcgaaattgtcaatttttaatggcttgcgggtggaaaaaagcgcataaaaaaaccagtcacacaccgtgactggttcttagttgggctagctgggttcgaaccagcgcatcacgggatcaaaacccgttgccttaccacttggctatagcccaataataaaatggtggggagtggattcgaaccaccgaacccgaaggagcggatttacagtccgccgcgtttagccagacttcgctaccccaccaaaagatgaatcgtcgtaacgaatcaacttcactatcatacaaaaatatgcataaaccgtcaagcactttttgcgacttttttcattttagcgtcaaaaagtgtaatcgttgccgccattcggtcataaaatccgtctgggtccactcattaatgcggcggttataataacccactgactgattataatacgtggtattgccaaaagtctgcggcctaaaatgccgatggacgtgaccgaactggaccaccggaacgtgatagctttctaataagcgtcccaagcgggggctccccagcatggcattggccatattccaaaatcggtcatccgttgtatagcggatatacgcttgccgtggcacaaaatgtgtcatgaataagacccgcttgtgaaccaattgcgcctgttggagttgtaccgttacttgggctaatacccgatccatacgggcaacatcgccctgtggctgatcgatactgccatccacccaaaaggcccgtttccacgtcgcaaaatcacggccccacagattgtgggcaaattgatagtcataccagccgttattgccgattatttgccagttagtccccgccacatctaaatacccacgatgcaagtaagtgggcgctagcggcgattctaggcccgcatacgtgacatcatgaagcatatcatggttgccagcaataaatcgaacctgggctggtgcaattagccgctgcagttgctcgactgccgccaacgattgggcaaaatggttggttaaatcaccagcgattaaatacacaccaacccgctgcgcaattaaataagctgccatctgcggtaagatcttagcggtatcttgctgattcacatcgaagtgaagatcactggttaaagctactcgaacgataggcccatctcctcgattaaaaaagtgctactccgataatagagtagcacttttagcagtgaattaaacttatttaattccagccattaaattcttaattggtttaactagggcaaccataataataccagcgacaatggcaacaatcgcgacgcctaagaagtaattagcttcatttcctggtgtatatagcttaacaatctgagcgttaacggcttgcccagcagaatctgctaagaaccacatactcatcatttgtgattggaaagcctttggtgctaacttagtcgttaccgacaatccaattggcgaaatcagcaattcggcaatttcaataactgcccagctaccgactaaccataaaggactaactttagcgctagaaccgaataaggcgactggaatcaccataattaagtatgaagcaccggcaaacaacatcccagtagcgaacttcgctggtgaacttggttgcttcttcccccaacggttccacatcatcgcaaagaatggtgtatagagcaagatgaacagtgggttcagtgattgataccatgcaggtggaatgtggaaacctaacaccatattattggtttgattagcagcaaataaggctagaacagatgagccttgttcttcaattgcccagaaaatcattgcggcgataaacaatcccaagtaagcccacacgtgtttgcgttccgtggccgtaacctttttgctcgttaagaaaattgtaaagtagattacgggagttgccaacgcaatgatggtcaataagagcacgaagttggttaagttcaatgaacccaagagagccatcaacaacaagactaagacaaaggccactaatccaattgtgctccgaacgactaacttcttcatgtcgcctggttccaatggatcggttggataaaggctatctttgctcaagtacttcttaccaccaatccagtattggactagccctaagaacatcccaatagcagctaaggagaaccctaagtgaaagttataacttaaccctaaccagccaactaagtaaggggcaactaaagaaccaacattaatcccgaacacaaagatggtaaacccggaatcacgacgcgtgtcgccttcgttatataggccaccaaccatttcagaaacatttggcttcaataacccagtacctaacacaattaataggatcgagacaaacaaagccattttaccagcgggaactgacaaggcaatatgcccaaacatgatgagcaccccaccaataaacacagtccgccgactcccccagacacggtcactcaagtaaccacctaagacagaggataggtaaaccatagatccgtaaatcgacattacagatgctgccgttccttgatcaaacccaagaccacccttagtaactgagtagtacatgtagtagattaagatagctcgcatgccgtagtaactgaaccgttcccacatttctgtgaagaacagggttgataacccacgcggttgaccgaagaaagttcggtcttcgctggttgcttccggtttgttattcaaaacgataatacctccattgcatttctgaaaatgaataattttattttctgcaccatccatcgttaaaatcgatggcgccggtgtctcatagacctctaataaaacatagtagttattatactgcacgaagtcctgttacgcaacggttttcctgataaaaacgtcttcattgaccgtaaaatcaacaaaaaacaatgatgaaattattagtcatctcatgcaatcctcttattttttattcattcggctagttaccgagttaatgaataaaaatcaataaaaaagccgatttgtgaatgctcacaaatcggctttcaaatttgcatagatgcccttaaacggctgctactggtaataattgcaatttctcacaagcaaactttaccaatgcctgaccgttcaaccaaccgtaaatatcattagggatcgtcatcgtcggaacttgtgccttaagcgtcgtcacttcagcttggttgactgctcgtggcgctagcaatacaagatcctgctctgctaacatatccggtgttaaatcctgaatactggcagcactgaaattaagtggcatgtgccgagtttcagcagtccgcttagcttcgcctaaaaacaagtgacttgagttttcatttccagatagtaatagaacatttttcatgatcgatttctcccttttcgttcttcattcgatagatatagaatagcactttaagtcatagaccacaatactaattttgaatttatcaatattattttacgcgccttttatgccgccatataggcattctaaggactataccattttttataatcaagctataccaattagatagcttcgtgaaagcgcttttataactagacacaaaaaaatcaccagccaaatgactgatgattatctgatgccggctgaggaattcgaatccccgaccctcggtttacgataccgatgctctaccagctgagctaagccggcatataccctccggttaacctggttaacccgaaagttatcagaagcaagcgctccgtgacaactcttaaagtatatcatgtcgtctaaatcatgtcaacatctttttaaagcttttgaatatatatccaaccggttggctgagatattcagatgcttgatgcctttcgacaacataaatcattgtatcagttgctatttgacgcgtcaagcattattttcaaattgtatgactattcagcaatctgttttttatgcatttctgtcgttcacagcaacagataatatcttaccaagcatcccgtcttaggtcaaggatatttacaaaataaatcaaaaaaaataggacataactgtcctacccttaatttcgatatcgtcgaaccggctgatgttgtatcgtcgccgtcatccgctccaaaaatttgaccaacagatcatgcatcacagcttcttcagttgcatccgtaatagcgaccttagttcgagccgtatgcggaattcccttcaagtaataagcaacctgattgcgaaaatcccatggtccttctactggtcccttggcaacacacaacttgtgcaagtgttccaatgcaatcgtgattttttcttgtggtgttggttctgccagcaattcatcagttgccaggtaatgattgatccgttgcaacagccatgggttccccataaccgctcgtccaatcataaccgcatctgcgccaacctcattcaacatccgttgcgcatcttgtggcgtccgcacatcaccattccccatgaaaggaatggtgagatgctgggcaacctccgctaaaatctgccaatctgcttgtccttgatacatttgcttccgcgttcgaccatgcatagccaccgcagcagccccagcccgctgcgccgccaaagcattatcaaccgcaaaaatatgatggtcgtcccaaccggttcgcatcttaactgtcaccggcttttttactgccgcaacaaccgctgccaccatatcgtgaaccttttgtgaatccagtagccatttggcacccgcatccgtattaattactttgttcaccggacatcccatattgatgtcaataatatccgctgccgtctgttgatcaacaaattgagcagcctgtaccaaagtttcctgggtgccaccaaagatctgaatactcatcggatgttcttgcgcattcacagccatcattcgtaacgttcgttgattatgataatgaattccttgcccagaaatcatttcacattcaactaacccggcaccgaacgctttacagatcatccgaaaggccacgttcgttacccccgccatgggggcaaccaccactcgattgggaatcgtaacatcgccaatctgccaacttgtgccttccatactacttagcctgcgcttccgttaaaatggcccgtaagtcatcttccgaaaattgatactttgtcccacaaaaatgacaaactgcttcggcaccgtgatcttcatcaatcatttcctgtaacgctgctggttgaatggaagccaacgactgggcaaaccggtccttagaacaatcacacttaaagcccacaggcattttttggacaatcttgatcttttcttctttaaatagaagtgccaaaatttcttccggtgtctgtccagccagtaatagttctgagaccattggcatctctttaatccgctgttctaaccgcgcaattgcttcatcggaagcaccaggcattacctgtatcaagaatccaccagcaaccttaactgtattattaggctgtacgaacacggatactcccactgcactgggaatttgttccgacttagccaaatagtaagtaaagtcttcacctaattcaccggacaccaatggcacttgcccagtatatggctggcccaggccttgatccttggtaactgtcagcataccgttaaccccaaccgcctttttaacatcaatcttgtgcttttcattaagcggcaggctagtatgtggatactgtaaatatcccttaaccgtcccgttagcattgccatcgacaacaatggcccccactggtccatgtccattcactttaacagttagcttttcatccccctttagcaaggaagttgaaagtaacatcgttccaatcagagttcgacccagggccgccgtggcggcactccaagtatcatgccgctgttgcgcttcagcgactgtttccgtggcgtcaaccacgtatgcgcgaaacataccaccgtcaattaaactttttactaaataatctgccattcctgtaaacgtcctttcgtttcttttcatcatgccttaccttaccagaatccacaccatttgcaaacacaaaagggaccggaaatattccggtccccttcaacgcaatcaactattcagaatggtcagactcatgatcatccgctgctgaactaacggctgaatcagctgagctggattcattggccgcagaagaagctaatttagcttccgtagacgcctgacgttctgcttcccgacgttctaattcacgcttggattcttcaaaagttgctgccttttcacttggaaattcgctgtcgccagacttttcaggcatcttcccagtattaaacaagctgagaatttgcttttcatccaacgtttcgtatttcagcaaggcttctgcaataatcttgtgttcttccttgtgttcttccaaaatcttccgagcagtcgcatgggcttcttcgatgattcggcgaacttcgctatcaattaagttagctgtttgttccgagtaagctggttggttggtatagcccgcaccaacaaatggttgaccgctgccactttccagtgccaccgttcccactgctttactcatcccatactgcgtaaccatggaacgtgcaatttgcgttgcttgctcaaagtcatttgaggcaccagacgattccgaattgaagatcaactcttcagccgttcgtccacccattaacccagcaatttgttccatagcatccttcttggacatcagcatttggtcttcacgcggtaacatgatcgcgtagccgccagcgcggccccgtggaacaatggttaccttgtggacaacccgggcgtcgttcaagactaagccgacaattgtatgcccggcttcgtggtaagccaccgtcttgcgttcttgcggactgactacccgatcctttttggctggtccggcaatcacccgatcttctgcttcatctaaatcagaagcatcaatttgggtcttgttccggcgagccgccaatagagctgcttcgttcaataagttttccaagtcagccccaacaaaaccaggcgtttgcttagaaatttctttcaagtcaacatcattagctaatggcttattcttagcgtggaccttcaagatcgcttcacgacccttaacgtccggacggccaaccagaatcttccggtcaaaccgacctggccgcaacaaagctgggtccaaaacatctgaacggttagttgccgccattacgatgacaccttcactaccagtgaaaccatccatttcaaccaataactggttcaaagtctgttcacgttcatcgtggccaccgcccatgccggcgccccgttgacgaccaactgcatcaatttcatcaataaagatgattgatggtgcagcttttttggcctgttcaaagagatcccgtacacggctagccccgacaccgacaaacatttctacgaagtctgaaccagaaattgagaagaatggcacagctgcttcaccagcaacggccttagccagtaatgttttaccagttcctggcgggccctccagaagcaccccagatggaatccgggcacccaaagagacaaacttacgtggattcttcaagaactcgaccacttcgaccagttcttgtttttcctcttcctcaccagcaacatcagagaagcgaaccttattctccttactatcagctggcttagctttgctcttcccaaagttcataacgcgcccattgccgccaccttggccggcttggcccatcatcatgtagaagaagaaaaagatgagtagtggtgctacatagactaacagattaatccagaagccactagattcttccgccttggtattgacctttacattatgattcttagcggccttatcaatcgctgaaaccgtcgagttattcgtcaagacttgcgtactaaagcttgttaccgccgtactttgcgaaccgccaagactaaaaccggtattggttgcccgcttttgtgcattgcggtactcaccggtaattttgtaaacgcctccggatggttgaatggagaagttcttgatcttattcgcattcaagtctttcacgaactgactcgattggatttcttgggattgtgagcttgtgttattaccattgaataggtataccacaccaatgaccaataagaagatcacaatataaaacaggctgttacgaaacagaccgtttcgtcgattattcatgtcgtgcctccttacccacagttcccagccttaagtctaggaacgaaattaagagcttgtgctcttttactaaataagatgttatcacaattgactatcattgactaattatttatctgaataaactgacggcttcaagacaccgacgtaaggaagatttcgatacttttcctcgtagtccaaaccataaccaaccacaaattcgctaggaacattaaacccaacgtaatccgctttggcttccacgacccgaccacttggcttgtccattaacgtgcagaccttaatcgacttcgcttgacgatccttcaacaagtcttccaagtatttcagtgtccgaccagtatcgatgatatcttccaccaagacaacgtcgcggccagcaacatccgtatctaaatccttcagtagacgaatcgtcccagatgattcggtcccaccattataactagatacatcaataaaatcgatggtggcgtagatatccatgtcacgaatcacatcggtcatgaataggatagccccctttaaaacacaaaccatcagtggggtcttatcccggtaatcctcggccaattgttgacctaaccgtttgcacgcggcagcaatatcttcttcactatataggaccttttcaatatcgttattcatactgttcccctttcgtctattcagctttcaacccaatatgatagtttttggtatgtgagcgcggtggccgtaccgcccactttacacccaatacagccaaaacagttccctgggccgttaccaacacttgttgttgggcccgctgttcacgcggaatcttcgcattaattagtgcccgacgaactggttgatggtgaccagttcgcagccgcaagcgatcacccgcctgccactcgcgaaccattaacggaaagtctgctgtcgtcaaagcaattgtttcatgcgttatcattttcgctgtatctgttgtaaagcagccaagttggcgaccgtgtccaattgattgccattggtctaagtctaccataaatctaaaatgttccacggatttttcatcgttttttttcggttgccagaagcgaaagtgcgtatagcttttggtcagttgccacccctcactaaaaacgacgctaccagtgggatgttgcccgtttgccagtaattgcaaacactgatcaatctgcggatatcccgccgaaatagttggcgcctgctgtttgatcaatcgggttagcagtaaccgttgttcagcaatcgagtgacgtaacaatcccgccacattatcagaccttgtcatgattgtttgtaactgttgatctaaagcttgatcactgatcattaacgttgcttgcagttgctgggcatacgtcatcacatgttcaaccacctgaggattctcttgtttcaacaacggaatgagctgatgccgaactcgattacgactcgctatcaactcttgattagtggcatcctcgtaccacggcacttgttgctcacgagcgtaggctttgagtcgttctttagtgaaggggagcaagggccgaataactcggccaccagctaaaggccggctggccgccataccggttaattgtgccagctgaccaccccgaatgagctttaataggattgtttcaacctgctcatcggcctgatgagccgttgccacccaatccgccttttgttggtgtaactgctgggcgaaaaagtcatagcgaaatgcccgcgcagcagcttccacaccatggcttggatgttggtcaatcggccatttggttgtcaccagcgatatctgatgggcggcacaccatttttttaaaaaggcggcttccgtttggctctgctgtcgcaattgatgattcacatgcacgactgtcagcttcggccgcatggtcaccggtaatgtcatgagcaactgcagcagcaccatcgaatcaaccccagtagacaccgccactagcccgtgttgttgtggatcggcccatccctgtgcctgccaatttcgttgaaaatcactttttagcgtcacttgttcctgcccccaacaattcaaccattaagaaaaagggccgcacgaatgcggtccctatcaaagacaattagctacgccgaccgccacggccgccacgtttgccctcagtgttacgtttaattgttgccagtcgatcctcactttgtttcaagaaccctgacatcatatcgtcaaaattttcttcatgtttaaccgcatgatgaccggaaaaccgaccattggctgagctatgatgtggccgcggtccattattctcgaaacgccgaccgccatggtcaccgccgcgatttcccccattgctatgatggtcatgatcgccaccgtgggcgccctcatgatgatcattatgcgcatggtgcggccgttctgatgccggatgatccgtagctttacgaatcgataacccaatcttaccatcatcgccaacagtcaagactttgactgtcacctcatcaccaacagataagacgtcatgaatatcctttacatacccgtcagaaatttcactaatgtgcaccagcccggtcttgtggtcacctaaatcaacaaatgcaccaaagttcgtaattccggagacctttccggtaactttagctccaacctcaattgccataaacaagaagttcctccttaaaataagtggttttagtataacacaattttaaccaatcccaaacgccaaaacacaaaaagcctctcataaattctggttttcacacccctagtaaagcccgttaaattaactttctagccaactcccctaatgttacggcttttcattaagtctattaagaatccacagcgctttcagaaaagtctcgcctatttagacaaataaaaaaaatcgaaacctaacgtttcgattttccaatcactattttgcagtgacatcactcgcatggtccccaggtaaactatagatagtctcccccgacttcgagtaataatacttcgagcggattagctgagcgacgtaatcctgattattcaattgtttaactttaagatccagctgggtattttctgccttggtcttcgtcaattgacgttcactcgtggccacttgctgattgaccttgtgcaagctggcattggtccgaatgagttggatgcctagaattaaagcaaacacagcaaataccaacccgatacgcaaagcccgacgcatccgtcgacgacccaaccatcgcgtgtggtgctggactgcctgctgatgatccagttgtcgggtatagtcattttcaagccgttttactttagccagttgtactttttcatcagccatcccactcactcctcaaatttaaccagatagtttaacttgagtatagcaagtttcaatttccccgtctagctagttaagcagattgtaaaatactcgtcacattatgcggttattcttggcggaaatcttgggcgtattcttccttgacgatggtgtacatccgttcagcatcgtctttcttagtcgtctccaataattcatccacagtaatggttaacgttttattaccaaacttgatcaccagttcatctcgtggtgccacttccgttgaagacttggctaccttaccgttaatctcaattcggcccttgtccgcaatttccttggcaactgaacgccgcttgataatccgagatactttcaaatatttatctaatcgcatattattttcctccaaaatgacgcaatttttgccacaattttaataatgttctcgcgtggggaatcgccagccattcccgcacggtgagtaactgccagctaagtgccaaactaaagaagatgatcacacccaccggaatcgtaatcaacagcgcaccaccagcagcgagtcgtccagttgctaaagcgggccaccagtgttctagtaggtcgccagttaattgaacaccagcaaccatgaggatggtacaccctagcagttttcgaatgaatgactgctgccagatacctatccgtaagtcacgcgctgagccataccaaatgatggcaaacgtgactcctaagctcataaccgttagccaactcgctccgactccgccgaaatgtatgactgaccaccgattgaagagacatttaacaataaagcccgtcattaaagccaccaccgttaaccgataggtatcctgactttgtaagacactattataagtctgaatcaacgtcgctaagatgatactaagcatgtagatgtctaacatgcccactccttgcgtattgccaaatagcaaccgatcaatccatggcatcagactgattagacccgcagttgctgctgccgctataaccaaagcaatccgcatcattgttgtcgtcaagcgtttaaacgcttgaggatgacgctgtcgctgggcttcggtcaaagcaggaagtagtgaggtggcaaaggccaccgcaaccaccaatcctaattggactagtggctgagcccgatcataaacccctttcagactcttggcggctagatcactcatgccgcccgcaaccagtccattcttaaccgtaaacgaatcgaccagctgtaataacaccatcatcgctgttagcaagcagagtgtgccaccctcgatcagcaagcgacggcctaaatggggcaagcgacgacctgctgatgactgtgcagtgcgccaccgcggtagcgtcaataatgcggctacagccgcgatggtaccaccgctgagtgcccacgtacccattcgatacactgaccacccatgatgcgtcgcccagccagccgctgcgagaataacgatcacccggactaattgctcgacgacttgggagcgggcagttggtaacatattaaatcggccctgatgatagccccgtccaacggaaagtgctggcatgaataagaacatccacgccaccatttgaatcaagggcgtcagctggtgatcgcccattcctcgtgctaaccaaggggcgcccaccatcaacccgccaaaaatcaccacggctaatcccccagtccaccggtaaacttgccgagcaacggtctgttgggttgctaaatcgggggcttccgcaatcaacttagaaataaagacgggtaggccactcaatgcaaacgtcatgccaatgccatagagtggatacacttgctgatacacataaaatccagtattccccaccatattctgaaagggtacccgataaacagcgctcagtaatttggcaacaaatgccgcaactgagagaatcagggccccctgtaaggtggtattaacattgtggttgcccatcagcggcctccttacttatcggttgccttagcagccttaggtttagtcgtttgctccacaatctcacgtaacgtaaccatgaaggcttgcacttgcggtaaccaatcagttgtcgtcatattgggctgtaagaccaacttaatgtgcaaccgatcatcattaatgccaacagtagctttcagttgcgtaaccgccaaagccttaaagacgtcttcaccgcctaagatttccgttccttgtttcgacactgtcacgaatacatcgccattgacccgccgaattttatcgactaaagccaaatccgcggctaacttcaattggccaattgtcaagagctgatccactgctggtgggtattccccaaaccggtcaatcaggtccgcttgaatctcgctcacctcatcgtcatcttccaattgacgaatccgtttgtacatctcaatcttctgttgttcatcctcaatgtaatcactcggaagataggcttcaacccccaactcaatggtcgtatccgtcttcggttgtgtcttttgtcctcgcttcttggcaacggcatcactgagcatctgcgtgtacaaatcataacccacggagttaataaatccatgctgttgcttacccaacaagttacccgcgccacgaatggataggtctcgcatcgcaatcttgaaacccgaccctaattcggtaaagtctttaatggcctctagccgcttttcactgacttcggtcagcaccttattgggctggtaagtaaagtaggcataggccacgcggttacttcgaccgatccgcccacgcagttgatataactgcgacaagcccatgcggtcagcattttcaacaaagagtgtgttggcattggggatgtcgatcccagtttcaatgatggtggtggttaccaagacatcatagtccccccgtagaaagtcgaacaacacaccctctaattgcgcttccgtcatcttaccatgaatgtagccgactcgcgcttctggcaccaacacctgaatttgtcccactgtcttttcgatgtcatccacccgattatgcaggtaaaacacttgaccaccacgctgcatttcccggcggattccatcctgaatcgcccccgcattttgttccatcacgtaggtttgaatcgggaaccggttagccgggggtgtctcaatcacagacaagtcacgaacccccagcatcgacatgtgcagcgtccggggaatcggcgttgccgttaaggtcagcacatcgacgttggccttaagttgtttcaaccgttccttatgtttaacaccgaaccgctgctcctcatcaaccagcaccaatcccaaatttttgaatttaacatcttgtgataagagccggtgagtgcccacaacaatgtccaattgcccggtttccaagtctttaatcgcctggtgaatctgcttagtcgttcggaaacgggaaaacatttcgacattgattggatagccttcaaatcggctgaccatcgtatcataatgttgttgcgctaagatggttgttggaactaaaaaggccacttgtttaccggcttcaacggctttaaatgctgcccgtaacgcaacttccgtcttgccgtagcccacatccccaaccaacaagcgatccattggccgcggcttctccatatcatgcttgacctcttcaatcgttcgtaactggtcaggcgtctctgcgtatggaaaatcattttcaaagtcatgttgtaagctatcatccactgggaacgcgtagcccttctcagccgaacgtttggcatacaggtccaccaactcatcagcaatgtcttcaattttagcggccactttactcttggtcttcgcccactcagaaccgcccaacttgttaatcttgggctttttatcctcggatgagacatacttctgaatgagatttagttgggtaacgggaatgaatagttgcgcgttatcctggtaatcaatggtcatgtaatcctgatgaacgccgtcaaccgtcagcgtctgcatcccaataaacttcccaatcccatggttaacgtgaacaacgtagtcaccgggctttaggtccgtataactctttaaccgttcagcgttggccatcgtttgccgtcgggggcgttttttggtcaccttttggaacatttcggcttccgtaatcacaactaatgaggcttcgggcaactcaaatcccgtttgcagtcgctctggtactaactgggttagtgctggttggaggtttgccgatttggttaaaaccgcttgaatttcaaagtcatcaagggtttgttcaatcttagcaagccgttcctcgtcttgaaccaataatacgaccgtctgctgttgtttgtgccaccggtcaatttcagttttcatcactggtaactgaccaaagaactgttgcatcgctcgcgtcgtcatattggtcatcgcttggaaccgtaaactccccatgcccttttggaacaatgccaacataatctgggcatgcttatcggcccggacaattggccgcaattcaccgccaaaggtctgctgggtaaagatttgatgatgggctaatttatccgtcgcccagttcgcttcatcctccaataattgtcgttcagcatcttgcagccgcacgtagtcgccgaataaaaccacaccgtcatctggtaaataatccaacacttggtggtgttcggggaataagtagtccgcaaattctaataactgtggatcaactgagcccttctgcaacccatcaatcaatggttgaacctgattggtcagtgtggtcgcatcttctgccgctaagtcagccgcttgggcttgtaaggttgtccggagtgccgtcgctccagtggcccgttcatcagcggtcaaaataaagtccgtggctggtaaaacctcgaccgtttgtccattatcaatacttcgctgggtggcgggatcaaagtagcgtaatgaatccacttcggtatcgaaaaagtcaattcggatcggatagtccgccgctagtggatagatgtcaataatagacccccggacagcgaaatcaccaggtgccgctactaatttctgatgcgcataccccatcgcaaacaacttttgctggagggcttccaaatcaaattcatcgccaacactaactgtaaatcgggcggccgcaaaatttgccggtgtgggtaagaaccgccgtaatcccgataacgaggttacgacaaccaccggccggtcactctgtaaagcccgcaaggcatcaattcgtgctgagcggtactctggcgaactggtcgctacctcagccgccaataactcctccacgggaaagtcaaagagctcgtcatcatctagcaaattggctagatcgtcgacgagctggctagcgtgatagagggtatccgtcacataaactagggatcgctgttgctcatggagcagactggcaataaatagcgtctccgccgagccattaagtcccgtcactaattgacgctgaccaaccccaagcgtttgacggatggtcgcgtattgcgccgtctgggtcataaatgcttctaaattcacacgataacttcctattcttagttgtactggttcatcaattgcataaagtcactgccggctacccaatcatcgagggccgctaccgctcgatcggccgcctgattaaagactggacgttgatcagttgtaaacttacctaatacgtagtccacgaccgtgtgttgctgtgggtgggcaattccgacttttaaacgaccaaagttctgcgtcccaacgtgggcaataatactcttaatgccattgtgcccacccgcagaaccatgatcccgcaagcgaatccgacctaaaggtaaatccatatcatcttgaacgaccataacgtcggcaacatcaattttaaagtaatccataatcgggtgaacggcccgcccggattcgttcatgaatgtcgtaggcttcacgaccaagaccttttcaccattcacaaggccgctaccaaaccgcgcgtccattttacgcgtagtcaacgcaataccatgttgctgagcaaacgcgtcaaccaccatgaagccggtattatgccgcgtattgtcatattggggcccaatatttcctaaaccaacaatcattttcatcgtttcatgttctcccttaacgcaaattgtgactgagcgctagaagcaaaatagctggacgagacactaatggcccgttcagctgactcagtttattcttttagttcattcaatgccctatagtatagcataatcccctcacaacttcacgactcccgtccgcgaaacaattgtttagttaaataaatgattgttttcacaaattttcactgggagcatggtcgaacacctttttacatggtatactaagcggtgggtatttaatacgagcgataatcactggattatcgatgagaattgcgtacctggatgtcaaaattttataggagatgaagaatttgactactaagaatcatcaaaaagttgttttagtcggtgacggtgccgttggttccgcctacgcttactcaatgatgaaccaaggtattgccgaagaattcgtaattgtggacgttgttaaggaacgcactgaaggggacgctttggaccttgaagatgcccaagtcttcacgtcaccaaagaacgtttactcaggtgattactctgactgcaaggatgctgacgtggttgttatcactgctggcgccccacaaaagcccggcgaaactcgtttggacttagttaacaaaaacttgaagattttgtcctcaatcgttaagccagttgttgaatctggtttcgatggcatcttcgttgttgctgctaacccagttgacatcttaacttacgcaacttggaagttctctggcttccctaaggaaaaggttatcggttctgggacttctttggatacttctcgtctacgcgttgcgttggctaagaagttcaacgttgacccacggaacgttgaagcttacatcatgggtgaacatggtgactccgaattcgctgcctacgacgaagcaactgttggctcaaagccattgaaggttgttgctaaggaacacggtttaaccgatgatgacttagctaagatcgaagacgacacgcggaacaaagcttacgaaatcatcaaccgtaagggcgcaacttactacggtgttgcaacctgcttgatgcggatcacgaaggctatcttgcgtgacgaaaatgctatcttgcctatcggcgctgcgttgaacggcgaatatggtttggatgacatcttcatcggtacaccagccatcgttaacgctaacggtttaggtggcgtcatcgaagttcctctttctgacaaggaaaaggacttgatggctaagtcagctgaaaccttgaagaaggttacccaagacggtttagccgctttggaaaactaatttaacgattaaaggggtcgttccttacgggaacggcttttttattttgcctgattacttaaattccacgaagaacccagaactgacaagacttgtttaccgcgccctatctctaaatcacccgctaatctggcacagtattttctgaatgaacatgacatagttatccgttttaattatcaaattaattaaattcttcgaaaactgacatcatcatgatgaaagcgatagcataaaagcagtcgcgttgccatttaaggtagtttgaagtaagctgggagtatgctattggtgatagttgaaatgacgacttttcctccactggctattttaggaggtcacacctatgaaaaaacggaaagccttcgtgattgggattgtcactgcggttgtcgcagttggtgccatttacgttggacaagcaatgcattattcttctagtaaagttttcttcaaagatacgacaattgcaggggtcaacgtgggtggcagtaccgctaatcaagcggctactaagctaaagaccgccatgcaagatcagcaatacaccttaaaggatggcagcaaaaccgttgccagttttaagactaatcaggttaacctgaaagtcacctccaagcaggcattaagccagctgattgccaaacaaaacgtttggagctggccagcacatgtcaccaccgccacggcagacagcatcaagctcaatgctagcagcgctaaccaacaaagtgtgcaggctctggctaaatcaattgctaccaaaaccaacaagacgcggacagcggccaaaagtgcctcatttagctaccaaaatggacaatgggtggtgactaaggaaaaggccggtaaccaactcagcactgccaagttagctaagtcaattacagcggctattgaacaaggtagtaataccgtagacgtttcgaaagattacttgcagcccaaagttactacaacgtctgctagcttcaaagcagctaagactaaagctgaggctattaccaagcaaacttatctctacaagttaagtggtcataaagtaaccattccggcggcaactttagcgagttggctgaccttaaaagatggtaaattgactactaagaccacagccgttaaggcctacctgactaagctcagcagtaaatacggcaccatcaataagacacggacatttaagtccactaaacgtggtacggttaaagtcaaggctggattatatggctggagtatcaaggtcaagcgtgaaacgccagccttgagtaagctggttctcgctggcaaagggatgtctcgaacaccggctatccaaggtagcggctatcacagtaacggtaccgacatcggcaagtcatacgttgaagttgataaacaaaatcagcacatgtgggtttataaaaacggaaaagtcgtcgtttcaaccgacattgtgactggtttaccaactacggcccatcatacgccagttggtgtctgggtcatctggagtaaacaacgtaacaccacccttcgtggtaagaatgataatggctctagttatgcttctaaagtgaagtactggatgccagtcgatgacactggcgttgggattcatgattcgccgtggcaacccacttacggtggcacgtggtataagaaacacggctcccatggctgtgttaacaccccaccgtctaagatcaaggcagtttacgagaatgtgagtgtcggtactcccgtcattatcttctaatgaaaatttaaaaaagggtctcgccttgcgagatcctttttttcgacctaatttaatgccaagccgatagcacctaaaacgataatcgcaatgactgccgccagtgtccaatagagccattttttagtgataatccgttgattatcaggatcttctggttgtttcatccgttgaccctcccttagccaaactttcttttattttaccacgaatttcatcgaaattttctccccgtttcacttagaaatatggtattattaaaagagattattagaagtttctaattttaggaggtcatcagctatgctgttaaagtccctagtgaaaccgaaagaacggttagtgacggttcgcgaggatgtcaccttggaacaggcactaaaggttctggaagattccggttaccggtgtgttccaatccttgacgaaacgggtcagattttccggggcaacatttacaaaatgcacatctatcgtcacaaatctcggggcggtgatatgcagctccccgtgacatctttattaaagaacgcgacgaagttcatttccgtgaatgctgccttcttcaacgtcttcttctccatcaaggatttgccttacatcgctgttctcgatgataagaacgctttttatgggattctaacccatacccgtctgatggatatgctatcccaatcttggaacgtcaacatcggtagctacgtgttaaccgtcgtttctgctggtgaacggggtgatttagccggtatggctaaggtcattacgaagtacacgtccattgcgagtgtcatcagccttgacgcccaggaaggtgaattggttcaccggaccatgtttaccctacccgcggaagtcgacgaagaaaagctcgaccgcatcgttaaggctctggaacgcaaagaattccacgtgccagaaattgaagacttacgtcacgaaaattagtatatgaagaaatcggcaaagcatgctggctttgtcgattttttatatccagtgatcattacctgggcacaattattagtgaacataaatacccgttagcaacgtgttccacctgctaacgggttatgtcattcactatgtacaattgctacttaacttttttcttacgtgccttgtccaccaagccaatgctggttgcaagtgccgtgtccaccgctgccattgtttttacatccaaatgagtcacttggtctttcaaccgttgcttatcaattgtccgaatttgttctaacaaaataaccgaatcccgttcaatcccagtacgagcggcagaaatgccgacatgcgtcggcatttttggcttctcgattcgggcggtaatcgctgcgacaatcacggtcggactgtagtgattccccacgttgttttgaataatcaacacggggcgcatgccaccttgctccgaaccaacaactggtgaaaggtcggcaaaaaagacgtcaccgcgtttgatttcaacacgggccataggccgccatcccctcactatttaaattttttatactaactctctgctctacgaaactgggttaaccgccgttccgcttcctcttcacaaggcgtgaacgcctgtgcgaggtcccggttgatgagcgccatcgcctgatacccaacaattaaagctaactcccgtgaggcagccgctcgtaatggcactaatgcctggcgctgcttggtacgagtcatgtgaagccgcaacgttactggtttcaattgtcgtgattgagccatggaattttgcccctcctcaagttgttaatcacttcgtctcacttagtttaccacgaaacatcatttctggacacaaaaacgtcataaattagtgacgataaactcgtggtaagcgacttgtgaagccacaggcaagctcataatgaattgtttgacaataatcggccatttcttgaagcgtaatgacgtgatcaccatcacgaccaatcaaagtcacccgcgttcctcgggcgtagtcgtgaggcaaacgaatcatcagttgatccatgcacacacgcccaataatttcacaggcctgaccatcaactagtacatgaaaaccttgcagtcgtcgttcgtaaccgtctgcataaccaatcggcacagtccccacccattccgtctgttgagcggtgtacgtggccccatagccgactgattcaccggcaacgacttgtttactatgaaccaactggctggttagactcagcgctggctttaatgcatacggcgctggaatagcagttccggaaggatttaaaccatatcctgcaacaccgaaacgaaccatgttgtcattgcaggctgcatgccagagactcgtagcggaatttgacacgtggacgtaccgtggtcgttctttcaaagcagctgtcaacgtttgccacttggcaacttgttgcttaaagtacgtctcatctggactatcagccgtggcaaaatgcgtgaaaataccttcaaagttcaacgttgcgtgggttgccaaataactaaccgctgtcgtcagctcagtcgttgttttaaacccaattcggcccattcctgtatccaatcctaaatgaacctgtaacggtgctgttggttgtgccagtgccaagtaggcgtccgcagcaactaaccagtcagtcgccgcaacggttgctgagatgtgctgttgcgccatcaacggcgcatcttctggctccgtcacccctaatacgaggatcggttcattaaaaccggctgcccgtaattccagggcttcatccaaaatggccacacaaaaaccagtggcaccggcctctttagccacctgagccacctgaacagcaccatgcccatacccgttagctttaaccaccataaataactcacagccactcgctaaccgtgtcacttcagcctgaatattatcgtgtaacgcttggcggtcaatcactaattgtgttggccgatggaccccaactaccatgattcgttccctctttctagaataacctgtgtcatcacgaccgtctccgtgtgtgaaatcgaaacgtgcgcaattcccccaaatggttggcgacgcaccactggccgcccagcatcattatcccgaatctcaatgtcttgaaaggtcacagtcgccccaatccccgtccccattgctttactgtaggattctttggctgaccatcgtcccgcaatgaattccaatgcgcgttgcccactcaatttctggtaatcaacgcgttcattcggtgtcaagactttagttaaaaaacgtggttggcgttcaacaacccgctgtacccgttttaaatcagtgatatcaataccggttccgtaaatcatggtgttcacctcgcttaaagtctagctattattttagcacagccacccctaattagggttacaagttactgagttaagtcgaattttaacttattatcagaccatttcacagataaacccctaaaagatttggccattcgcacaaaaaaggtagccgactcgcagttcgactacctagtaaatacttattgattaatgcgcaacggtttcacggagccgtaattgcgcagctacaggattactggttggcatggcatctgctggtaagacctcgacctgtccacctaagcggctgacctgcagggccagatcattgtatagattattctgccgacttaacgctgtggctgtcatcaccgttcccttttcagttaaatggcctggttgactggcatcatcgcgtaaccacagcttcgccacttgcccttgtacggccgccgtcgctaatggacccaagtcttggacaacctgttgattctgccgaactttagcgtaagcatcccgccgaatctgtgttgcctgctggtgtcgctgttccgtaattgacaaggccaacgccgctaatgtttgattggctgccgccaggttcggtccctgaacaacgcgcacgacatggtctaaataagcattctgagcaaatttacggaagttcccttgatcacttgcattggctaccagaatcaatggaacttgatcaacattcgaatagtgctgggaaacatacgcgtcaaccatcatgaaataatttcgttgatccgcttcccgggctgtatctaaagacccggttccactgtactgggtatgttctccggcagatcgctgccaacgcccacggtcccgcagttcacttcccagggccttttccaacgttacgggagcatcgactggtaagttcaccatttctggccgcccattgcgcacctgtgccagatcaaacgcatcacgacctaaaagcaagatgtcgtaatcactggtcttatcttgggcctgtaaaataggtaatacattcggttgatacgtaaccgtcactgtggccgccaccggtgtgtgtagccaataatgataactatcactggcgcccgccataatcagcagacctgtggcactcccattagtcaatgggccgtgttcaaacggcgtgaacgattcagcataagcagaccacgttctgtcaggtgcaaccttctcaagttgttcttttccctgttttagcaaactgttaaattgggtgcggtcagtcgcggggattcccgtgactggcagagtcatggtaacgaatggacctggcttagtggcaagcgtcaatgcagcatgtaagtcaaaattattggccatgataatacctccgtagcggtttgctataagcttattcgtatcaaatctataagtacataatagcatgcacccgtattgaacgcaagccaacttttctatccagaatccatttatagtgtgaacatagctatttaagcctgctaaatcaaccttttatgccacaaaattttttaataaaaaagcactcatcactaggatgagcgctctccaatcaattctcatgtaaaactagtctttctttcgaatggtgaagccgcggctaccaccttcgttacgccgaccaccgccattgttgcttcggtgactccggttatcactatggttacgtgagtcatggttgcgtgaaccatggccacgatcattaccatgacgatctgaagaacggtgtccaccacggtaaccgccaccgccattaccgccgcgacgattgccaccgccatgatggtagccgccaccgccgtgacgtttgccaccgcgcttaggcaatggtcgttctggcgtgatcttaacgggtacttggttattgtcatctttcgtgacatcactcaagagcgccgcaactaagtcttcggcatcgtattcgtttagcaagctttcagctgccttagcatacttttccttatccgccttgttgaccaggtcagcaatggtttccttcgcagcacccaattggctgacgaacgcttcttcatccgaaggtggcttcaaaggtaacatccgcacctttgtcagcttttcgatttcacgcaagtagtccatttcgtttggtgtcacaaacgtcatggaaaccccatgcttcccggcacggccagtccggccaacccggtgaacataactatcgggatcttgtggaatatcgtagttataaacgtgggtgacatcgttaatatcaatcccccgcgcagcaacatcggttgccactaagatatccaacttaccgtgacggaagtcgttcatgatttgggtccggcgcttctgcgtcaaatccccatgaatcccagcagcgttatagccgcgggcttccaaaccactggcaatttcatctacccgccgttttgtccgggtaaagacgatcgtcaaatctggtgattgaacgtcaaagaaccgcgtcatgacatcaaatttttcgaaatcacgagaacgcacgtagaattggtcaatcaagtccgtggttaattccttagccttgatcttcacatgcttagggtccttcatgaattggacaccaacccgtttgatttcaggcggcatcgttgcagagaacagcatcgtttgacgttcttctggcaattgtttgataatatcttcaatatcgtctaagaaacccatgtttaacatttcatcggcttcgtccaagaccaacatttgtacgtggtctaacttcaacgtgtgccgccgaatatgatccaataaccgacccggggtcccaacaaccacttgcgggtgattctttaaggatttaatctgacgacgaatatcagcgccaccatagacaacttgcacgttagcccgttcagtccggcctaacttgtaaatttcttcttgggtttggatagccaattcccgtgttggtgagacaaccagcgcttgaacattttcgttactcttatcaattttttccaaaattggtaaggcgaaggccgcagtcttcccggtaccggtttgtgcctgaccaatcacatcttggccggctaaaaccatcggaattgtctcggcttgaattggggtcgcttcctcgtaacctactgacgtaattgctttaagtaggtcttcagagagacccagttctttaaacttcaaaaataatttcctcctaaatgagttcgtcgttttagtgcctcagggctcttggaaaaaatccgttttccatgacgcgaacgatgattggctaaaacggggttcgtttcaaaaaatacaactaaaccatcatacaacgctgaaagaaaataagcaactcccagctctcgcagaagttgctttgctttcacactaattttcagaagaatcctgcaaggacgccaatacttgttctaaatgaatcccgtgggaccctttcaataaaatctgatcatccgccgtcagctggttttgtagatcaaccgttaacgtcgccaagtcagtcgtctcataatgagaaacagctaactgtggctgttgctgtgccaaggcagcctgtagtgccaacatgtgtggaccgaccagataaacgtggtcgatcttcgttgcatcaatagcgcttgccaagctagcgtgcatcgcatcagcctggtcgcctaactccagcatgtcccctaggaccacatagcgctgaccagttactggcgtttgcgagaaggccgttaagacttccttagccgccgttgggtttgaattgtacacatcactgagaatggccgcaccagaggcgcttgtcacccattccgcccggttttccgtcaagctaacggtcgcgagcgcttgcttggcactctctggtcgaatccgatatagcattgctacggacaaggccgccaaggcgttattgacattatacgtcccaatcattggaatagtaaatgtcacttccggccactgattcgtggtaaaactggtcgttgtcggggttcccgtaacgtcagtcgcgaacagatcatcggtgccctgctggccaaaagtaacctgtcgctggatcaattcagtggcacgctcgcgtagtaagggttcatcaccattaaagacaaacacgccatcatcactcaacccgtgtgtaatttccatcttcgcatccgcaatcttatcgcgggtaccaaagaattcaatatgggcttccccaatcatggtaatcagcgccaaatctggtgagaccaattggctcaagaaatctaattgtccgggacgatccattcccatctcaacaaccagcatttcggtattgggctccatggataacaccgtcatgggtaccccaatctcattattaaagttcgcatgtgtcttggtgacattaaattgcgtgctcaaaaccgccgcaatcatatccttagttgtggtcttaccattgctcccagtgaccgccaccacccgtggattaatcttagacagatagtattgggcgagggtttgtaaggctttcagcgaatcatcgacttggataactgggaagtcagcgggggcggacgctaggtcacgggcccaaagcgttgccacagctccatggtcgatggcagactgaataaattgatgaccatcgtgttcaccagtcaggggaataaagagtcctcccggttggaggtgtcggctatcaaatgccacactagtcacactgacactaccccattgttcgaaatcattgattgctcccactgcgtgagcaatttcagcaagctgcatcttcatgttttctactcctaattagtgaaacggccgcctaaggtcgccacgttctcgaaataattctgaccagaggtattcgctatctctgatataaattctgaatttcattataccatggattacgccagacaatcttaaaactaacgcaaaaaccaccgatgacaactcgtcaccggtggttgacaacttctaaattaattcactcacatcattaaatacctgattatcatgaatgctcagcgcccactcacgcgtggtcaaatcataacgcaaactagcgacctcacgagagtcggcgtaaacgtcctcttgtgtgtaccacgcattttggtgctccggatgggtaatcgcgcgcacaggaatcacataaactcgccgtcgttcaactagctgatcgaacgccacaatcatgccatccattagcccttgtgtcagctgcaacagaatttcatgcggtacatcgctaattgccaacggacgggcaaagacccaacggttattgtgcatggcgcgcaaatgccgcttgatgctaacttctaacacgtgatcgacatcacctaggtgccgataatacgtcttataaaatccgtctcgcaaacttaaagaaacataattgttctgtagtttggcataaaagggtgtgcgaatatgggtatccatatgagctaaatataatagctccgcaatctccgtaggtaacaaaaagtccaagtcatcactgtgtgcataatctaaccacttaaccgcgtggtcgtgtttacctaacaaataccggcgaatctgcgcttgcccggttatggtctgcaaccgagtatgcggattgatttccacatcgttgccagactcttcgttcagcaataataattggttcggaatagctgggattccgttcaaaaaatcagcgggtaaaattcccagcgaatagatcatattcgtcaccggctctaaactaatatagataaaatttccgcgcatggttgcacactctttcccctagtttcaatcacacctaattgtactacgaaaccgactaccggtgcccacttattttacattttttccagccgggcaattcgatcggcaatcggcggatgggttgcaaagaggtcggcaaatttttgtttgtgcttgaatggatcactaatataaagtgcggcactgttaggatcagcagctttcatgggctgactgtcatcaatctttcgtaacgcattaatcaggccttgtggattacgcgtcagctcgacactagaggcatctgccaaatactctcgattgcgggataaggccatctgcgcaatactagctgctaacggcgccaagataatcaggaaaatggaaatgactaaaccaatgatattaccggccgagtcatcacgatcatctcgccgccgcgttgccccaccccaccagaaccaattgctggcaaagttaaccaataaaccaatggccgcggaaagagctaacgcaatggtctgcaagcgaatatcatagttacgaacatgggacatctcatgcccaataacgccttccaattcttcacgattcaagcgttccatgatacccgttgtcactgccaccgcagcatgcttgggatcatttcccgttgcaaaggcattaggactgggatcatcgataatgaagacccgcggcatcggtacttgtgccactaacgccatatcctcaatcaagtgccaaagctgtggcgcttgactaacgtctttaatctcacgggcatgattcatgctcatcaccacattggttgactggctaatcataatcaacatatagacgaccgccaccactgcagcaatcacggttcctgacacccaactgttccaaaagaggtaacccaatgctgcaccaatcgctaaagttaagacgccgaagccaaacatgacgtaacccgtgcgccgtttgttcgtagcaatttggtcatataacatatgatcgcctacttatctgacccaaagtcatcaaagttaaccttgggcgtggttttttcttcttctggcacttgcaagtattcgccagcttggaaatggtgtactttagccacgatgttacttgggaaggattgaatcttcacggttaggctcgccactgaactgttgtacaattgccgcgaataagcaattttattttccgtattcgtcagttcttccattaactggctaaattgcgcattggcctttaaatctggataattttcagacagagcgaataacgaccgtaacgtcgtcgataactgattagagacttccatcgtctgttgatggtcatccgccggcactgccgtcaattggttgcgcaaggcaaccactttctttaacgtcgactgttcaaaattagcatatcccttggttgtggataccaagttgggaattaagtcattccgccgtttcaactgaacgtcaatttgactccaggattcttggacatttgtccgactacgaatcaaaccgttataactggcaacataccagataacaagtaaaacaatgatgataatcgcaataatcgcaaccataaaatcacgcctccataaaattattttgtcccctacagaactcacatatcgggctactggcttggtctaggaactgaccgaattttctgctaaactaatcatagcaaaaggctccacccgagaccagcaacttggctttattttaccatttgttaggaggatttctgtatgcaacacattttatttgtctgcttaggtaacatttgtcgttcccccatggccgaagccattttccaacaattagtcgctgaccggcaattaaccgatcaatttgcggtagcatcggtagcgaccagtcctgaagaggaggggaatcatccccatcccggtgcattagaaacgttacgtgcccacggattggatgccagtgcccatcgttcacgaccaatcacggctgccgattttgcgtgggccgataccattattacgatggatcacagcaacgtcgctaaccttaaacgcttggcgcctaccccggcggacgccgctaaggtccacttgtgtctagacatcttacccgatcatcaacatgaagcgattgacgatccgtggtacacacataagttcgaattgacctatcaggaattggctaaatcactgccggcttggctggataaattatcacaaacgccagcctaacacccaaaaacaactaaagaatcggacctttcaagtgtgttgaagagtccgattctttagattttacctttagcgttccgcttaactcggtgcatcctttaaactccacgtaattgtaccgtcataatttccagccgtcgttgcactgggaatctttaaaaatagtcccttcgatgacgaatcagtccacgtactggaccactgcttgctaacagttgtagtagcggccgaatctcccgtatcaatggcagcatcttgattactcaaagttgtcacgttcccatttcctggttggtacacaacttcccccgggaagcttgccgccagtcccgttagactagcactcaaggcccagtgtttgcctgttactcgcgtatccgcaacagaaatattgggttggctacttggtgcaatcgtggccgctgttccggttaattccgcattaaaagcaatgttgctggtcacattcgaaaatgttaatgatccaacgttgatggtggccttaatcacatccgacacgttggtaccgccgttgtaaattgcgtaaagcgtcacggtattggcccccggcaatagcaaactagccggcaccgtatacgaaaaggtgccgccatctccggcagtcgtggacgtctgcgtctgtccatttaccgttggtcgcaaggtcaccgccttacccgctgttcccccgtagccagcatcactagccgtactcgtcaacgaataggtaaaatgcccggtcaacgtggtatctttaacggcatccaaatccatctgactcgtcttagtcccgttagcggcagtcccaaagaataaccgcaaataccagttagacgcagcactaattgtaaagtttggcgtagtcgcgttcgttagagcattactcccattaaatgtgctcttcgccgctgcaaccgctgttgtggcatttttaacccccataacgttgccaatgatagtgatggtggctggtgcattagtgccattcaagtcatgcgttagctggtatttcaacgtctgcgcactgatagtacctggatcaatcagttcactcttaccatccgcataagtcaccctcgcatagctcaccgtcatattattgggaaccgcaattttagccacaatatccttccaatcctgtgagccactgtcgtagttcaacttgtacgctaattgtagctgatcgcctgacgtaacggtgtcccctgccgcaatcaccttatccgtcgtcaaatctgttgccgttacagatgcactactattcacgacgcccggaacctgctcgaaaatcaccagattattctcccagttcgtaccggttgagcctgtaaatccccagcgtgcgtagccagtattattcggatcaatcttcgtcgtatcaatagaaactgtcttcgtacccacgggcgtctgggcattgccggtgctcgggtccttatcattataactatacgtcatcgtcttagcagtcgcatcccacctcattgtcacatgatgccaagcaccattagataagagactataactgttattttgaataacgccttgatgttgcataagcacatagggattatcaggatttaaattattcgtaacatacgtcagaccagctcccggatagttagacgcaatatggggataggatccaaccgatgtatcaaaggccgatcccttgcgactctgcgtattactgaaactatcaaactctaacgcccagctattctgaatcgctcgtgattgaatttgcggattagtgataccatcgtcaacaccccaaacccccagcgtttcaccatcaccaaccgtaccactggtcgtcttagcaatggcgtccaccccccgggcatcattttgtaacacgaacgccatcccgtcgcccgcactagacgttcgatagccaaagtacagccacatagaggctgttgcgttcttattcaagttgagccgatagttatccgccgtccaaatagtccccacttcgttggtggtatctgtcagctgaaccaattgtgtcccatcaccgcgattactgtcaatcactttagctgaattaccgccaccagtgctagtattaagggtccccagcttaaaataatcattcaaaggcagcccctgtggcgcggaactaatcgcattactcaaatcattattatcagcctgagcaatcggaccgcccagtaatccagccacaacaagtgccaagccacctaagaaccaacgtttgatccccattgtatcgtctccctacgtaacttcaccttccagcgtgtacaatataaaccattcacaaagcatcatttgaattttcctaatccaatagacgtttaaccgctttcattttaccaagttaaactaaaaaaagatacctttatttaccggttaattaatcaaatttcactttcattagtcatagaaaagatgttgattgacagcacttattggccatcaccatttatcttgttttagggcaattcggggcatttgtaacccttacctataacgacaaatattaataaaaaaaggccgtcaaaaatcattcaagatttctgataagccttcttaggtgttttctagctaggcgtatcgtctagttcccaattaatctgaccgttataattaccagaagtcgacgaccctggcaccttcaagaataggcccttagaagcggcccccgtccaagtctgactccagtcatcactgacatcggttgctgaactagcggctttccctgtatcaattgttgccgcttgattatttaacgacagtgacgagccatcacccggctggtagatcagggtcccagggaaactagtgctcatcgctgttaacgccgccttgacagtccaactgttcttacccccacgtgtatcactgaccaacacatctggctggctaactggtgcaatcgtctcagtgtttccagttaacgtttcgttaaagttaatcgtgtcgctgactgattgaaaccctagcgctccggccgtcaccgttgcagtaactggggttgaataaacggtcccggtagaagccgcatatcccgccgtcagggtcacataattttcaccgctagtcaagtcagcagtggcaatatggtaactaaattctcgcgatgttccagaagacactttaactgagctcaaggctttcccattaacgctaggatacaaatcaactgcagaaccattaattaaggcctctgaactgggcgtattgtcttgtgcaaacgtaaagtacccagtcaagtcgaccccatccgctgtcgtagtcatcgacgttgtggtcgtcccagtaccaaccacgccgaagtacaagcctagttgccagctgttacgagggttaatcgtgtaggccggcgtactcgccatcgtcaacgcattcgagccgttaaagtgactggttgcggccggcacactcacggctgacgacgtacttgaattcgttgccgaaccatataccgaaaccgtcgccacattgttagtcgtattcaggtcatcaatagctgccgtcaatgcttggtccgacagttgggacgtatcaagcaaggctgtttttccattagcataggtgacctttgcgtagttggtagcgaaactatttggtagattgatcttagcgttaatcccggtccaacttttagaaccactcgtataatctaaacgataatccgcccggagcggtgttcccgcatcaatggtatctcctgtggcaatctgtttgtcagtccgcgtattggtaatggttgctgtcgccgaactgttaacaatcccgggtaactgttcaaaaatcactaaattattttcccaaagttctccggttgaacctgtgaagccccagcgtgccttacccgtaccgttgggatcgatcttactccggtcaatcgtaacggtctgggtccccgtcgccgtctttgcgtcaccggtagccggattcttatcattaaaggcatacgtaatcgttgacgcagccgcgtcccatttaagcgttaagtgtttccaagtgttgtcccgcgatgaaagcaggtaattcggatcactactatttttcatcaacccattgtgattcaaataaaagaagtcgccaccggaaccatagctccccgcatatcctggataattagaagcgatgtgttgcttggctacaccggttcgtaagtcaaaattattactgttcaaatacgtatcgaattccagggcccagctattttgaatacctcgactggcaatctgtgctactgtccccttcggatcatcgtcaactccccagacacctaaagtttgcccattaccgacggtcccatcagaagcccgcgacacggcattaacaccgcgcgtatcattttggatcacaaaggccatcccatcacccgcatccaccggatagtttccaaagtacatccacatcgatgccgtggcattcttattgaggtcgagggcatagtcatccccggtccagatcgttccaacttccgctttcgcatccgtcaattgaaccatctgcgtcccatcacttcgtcccgtatccacaaccttagccgagttacccgcaaaatcgccaaatttaaaatagttgctcagcggtagaccctgcggcgcattagccttggctttatcataatcggcatctgcatgggccactgacatctggctaactaggccgatggctaacagcagactaaaacccccgatcaacaaccttttaagcttcatcgtccatctcccaatccccaatttcaatttaatcggtcagctaaattcatatcggccatataatatgcatacattgtaacaaattaattcgtaaaaggccacatttatgaacaccgtttaacaataacagttaaaaggttcactccccaacatcagtctccccataaacgctgtcaaaccagtctattcgttatttatcgttgattagttattccacaatcaggcccaagttatgctaaagctgcagtaatcaaaggcttcaaaaatctcagcggattggcaaaagtgtccaattcataattcccacaaaaaaacacggctctactctgtcagtaaaaccgtgttgtaacttactcagttatttcgactcttgcttatcatcatcgtcattacgcttacgcttgagtaacaagtaaatgataatcgctaacaataagataatcagaatcccgccggcaacaaaccaccagaggtaattatgttgttgtggcgtattaatcttattcttcaaactgttgatttgcttttgggttaccgtaaagttcttaacaaaatgccaatgatagccacccttagctgttgagtccagcgttaatgtgtacgtccccgccttcaattgggtatcgccccatggaatggcataattaaagttactgttaggtgccatcgccatattcgacttttcgttttgtaagacaaccttagtcttgccaacctcagtgaccttggtcttaactttcaattgagacatcagaccgggacgtgggttttggaggtttgcttccacttggttataggcgttgatttgaccagcccgaacttcatttaacttcatgtcaggtgcgacatcaacactactttcacgcaggcgaacaccaattacataggcgaattgattggtaatcgtaactccttttttcgccttagcttccttaccggccatcttcttgacgtaaacaccacctaagatcatcccatcaatcttcttgctaggcatcttataggtgacgtaaacggtcttagacgtcttcgccggcactgttaccttctgtagcttctgttcgttaaaaacgtccttaatgcccacttttaatgagctatcaagcttcggattactattactgtagtcaataaccccgttgttgttcgtaattgcttggttgacgccatattggaaagtcgccgacttcttactttgattagaaatgaccactcctaatttctcttgctgattaggtttaacccgcagcgcaaaataggtgacattcttatcatcctgattctttggcagctttgccgataccgtatagccaaccccttcagcgtgagctgttgtggtgtgccagcccgcaaaagtcagcagtgcccccaatgccaaaatccattgccaataacgcttcatgatgtagcctccaattcccactatttacctatattataccaaaagtagcggtggcgacagccaccgctactaacttttctacttattgcggcgtatcagtcaatagccaagttaatgcaccctgataagtctgctgttgcttaacaacagcattatctaccaatagcttggttggtgcagtcgcactacggtttacctgtaacaaccacgtgcccagaccagttcctttgttcgccgaagcaactagtgaatagctgccaatcggaatcaaactagtcgccgagtcggtaaccgtcggactggcactcacattggttgtgcttgccttagcaaaggaagctgaacccaactgtaaggccgccgctgaaatcttagaaaaatctttttcgccaactaagggactgggtttgacttgtaattgccaacccgcacccgtgaaacggcggtcgctaatttgtacgtaagcaccctgattggtggccgtcgttacaatttgccctttggtaacctgctgttgcttgaacgtgaggttcggcacataatccaaagttaatttacccttagaaccagttccgtcatttccagaatcatctggatcggttggctcgcccggattaaccggcttagtacttccatctccacttaaggttactttagcagtggtcgacaatgaccctgaattggccagagcagtcgactgcgccgtaaacatgatccctagagttagcgaggccataaaccataatacacgtttcacgacgacgcctcctcactatcgatgcctaaacgtcttagaatggggcgttctttagagtccaagttaagttagaagtgtaagtaccggccgtgttcccatctggaacagccaagctagcggtattgaagctcgtgttccacgtaccaacaccaactgccttagcgtcaccagtaatattttcattgccggcagccgtcacaactggtttttcggaagtcccatcaccatttaattcaatggaaccctcaccagtaggcgcagttgaagacgttgacccagtcggtgaagtaaccgcaccatcagttaaagtcaacacagcaccttgcaattctgttccagtagttgtcgcgaattggctactcttcacagtaacaccccagttggtcttaagaccagggttaaccgtctgaactggtgtattaccgtcagcagtaccggctaatttcagtgcctttgacccaccaagttcaccaccatcaatcgtgtaacttggtgcagtaaccaaggccaatgccccatcaccagcgttaccgccgtcaccgttgtccccaccagaagtggacccagcggtcaatgcaaccttagccgtcgtgtgcaaatcccccgtgttagaaccactggcactgtcactagtagccgcaaaggcggtggaaactgaaccgaagcccaaacctgctaccatagctgcagctgctacaaattgtaaagttttcttagtcataatattatcccctcaacttaaagttttaatttcttgcttcctacgttttaacaacatgccgatccaaatcagcaataatatgatgatacctgccattgacccaaaaccgtaccactggccttctgacaattgtggcaaacgtccactcaaaccggaccgcgacggtgtcccagatacctgatcaccgtcttgaccctgagctgcggtcggtgaaacccgactgccactcggtgacttagctattgagctaccgctatgattcccgctatcacccactgcaaagtcaccatcccctccggcaagtgcgccggacgtatctttactcggtgtcagctccacttggtaagtagattgctgaacatccgctaaagccactacggattgtcccccaccagcaacgattaggaggcctaacagcaacaaccagatttttttaaatctcatcactgtccccatcctcacgttaggtgagaaaatggcaaaccaaattctcaacttgtgattaactaacttacagaccaacattatctacaactttcttcgttgaactcatcgatgattcatgtatagaatagcacgtcttttttactttgtccatagttatcgaaatggatagcttgatttttttgataattcagcatttcttttttttcgccgatactaaccattagctttgcttgttgtcatatcagtatttgttcatcgtttgaattatcaattgaattcgatttcactaatatttttttatcagaattatgtaaaatcagctctttttatagtcgttcatacggttctcagttgtgttcagtcacaccgcggatcatcaaaggcggatagttacctgtcataactatccttttctcttatcctcacccaattcttaccagatattgtctaacagatcgcctgatcacgcctttttaagcattaattctatgaaacatggtccatacccgtagctaatccacgcaaccttcagtgatcacaggcggttgattctcatagaacgcagcaaaaaaagcagctctagctgattgctaaaactgcttctaaattaataacctattgtggtgcgtcctgtaaggtccaggtcaattgcccgctgtaagtgccggccgtattgctactaccaacatctaatagcaaaccagaatccgtgttccaactaccagcgacattcgtcgttgaactgtcactagccgttttggtgtgcgtcacgattggtgtgttgtccgctgtgatggcttccgttccactggccgtcttgtacattaagctgccttttaaagcttgatcgttgaccttaaacggctgtgaaatcttggcagataacgtccactgactgccaacagcccgagtatcttggacattaaggttccaatcgccattcgtaccagcagtctgctgactgccatctaacgttgtatctttgaaagccgcactatcagagacggtaccaaaggacagcgaccccagcgtaatcgtcgcggcccccgtgttagacgagttccccgtactatcggtcgcatacacttcaaacgcattttcaccactgcttaactgactaattggaaccgtcacggtgaagacacccggtttatcagtcgcgctcagcttgctggtagccaaatcattcccgttaatagacgggtgcaaggttagcttatcattactgtccaaagtagctgttgaggtgatctttccagtcaacttcacatcactatcaccggaagccgtcactgctgactgatccaactgcagattcaacgtcgatggcgcaattatgaatgacggaatatcaactgaagcaattgcttgtgtccccgtaaagctcccagtcgtcgcggcaacagttgttttagcggttggattatccgcgacaccggtcaaggtaatatcagctgaaacatagtcgctatcgctcgcattgttgagcgcatgggccaaagctaatttaatacccgtactcgacaatcccgctacatctaacgttgttgttgtggtagcgcccgacttctgcgtataggtcaacttagatgacttgtacgtaatactttttggtacatcaattttagcctgaacattctcccaagcagacgtcccactgtcataggaaacattataattgactttgacatggtcattgccttgaatagtagcgttgtccgtaacatctttattggtggtcgtgtcggtcatagtcccactggagttaatgttagccaagttagggatctgttcaaacgcgactaaattgttttcacttgcctgtccagttgaaccagtaaacccccaccaaacagttggattagcttccgatgcacctagctttgagggcgtgatgttaacctgtcgtgacatatgattatcttcaaacgaaccataatcggtcccgttgctttgcttagcacctgtatctggatttttatcatcataggtataagtcataacgccatcgctagtcgatgttgctgccttgtaatcgatcgataaatgatgccatttaccatttgatagtttccccccacgtccagtgtttggatatgataatacaccttcgtgatttaaagtagcccagttataggttaaatgctgtgtatcatgttccccaaaaatatctttatacccaccaatagacactgaacctaacgaatgaagagtatacgtacttggttctccgggatagttagaagcaatgtgtggataggaactaacattgcctgcgttggcatcaaatccattagctgcatccgcaatatcattattatcggcttttaaagtattattatcagctgttgttggcttgttaaaaacagaccctatattcccagaaatttttttaattccgtctggattaggacttggaagtacatagtctgtgccatttgggatcgccgcgttaggaaatgtatcaaactccaacgcccaactcttgggaatcgctgaatctgctatcgttctttgcgtcttagttccattggcatcagttgatacatctttcccccaaacacctatgctttgccctttatcactataagtccctgtaccaccagaactattattttgaagaacaaatgccattccatcaccgacagtcctagtattaccattgccaaaatacagccacatgctggctttttgatttttatacaagttaaacttaaagccatctttggaccatactgtggccccaccattataactatcggccgtcaactgcatggcctgagtaccactactgctgctattagttgaatcacggacttcaggcgtaaaaccacctgtcaatccagtcgaatcgtaattttgtccaggagcaaagtaattggacaacggcaatcccttgggcatagttgccaaagcattcttcgcatccttatcgtctacatacgccgcctgtgctgttttcacccctgccaagctaccgaataaaactgttatcatcacaacacttagccctagtaatttactcctcatgagtgattcctcctcaactaccaaaaaccgcaaatcttcattattatgcaatcgttttctttggtgccagaaaaccacaaactttccagcattctgaatatcatttaatcgttagcatattgcccatccgattaagcaaaccctagtcgtcttacctaaccaattacataataccgttcaaacttctaagttcagtatacaaccggcgccaattcttgtccatcattaatcatatgtgcaagaaacatttatagaatattaaaagtaacccccctttttctaattattcaattcacttgtttccatctacaccattggcgattcaagccacgatttacgtccccttgtatgattaatctgttggagcgtcttctgatataacaacacaagtagttagacattagtgaaaatgattcatctaatgtgcctaaataattatttaaagttctttctagcaccggactgaccttgttatcaccgtattgccaatcaacaaatttgtatgtaaaaaagcataggaatcattcactacgaatgcctatgcctttgaattcaatattttaaaataaccgactatgcaggtgcgttagatagtgtccaagtcaaattcgtcttgtaagctgaaccattcgttgaatctgcagcaaccgcagaagcgggaatgttcaaagttgctttcgtataattggcgtcccagatacctaagcctttttctgccgcagcagtcattacaggttgagcagttgtaccgtcagtaccagttcccattgtcaccgtttgtgatgcggttggcgtggctggtttggttgtgttcgttgtatcggtcgatgaagcaccagtagacgtcaataccaagctcccaccatccaaagtatgtgtcccatcggtcatcttatcatttttcactgtaacgttccaaccagaggcaaccccggggtttttaaccgttaagttacccgtagccgtcgtatcaacactttgtgccgtaccatccaaggtagccgcgctaaacgtataacttggtgcatccgttaacgtaattccaccggcgccttcatttggatctccagatttcaatgtaatgttagcatcagttgtcgcccctgtacctttttcattaacagccgcgtgagcaaccgtccccgaagccaaacctaaaccagcaaaagcagcaaccgttgcaataatgcttaaagtctttttcattatcattatcccctttaatatatcctcagtggctttaaattatctactatggctagttcagatgcttggctcgagaataccctagttgttctcgctatcttcatcgagctacttaactcattcctaaccttcgaattcagtataacgcataaccatatttttgtccactattaatcttatgtggtaacaacattatttgcgattaatcaggaatcccattcatacgtttcacaccgtatctaatctgccaagcaattccccataggatgggtcttgtctatagattttggtagcggaatcatctccgtaatatggctaattgccaggctcgatgtatcattgcataatgtaactacactataaacgacacgttaaactactcgctaaatagcaaactttattaccgcaatttagttttggttttcagtatttactaaaaataaaaaaagcctgaacaatcgtccaagctttaacagatttcaattaatatcgcttatgcctttacggaatcaaccaagctccaagttaagttagaggtgtaagcaccctcaactgagttagctggtacagataacgttggcttggttgatgagtaatcagcattccaagtcccgaccccgcctttagctggcgcagtcatcacgttagtagcaccttgagagccggcaccaggcagttcaaccttcgtggtagcaccaacactggcatcaccagcaacaccattacttggtgtaaccgttggcaacgtgatcgttgcaccagtcaaggtatctgaaccactaaccatggcatcgttttgcacttgaacactccaaccatctttgtgcccggcgttaaccaccgttaacgtatcagttacgtttgtgttatccgcagtgctagtaaccgcatcaccattcaattgaatcgttccaaagtcgatgtctggggccgacttcaatacaaccccgttatcgcctgttcctgtatcactggctttcaaagtagtcttagctgtcgtgctcccactgttagcagttgtgccaaacgtcgccgcactcgcggtagtagcagaaaccaatcctaatccagcaaccaaagcagcaatcgcagcaaatttcacagtcgtcttagtcattatcattatctcctttatatccttgcttgtaatcccctagtaacttacgagcacctcaatgaacgtaattatagatggctaaagcgtatctgttagccgctcatctttcgtgcctatcaacgattcatttatatactagcacgctttgtgctatttgtccactatttattaattgtggtatcaatctttatttagcttaagttaaattcagtagtagctaaggcaaaactcgatagtagcgctgataaaagcgtcatctcacagttcaccttagttattgcagaatctctcgtcaactaccgcatacagtcaaccagtctattctggcgtgttacctaacgtccacgtcaatgttgccgtgtacacgccacccatggcgttagctggcaccgtcatttgtgatttggcatagttaccttgccaaattcccaagccctcttttggggcagcctgcatggcaatttgttcgccactaccagcaccgtcaaagctgaggttgttggcagtcgctgtagagttattgttttcatccaaaggtttagccgccgtagttgtgaatccatacgttgcaccagctaacggctgaccatcagcgtccgtcatggccgaagcagcaactttcacgttccaaccagttgctgagccggcattggttacttgtaaatcatccgtttgggtgccagctaaatctttgatctcattcccggttaactgcgcggaaaaactaacatctggggcggagtctaacttgatcccaccattaacccccgaaaccaatgttgctgaagccgtggtcttttgggttgagtcagcctgcgcattagtcagagagctggtcccaatgcccgccagcaaagctgttaacatcaacatttttaaaattttgtgggtcatcgttgctcccccttttccagaaacacactctattactttcaccgtcggccgctcctgctagtcatcagaagcttatcatggccctctcaatatccatatttataatatcatggtattaattttttgtccacaattatccttctgtggtagagattttttcgaaaaatgattggaccataaacaattatcttgcttattttcgtaaaacgcctacgtataagcattttaaagattatcgtttgattactagccgaccttacttttagccatccatcaaaatgtggccacaagttaaagatgtgtcatgtcgtttataccttacaccaaaattgattaaaaaaaacaacacagtatgcgctttcaatcgtcctatatccttatttacagcataaaaaaggagacaatcgccgtcatcgcggtaattgcctcatacttatcagttttaacttcggttgttaaagctaccatggaaccctttttgaacagacgttggtgcgtccttataggccatctgcttcacatattttccccgaatcatcaagcggttcgcaccggtagcatcacacgtaattaaggtgaccagtttttgcttggtttgtgcgataacctgcacatccgttgccggaatgaacttccgcacgctcacctgatactcatagacgcgcttagcatccgtcagataaatcttttgtccaacccgcgtcttccagtacaggggactgaataaaatcgtctgtgaggtcatatggtgcccagctaacggataattaccttctcccatcttctggtccggtcgcatggttcccgcggtcagagccaagacctcattgctaatccccttagcgattggcaaatgaaccttggactggggcatcaaaatctcaccaacgacatgaatatccgctgtattccagcgggcattggccaccgttgagaaatccaacgattttaccttactaaagtcatatgacgctttcttcttttgattactttgaaccgatttacgtgaaatccgtggttgataggaagagatcaaccagtttttaatctgctcgttgaagattaaggccaacgagattgctaataagaagataaacaaaacggtccatagccaccgccagcggtgcttcttgggtgtttgttttttctctgccattttactttactccaatccccaatttcataatctcttcggttctgaattttacgccatttacgattaaaaacaaagcccggcgcttcaatccaccagatagactatccaacagccaaaccaagccaaacaaaaaaccggtgacagctaagctgcccaccggccagacaaatcataaactttataattagtcgttggataaaccgtacttcttgttgaaacggtccacagcaccatcggcttgggtaaacttttgcttacctgtgtagaatgggtgggaatcagaagtaatttcgacacggatcaatgggtaagtgttgccatcttcccattcaaccgtttcgtcagaagttgccgttgaaccagacaagaactggaaaccagtacttgagtcttggaacacaacttcgcggtaatctggatgaattccttgcttcataatgtattacgctcctttgccctgattcattgactgaaccagagattgattaatcgtcaaccgttgaattataccatggattacgccagccatcaatggctaatcgcgaccattttcaactaaactatcttccacgatctcaacgttcgcattcaaagctgttaatttagccacgatccggtcatacccccgtaagatattatcggcttgatcaatctccgtatcgcccgttgccatcagtccagcaatcactaaggaggccccggctcgaatctcgcccgcctgcacatggccgccaattaagtcatcactcgggtcaaccacaatcatcccgtcttctgatcggatgttagcccccatctttcgcaattcggcaatgtgcttaatgcgcttggggtagatcgtatcaatgatgacactgctaccagccgcccggaacaagagtggcgtcaagggttgttgtaagtcggtcgcaaaaccaggaaatggcattgtcttcacttgaattggcgtgagttctgtcacccggggaacatagatgctatcttcactaatctctagtggcacacccatctcaatgagcttagccgtgaaggattccaaatgttccggaatcacattcttcacaacaatcccatcacccatggctgctgccatcgacaaataggttcccgcttcaatgcggtcaggaatgatcgtgtgggtgttcatcgcccgtaacgttggcacaccctcaattcgaataacatcggtaccagccccacggacgtgcgcgcccatgttattgaggaacgtggcaatatcaatgatttctggttccttggccgcattttcaatcaccgtagtgcccaccgctttaacggcagccaaaatggcattaatcgtagcccccacggacaccatatctaagaagatccgcgtgccatgtaagccttccggacccgtggtaatcttcactgtgccatcatgttcagtaacacttgctcccagcgccttaaacgccttgatgtgttgatcaatcggccgtggcccaatattgtctccaccaggaaagctcagcgtggcccgttggaaccgccccaacaaggaccccataaaataatacgacgcgcgcaagctcttaattgctttacttgggagtggcgcttcaacaatctcagtggggtcaatggttaagaccccgtcttcaaacgtagaatgtacgttcattgatttcaaaattaacatcaaattgtggacatcaagaatatccggtaccatatcaaaacgcaccggtgtatcagccaaaatcgctgccggaattaacgctactgtgctgtttttcgcgccgccaatcgtcacttcaccagtgagccgttggccgccatgaataatcattttcttcattgtgatgtgttcctcacttaaatttacttccatataattccatacagtcaaatacaataataaataatcccgcactaaaagacaaccgtttcccactatttcgccgaaattgtaatataaacatccaaaaaaagcgcgaaaatcatcgcaaaatttaatttttgcccaccaattggcggttaaaaaggttattaaccaaactcttttagcgattctctaacgttaccagtttgagcttaaagctaattaaactgataaaaaaagaatctagcattgtgctagattctgatgtaaaacaccgtaccctaattgcgccataatccatgtaacaaatcgacacctatcagccttcatgacgtcttttaagcattgcacttagtcccgctagtagagccgctacaattaacccaaggatttcggctgtaacactcgcttgccggttgtcattcgtttgtggcaaagtcgctcgcttctgtgttgtagcctgctcacgcgttgtcacttgcttattttctacagcttgcttgttttttgcagcttgctttataggcctaatcgtctttcctaattcaagagccgcagcagtcgcaccggccatttgaactggttgcttaatcttcttcagttgttttacctgaacgactttcttttgcttcttctgtgactttttaacctttaacggctgatcaggcgtcttaatggtaaccgtgtcggcaacataatcaatcgtttggacgtcatcagcactatctggcgtgactgttacggcctgcgttccagtgacggacggatgatagccagagatagctatcgctgggacgctgacaaaggtgttgtcatctttactcgttacccaaccactataaacaacggtccccgtcacgtgatcaaccactttagtccgggtaaaagtaattgtgcttatcgtatccgtatgcagtggtgtgccattgctagcttgataatgaaccgtttgggtaattgtcttagtctctggcgtcgtgtcagttgcgtgggccagacgaacggtgtagttaacaccaccctcactaaacggtgcccctgaggttgggtagtcatcactcactaattcgtagccttgtttaacgtaagccgcaatcgtcgtagccgtgcgataatcggacggtgtatcaggggtaccggacaggctcaccgtagcaagaacggcacccgtggtggtatcaacgtacgtcaccgtggcttcttttgagctagccgtgtacgtcacaacaatatcgttatcttgatcagttcccaacactgacgtattaccagcgaccctcagtatatcggccgtatagcccgcaatcatcggtgaatcgactgctttatagcttccggttaaactactatcattcaaccagtccgtatagacttttgtgccggctacgacgtcaatagttacattacgactaaaggagattgtctgaacattatccatcccagctaactcgccattctcaaattgatacctaatggttcgactaacttttttggataaatcttttgctgccgttccgtttgggtacttcggtccatccggattatctgggttgattggatcacccgccactccgggattgtccggggtgaccgtgatgaatttatgcttcaaagttaccgtatatgcttgaacaattccgtcttgatcatagaccaccccggctgctggatagccatcaacgtccagttcatagcccgccttaatgtactgagcgatccgctccgctgtccgataattcgagacggtctgataatcaccagttaaccagtctgtcgtcagcaccactcccgttgtcgtatcttcataggtcaccgtggctttttcaggattagcctgataataaacttgtacgtctggactgagatccgtcccactcaccgtatcacgacccgcaacactcgttgaatcagccgtataaccagtaatcacaggcgaatcaacagcctcaaaacaaccagtcacggccccatcatcagtcaaccaatctgtgtagacgactgcgccattaacttcatccaccgtgacgttacgactaaaattaaccgcttgcacattgtccggcttagccgtgcgaccatccttgtataaatactgaatcgttcgactgacttgctcagttaaatcctcaaagtcagttccgactggatatgtgggtccgtttggattatcggggtcgatcggctcgcctggcgtacccggattatctggcgtgcgcgttacaaatttatgatcaagcgtaacctggtacttttgaatactgccgtcctggtcatagaccaccccagcagttggatagtcatcaatgaccaggtcgtagcccgcattctcgtatgcggcaatcgtatcagccgtccgatacgcatccgttgttccgtacgccccttgtaaggtttccgtcttaattaccttgttatcagtttggtcaaaatacgtcacgatcgccgtttcagtcttggctaaataaagatacgtcacggtcccaccctgatcagttaacgtgccattataggttagtccagtattgggcgctaacgcatagcccgtcttgggtttgtcaaccgtagtgtaggtcaaatagtccgcggccgttgcgtccgtagcatgtgtcgccgtaccagtttccgtagcatctacctgagtctcaccattagcatccacatgttcgtaaaggtacttcaccgcaatgtcaccaatggtcaaggtgccaggaatgactgaaattgtatagtttttattcaccaaatcatcagcgtcaggagtggccgtgattgtcttagtcccaaccgcactcatgccgtccgtcacacgatacttcaaagtctcgccatcaacggtcccggtaaccaccgccgtcaaattcttttgcgttccgtcagcccaatagacctggctgggaatcgtaatcgtcgctttggcgggatcaattgtcaacgtcccattgacatacgagatttgataattactggtatcggctaccgtggtcccggtcatggcatacgtaccaaccttcgtataagccgtcgcaccactgccatctgccgcaactgtggtaaatgctaactgatcataattggtcccgctagtaacagtggcagtcgcgccatgtgctcggccgtcataaactgcatgatcatccttgaccgtgactgtcagatctgctggcgtgatcaccaacgtcccatccgttgtggtgacattgtagttcttagctaaaattgctgcttgcgtgggatccgctaacgcgtatgtcaggtcgtcataggtaccgacgtctttgccggtcgtcgtggtaaagtccaagtgatcatacgcggttccgttcgttacggccacagatgttccctgagcctgaccattataggtcactgtatcactggctatcgttaacccgagatcagcagccttcacggcaccagtcgtggtgaaaattgctgtatcatccagaatataattcggccccaatgcagcttgaactgctgcccgacctgcgttattaagggtaattgtatatttgccagtgtccgccccggtcaagttagtttcggtaccttgatacgtataagtaaagtctgccggcgttaaaatactttgaccggccttgccaacaacgtcttcggcggcatagtcaatttcgccgttgctaatttgaaggacatttttcttttctgaatctttaacggtgactaacggtatcattgttaatgatcccacatacgcttgtgatggccgaagcatagttaacccgttcacaccagtggtggctgtgatttttgcgggcacaatgttaattgtaaaagtgtaatcggacgtcccagttgaaaaggtggggacaaagtcaacaaaaacattggtcgtggtatcataagcattatatcgttgcataacctggctcatcgcggctttccccgccgcattaatcgtcactgcgtaactaccaatttgattaagcgttgaaaggtctgtatcttcggaatatttcgtgacgtgaccatgcacatcagtatacataacatcaaagtaaccattgacatcaacagagtccagaaaaaatgcatatagtaaattgaccttgtttccgtttacatcttctaagtaattgcccgctgcatcttgaatatagtaggcaacattgttagctggcgtctcatctggagaactaatatgaagtccgatatccgccagcgacgcatcgccatagctcatcgccacggtccccgtagttactaacgatacggtgggctgggcctcagcttcactaaccgcagctgtgacattcatggcccggctagtgatacgattcgtcattggcatagcgttcgtattcgtcgctgtggtagccgaagaagcagcgtcactgttggcattatcagtagttccagcagcttgctgactttcttgatcagaagctgcattactggtggtatcacttgccgccgaccaacgagtattctctgtactttgactatccgcacttgagaccgttggttgtgttgccgccgagtcagaggcagcagcccccgtcgcagcccctgacactgcacgactggttgaagctgccggagttgctgtcgattgactatcactagcagttgaggcggataccgcagcagccgcagtagatgttgcggccgcactactggatttcaataccaccgcatttttagtttctgttggtgaactggaactgacagtagcactgttctcagtctcatcagtgtcactgttcgttgccgccttagcctggtcaacccgattccaactgagaagaccgttataccagcagttacccagcgtctccctgacttataaagcttatagtgagtcttcccttctggttccatcttatttaaacgattccgcacgattctacctccaaaacccagacgtttatgtaaacaacaagctagatagattaggcccaaaaagtttatacatacagttaacgttaaaccagttatttacccccataagacaggcgcttaattaaatcctttaattattagtacctattcaaatggataaaactagttaagaacaaacgtgttaaaaatataattaatctacctgttcccccaaaaaacaaacattacataaaaatgttttctataaacactcatcaattattgaactattcaataggtattatatcattctaactgtactttaacatgtcattcaacatgctattctccttatagtttccgttaaaggtgcaccgaactatcaccatattgcagaagtttctagtctttcatttcctaaatagccaattgacttggttccacaacaaataaacgaccctaagcatcaacaacaaatactcaattctaatccatacaaaccatgtccatgccaagcaattctggtattagaccacaaaaaaaccgtctttgaataatttcaattcaaagacggtttctacttgttgctaactaactattttcaaccagtcggcttattcgctggcattcagctaaccttctgcttggtgcagatcagccataatattatcttgtgaaaaatcatggtgctgataagcggcgtctgccactgggaaatgctgttctagcgttgcaaaagtctggatcatcaccgttccacttgcttggccgaattctagcaagtgaccaccaaagtcatgatcggctgacagaaagtggtgatgaaagccacccacggccactccatcaaataactgcggtgcgtagtagctcagcaaggtcccctcaacctgttttctcttaaaaatactttgatgtcgagccgtttcggctaatgagtcatatggcggttgcgatttagccacagcccgtgtggtgacatccgtaaacgtccccgtcagtttaacagagaagaaaatattgggctgttcagccgtcgccaggatctgtttctcaactgccgaacgggttgccgctatcaccgtcattaaaggcttgtaagccgcaaagtgactgttcgcaaaaggcaacgtaaacgcatccgctaccacattaacccgtcccgcactatctacctgataaggtgtgccgtccagaataatcagttcaccatcaagaccttcacccgtcccaataccggtatcaccatgctgcagtagttcgcccatcgtcaaggtaccagctaacaatcccggcactaagagggctaacgttccgtgttggtataaaactgttgtgtttgtcatgtcatcacttccttttaattgagcacgtccgtaagtaattgtgattttaactgctgattatcccgataatcaactggtatctggacaatcacaggcccgtttgtttggaaggcttccgctaatgttgacgccaattgatccgtttgggtaacccgcagccccttggcaccaaagctttcagcgtacttcacgtaatccactggaccgaagtcaacccccgcatcatgtccgtacttagcgatctcttgaaagcgaaccatatcataatggccatcgtcccagattaattggacgatcggcaactttaaccggacagctgtttctaactcttgcccggagaagagaaagccgccatcgcccgatacggatacaacgggttgccctggtcgctctaaagccgccgccatcgcccaaggtaaggccacgcccaatgtctgcattccattactgaataacaggtgccgaggttgataactccggaagtatcgggccaaccaaatgtaaaaactaccaacatccactgccaccgtcgtctcatccgtcacttgcgcttggagcgcttgaataatagctaaaggatgaataccgtgggaatcatcggcagttggggcaaccgcctgttgactaaaggcgtggcgcaactcagctaagtcatcgtgtacggatgctggcaaggcccactcagtcggtaatttagccgttaaggcgtcaacggttttagcaatatccgcgtgaatcaccatttccggctgataatccgtgctaatctctggcaccacactgtcgagattgatgacggccccgtggcgatcaacattccacaaccgtgcttcatattcaacaggatcatacccaatcgcaatcaccaagtcactgcgtttcaacagattatcgccaatttggttgcggaatagtcccacccgaccaaagtagttatcctcacccgcatgtgagacgacaccggcaccttgaaatgtctctaccactggcaggtctacttgatccagtagccggcgaatagcagctgtcacgtcgctggcagaagcccgcatgccagccaaaattaccggcaatttagcggctttaatctggtccaccatggccgttaaagtggcttcatccgccactccctgttgcacgggcgagacggtaccaatttccggccgttcgacgggtgcacttaacacattttgcgggagcgatagaaacgttgctcccgccttaggggcctgcgccagtcgataggcgttagcaaatgcttctgacaggttatccgcgtgttgaacttcaacgctactcttagtggcggttgccaataattcttgactgggaatgctctgatgcgtcaatcgcccgagatcatcttggggcacttgcccacccaaagcaattacggggtcgccttctgctgtggccgtgattaagctggttgccagattggagacacccggacccgacgttgtggcaacgacgcccggtttcccggttaaccggccaattccggccgcaatcaaggccgcgttctgttcgtggcgggtcacaaccaacttaggtgtccgcgggtcttgactgtattgaaggctctcaaataactggtcgaccttcgcgccgggaatcccaaaaacatacttaattccctgattaatcatactttgaattagcgcttgcgcgccgtttttagtggttggcatctattcaacctcgcttttttagtttgcgttcatgtgtgttgacaaatcaacatacggctatcataataagtttaagttgttttgtcaacacagacactcataaaggaagaatacgcatgacagatcttggttatctcgcccaaaacatttctattttgcaccgtaaatactataaggatactcgagccgcctttcaggaacttgggctaaatccgactgccgcttgtgtgttgctaaccgttcacgagcatcctcacatcaatcaaaatcaagtggctaaggcgctcgtgattgataaggggctaaccactcgtgaggtcaacaaattacaagctttagactatctggttaagaccgccggaactggaaaatccttaaacttacagctcacatccaccggtgacgccatcgtcagtcaggttcaaaccatccgccggaactggtggcaacggcgctttgacgaagcccatattgacgccgacagccccctcattccagcaattgaagcagcagttgctaatgtcacgcaggtggattaatcgttacccttagataccgtaaaaagcacgcagttcactgaattgcgtgctttttacggtatgatttaagttgattgtggccaattaatgccaataccgatgccaattaattggccacaacaaactgtcggttagctgtaatatatccgccagctactcggtaacgcaaagtcccggataaccttgggttacgcccatgcgaatagtcccaaccggtaacggtcagtgtctttcccggcttaattcgcttaatgaacgtcgacccattaacatctcgatagagtctgatcgtccgcttaaccttaacttgtttaaccagccgaggtttggttggagaaacccattgcttattgccagtcacgtatgttccgttggtcagttcataacgcgttgtttgaccaacctgagtctgtttaacaactgttaaggctgttccctgtcggtaatgcttctgtttggttgcttgtgcaaagcgcgtcccatcgtaagcattcgttcccttaggatttgtcacgtataatttttgatacatgccttgccaataaagggcaccaacataatcagcgttggcggtcacgtaagtcccatctgctagcttgtatcgtaagtgcccactggtagatttggccgttccgacaacttcaaagattggcgcataggctttagatttttgagcataatgactcacgcgttgattcttcttaaatgtggcattcttgtaagtgtatagcgcccgcttgccataaatcttgaatggcgtaaaagtagtcgcctcgtcagcggtgctggaactggctgacgactcagtagccgtcggggtggttgggttagctttgtaggtcacggtatacgtcttttcggttggcgcaaaggccaccgctacttctttttgatccggggtgtaaccggaaattgttggtgatttcgccgatacagtagtcaaccctgcataaccactgagtttagctgaaggcgccgcttctgtaccatctgcgaacttgtagttaacggtggcatgtaagagttggtcttggggcacactggtgaatgtctgtgggccttgattcacgtcaacggggaatgtttcataatcactgccatccatatccatgattcttgtgagtgtcatctcttggcctgttcctgcattgattacgaaagcatcgtcaaccagatacttggccgatatcgtaaatagtcccgttgtataggccgaagttgcagtcgtcgttgctatatccgatgtttcaccactagcattgagctgattaatgataattttagcggtatatttattgggttgtccaggcaagactatataatagtgtcctggactcttagtgtattctaccggcttttctgttggcatattttcgagatcagctgtattcattgacgtatgatcaaacacgttactgatagtcgccgcagcgtctgaattaatgtcagagattaaaaacaggccatttgctattgatgagtattccatcatactcctttttaccaatgcagaatctgaatttaagtcagagagtatatccccgaaagtcgtcgaatccgagaccgttatattattgtctaaattaatagatgctatacaaccttccggcgcggagaaaggactctgcgaactaatactcggtcgcgtatcgggtaccttcccgtgccatgccggtgtataaacatctagtgtctcttcatcggtggcggttgtatcgtcggccgccgcacgaatcgctggccccccaagtagcatgccagttatcaacatggctaccatcaaaaaccatttgaatatccgttgttttctcatcactatcccacctcatatgtaatttgtcatgtattacagcacgattaataacacgcgttacaacaatgttaattataaacctttattatgtgaacaaacgctattcaagtcttgaaatgtttccgcttacataaaatggataagaattaattttacctattctcatgccattgattggtctcatagctttacgtcaatctgtcacccttcttcaatttctcaaaacaatctatttagtacccatcctattaacattaacaatcatccttaaccacactaaaaagacgctagccgcgctagcgtcaatcactccatgattaattccgccatcctttaccccggactattggttaaggtccacgtcaactgaccgtgatagtttccgcgactggcggcactcgacacatgtaatcgaatgccagtggtgttctgccaggtcccagtaatatccgtaacttggctgggctgcgtattggtgctctgggcaacctgcacggcggtggccaagggtaattgcgtcccgtcggcgcggcaccacaccatttcccctgccagtctacgctgcgtggtcgtttccgttaactcactcgcttgaactgtcagttgccaggtagtccccgttcccagtgaattctgtacctgaacctgccaatccggattccgattaatcagcatctgttggcccgacaagatcgtagtcacaaacgaactggtcttcgccaattgactaaatgctaatttccctgccaccatcacggttgtcgcgatagttgcagaccgattgccgcgcgaatccgtcacgtagaccgtcacggagttagtgccactgattaatttatcagccggtaaggtaagcgtgaaagcccccacctcatttggactcgctgttgttccatttaacgtaaaggtcggcaagggttgaccattcaagctggcgtgaacggtcacctcatgattattcacggctggctcgccagccactgacgccagccccgttattgtcgcgttactccccggtgctacggtagcgccagcccctgccgtccagtccaccgaccattgacgagcgggataaatcgtatagttaggtgccgtactggtcatcacctgattggtgcccgcaaaggtggcttggctatcagcaaccggcgtctcagtagtcacagcggccacccgtccggtcaactgaagcgtggccgtggtgttcgtggacgacagactcttggttaacacatgtgtcacaggattgctactcagcgctgtacttggtagcgtttcttgactgccatccgcataggtcaccgtgccgctttgccaggtcacattgggaatcgtcggtaactgcgccacaatattttgccacgactgactcccaccgacataggttagctgatgccgataactcactgtgtccccaccgttaacgtatccgtcagcagtgaccggtcgtgccagcgattcatctgtgatcgtggttttcgcctgcgcattgaccaatcctgggatgtgttcaaaggccaccacgttattagtgccaaaggtcccggacacccctgtaaagccccaagtaactgtcttagtagcatccgtcacattaatgcccaatttactcaggtctaaactaatcgtggcactctgcccggactgactcgctcccgttgttggattcttgtcattgaaggtatacgtcatacttcccgtattgctgttgtcggttggcgccgtccaagccaacgttaagtggtgccacgtgccatccgataaagtcgtattaagcttgccctgatgattcagaaaataaaagtatttagcgccactcatcgccgtcccatttctgctgtaactggacacctgcgcggggtaattagatgcaatgtgctgggtcgtggtattgatatagttgtaatcaaacccattattatcgccaccatcacgactatcattgacctgctcatcaaactccaacgcccaacttttcggtatggcagccgccgctacggccgttgcatccgctgctgtactattgaagtccaggccccacgttcccagcgactggcccgccatgcgtccagccggaatagtcgtaaacccagttgcaccggcattctgcaaaacaaaggtcattccctgtccggcactccccgccccccctttccctaggtacagccagagagaaaaggtcgcatccttgctcaaatcaaccttatagttattggtagcccacgccgaaccagcgtgattgttcccctcggttatttgtaacccatgattgttcgcaaccagtgtcgccgtattagtaacgttggcaattgagctggtcgtattaaatattcccgtaatcgccatactaggtggcagcgtcgtggttactgctgtatctgtcgcttgggccgtgatccccccgaatcctagactgctcagaataccgacgactagccacccccaaagttttcgcatcttgtccccctcctcacaaccacgtagtcatgcgcggataatcctgactcacctgtcgggctaagcataacatggtgaactaattttcacgtactaccatgtcgccgataaaaaggtgccattaccaactaaatatcgcaaaaaagcaccaccgactttaagcggtgatgctcttcttggattttaaactttagtccttaacctctcgactggccgctgccacaaagtcgcggaaaagaccttctgggcgatttggccgtgacaagaattccggatgatattgcgcagccacaaagaacttcttttctggcaactcaatcacttcgaccaaatgatcgtcaggtgacgttccagaaaagaccaatcccttggccgtcatttcgtcacgatattggttattgaattcataccggtgacggtgacgttcttgaatcatctcttggttatcataggctgcggcggcccggctccccgctttcaatttgcaagggtacagccccagccgctgcgtgccgcccatttcatgaacgtcagcttggtcagccatcaagtcaataatcttgtgactcgtatctggattcatttcagtggagttggcatctgcataacccaagacatcacgggcaaattcgatgctggcaacttgcatccccaaacaaatccctaggaatggcacgtcttgttcccgtgcgtacttgattgccgtaatcatcccttcgataccgcgatcaccaaagccacccggaacgatgattccgtccgcagatcctaaaacatcttggacattatcatccgtaatcttttcggcatcaatcatctgcaaatcaatattggcatccactgggtaaccggcatgttgtaaggcttccgccacagaaatgtaggcatcatgcaaagcgacatacttcccgaccaaagcaatcttgatcgtccgggacaggtgctgcatgtggtcaaccatttgggcccaagcggtcatatcagctttgggtgcctgcacaccaaagtgatccaacacaatctggtctagcccttggtcttgtagacgcaatgggattgagtagatagttggtacatccatggattcaaccacggccgatgggtccacgtcacagaacaacgcaattttcttacgcatatcatccgtgattggtgcttccgtccgtaccactaagatattgggttgaattccaatacttcgcaattcgcgaacggagtgttgtgttggtttggtcttcatttcatgagccgcatgcaagtatgggactaacgttgtgtgaatataaaccacgttttcgtcaccaacctcggccttcatttgccgaatagcttccaagaaaggttgggattcaatatccccaacggtcccaccaatttcggtaatcacaaagtcggcgcctaaggttttacccgcacgcatgatcttttctttgatcatccccgtgatatgtgggatgacttgaaccgttgcgcccaagtaatcaccatgccgttccttttctagaacttccgagtaaatcttaccagttgtcacattggagtatttgttcaaattgttatcgataaaacgctcgtaatgacccaagtcaagatccgtttcagtcccatcatcggtgacgaagacttccccatgttgataagggttcatcgtgccgggatccacgttaatgtacggatcgaatttctgaatggttacgtttaaaccacggttttttaacagccgtcctagggaagcggccacaatccccttacctagtgatgaaaccacgccgccagtcacaaaaatatatttggtcatgtgctaactccttgtaagattatttagggtcgtccggtagccatttaaaactataaaaaagctccctatccattgcgaatagggagctcaccgttcagttgtcctcactacaagtagcaaggagcccaaaaaatataatacctgcttttggcaaagaggtcaagcgaaccacgaaaattatttttgattttcgtcgtcgttttcttcttcgtcttcgtcatcagcctcatcatcgtcagccgagaagtcgagattttcatcatcgtcatctggtgcatccatttgtgagagctgatcttcgatgccatctggaatatcttccgtgtcatcttcttcgtcatcgtcgtcgatgcctaagccggtctgtaatttacccaaatcaggggtcgaaccggttccggaagtaacatcatcatcgtcgttgtcgtcaacgtaggtgctgttgtcatcatcttctggatcgtcatcgtcgtagtcgatcacgtcatcatcatcggtggtgtcagctaagaaggcattaaccttcttccgcttcttacgcttaggttgatcttcatcttcctcagcatgaaccgtcgcttcatcgatggattcaaacggataccaagttcgcagtccccaaaggttatcacccagagaaatgaaactaccatcgacatttaaatccgtataaaattgggacagccggtcacgaatctcttcgtcgctgtcgcccaagtatgattggacggcgttagctaagtcagcaaaccccatcacgtcgccgtgctgcgacaaaatagcatgagcgacttcaatcattgataattcctttttattctggccctcaaagacttttaattccaaactggtgcacgtcctttccacagtctactaaacataatacgcgtttatgccgtaaattgcaatcgaatcttgtagttcccaactaattcctcaccggcatacaagaggtaatcaatcttgacgttgccactgaaggggcgttccttgaaactcgtttccaaataaggcgttaccgtctcaattggcatgataccatacggtgttttataccgggcggtcacccgtttaccactgacaaaatgtaggcgtaattcagcctccgcattacgggtcaagtggacctcaccttcagaggtgaatttcatggtcactggggtcttctcacctgtttcgtcattgggttccaaataacgcagataaaggttttggcccatctgcaccagttgcccatctacatccaattggtagtctgaaacattatcgtcttgtttgatgtgtgtttccaagtgaatcatcacgggaacccccgttgataattgatccatttacacccttcctttccattgaattgtctggactaattataagacatttgtcgccgaaagcccaccaattatcacggaatctagtgaatcataccgatacccccactttaagtggtgccttgctggacggtcctcgtcatgtacttcatgaacatcgctgtggtaccttatagggccgccttccagacacgtgacttccgggccaagactggttgaaacagttacagccgcagatagtgaccagcacatcaatactaacattgccataccaccgtagtccggcgggaagcggcaaatgggctcagtaccgtcgttatccttggtgcgcgttttagctcgcttaggataagaccgagctttaagacaagtgacctgcctggcttcaagtcgtgtccggtacgttccagcccatttaccgcgaccagagggcggatagtcaccacctcaattaagaaaccagcggcccagagcgcgtacttttttcaccaccactgaatcaatgatgagccaagcttacttttagcgccacttctagtataatagaaaataggtttcacacggtcgggaccttgccaaccgtggactgaatgaaagaaggtaggtaccatgtttctcgacctccccacgaataccattcaaactgtgaccactccaattgcgaccacacaaaaaaatcaagcgtttggctataccaacgccctcctcgacctcgtagccgagcttaaacagccaattcttcacttctggaccatgcagcccaccgttatcatgggattgaaggacaaacgcttgccagaccttacagcggccattaaggccattcaacgacatggttacgattacgtcctcagaaattctggggggctggccgtggttagtgatgccggtatcttaaacatctctctgtttgccccattaacgacacctccaatgagtgtcgatgctgcctatgcgcaaatgactaccctggttgatgccgcctggccggaattggcaattcaacattatgaaatcacccattcctattgtcctggcgattatgacctgagtgttaatggtctaaaaattgccggaatcgcccagcggcgtagtccccacgcgctggtcacgatgctttacctcagcgttaatggtgaccaattggctcggggccaaatgattcgtgatttttacacagccggtctggctggacaggaaaacacgtgggactttcccgatgtcgaccccgctaccatgaccactacggccgcgttaattggacaaaacttaatggtagctgatgcgcaacagcggtttatcactgctgctgaacaggcgggcctaaaagttgggcgaacactactcgcacaggcgatggcaactcccgaatttggcgcccacctggaccacgctaccgcccaaatggcacgccgccaaccacagcttaataaggaggactctctgtgacttacgcacaacaacgacttccccgagaaaaagttctccgggacccggttcacaattatatttacgtccaacatcaagtgattttagatctcatcaatacccgtgaatttcaacgactccggcggattaaacaactcggaaccgcctcgttaattttccatggtgccgaacattcccgttttggtcattcattgggtgtctacgaaattacccgccagatttgcgataatttccaacggaactatcctatgaagacccccggtgacggtggctgggatgatcgtgaacgcttaacagcattatgtgcggcactcttacatgacatcgggcatgggccgtattctcatacatttgaacacatcttccataccaatcatgaagccattacagttgaaatcttgacttcaccggaaaccgaggttaaccaagttctccgtcgggtcagtcccaactttcccgaagcagtggccagtgttattcaaaaaacgtaccctaacccccaagtggtccaaatgatctcgagtcaaattgacgcggaccgcatggactacttgttacgggacgcctacttcaccgccactcaatacgggacctttgacttaacccggattttgcgggtgatgcgtccctaccaagggggcattgcgtttgccatgaacggcatgcatgccgtcgaagactatattgtcagtcgcttccagatgtatcaacaagtttattttcaccccgtttctcgggcaatggaagtcatcttggatcacttactgggccgcgccaatgaactgtatcaagcggatcaaacggatgaaagttttattccccacttactgttaccattctttaatcggcagtttgacttacaagattatttgaatttagacgacggagtgttaaccacttacttcacccactggcggcagtcgccagataagatcttggctgacctcgcccatcgcttcttagaccgcaaaccactcaagagtgtcgaatatgatgaggcaacgcaagctctattaccgcaactgcggcaactaattcactcggttggcttcaataccgactactatacggccacggacaatagctatgatttgccttatgacgatgcctatgatccccggatcacgcacccgctgacccaaatcgaacttcaagaacccgatggcaccttgttggaattatcgacggtctcagatttggtcaacgccattcggggtaagttcactggcgatcaacgcttcttcttccccaaggaattactcaatcccggcgatgacgccccagaaatcttccaaccaatctatgacaagttcagcagctatattcaaaataaccaactgattcaacccaaataaccactttcatttcacattaaaaggagaatcttctatgaccatcaaactcatcgcaattgacatcgacggcaccctactcaatgaaaaaaacgaactggctcaagaaaccattgacgccgtacaagcagctaaggcccaagatatcaaggtggtactctgcaccggccgacctttaactggcgtgcaaccgtaccttgatgctatgggtatcagtggcgatgaccaatatgccatcacctttaatgggtccgttgcccaaacgatctctggtaaagtcctcaccaatcactcactaacttacgaggactatattgatctggaagcttgggcccgcaaggtacgcgcacatttccaaattgagacgcccgattacatctacacggccaataaagatatcagtgcgtataccattgccgaaagttatctggtccggatgctcattcggtaccgcgaagtcagcgaaacacctcgtgacttaacgatttcaaaggccatgtttgtcgactatccccaagttatcgaacaggttaaagctaatatgccacaagacttcaaggaccgattcagtgtcgtccaaagtgcaccctacttcatcgaagtcatgaatcggcgggctagcaaagggggcactctgagcgaactggtcgatcaacttggtttgactgcggatgacgtgatgaccctcggtgaccaaggcaatgatttaaccatgattaaatacgctggcttgggtgtcgcaatgggaaacgcgattgacgaagtgaaagaagccgcacaggctgtcaccttaaccaacgcggaaaatggtgtggccgccgcaattcataagtatgctttgaacgaaaactagcctgcttttagcctagttttcaaaaactcccgcctatataacttcggtcaacgcttggacaatccggcgttgaccgtttttattttgatcccaatcagcacacagccaatgcccccaatctgttctcattgatttaattatcaaatatttattaacgctacccctaatactttaaaaatagccgctgagaatcctaaacattcggtattctcagcggctatttttatacacaaaaaaaccgttacccaggcgttttcacgcttgagtaacggttcaaaatgttcacaccaacttgtggcgtttcaattttagttaatcaaagaattacttcttcaatggcgtccattgccacttagtgaattcttcaatatcgcgaccttcgtcacgggtaatcttaaagtgcttagctaagatgtcgtccatcttcttgtcgaaggccttgccggcagcttcgtcgataacgcccttggcaatcaaggtgttaacagcatccttagcttggtggaaccgatccaattcggagtatacacgcatgtcgtaagcagtcgtgatatcaccatcttcacggtaaccatgaacatgtaaaccaaggtgttgacgttcgtagaagaaggattcgatcaagtcttcgtaaccatggaagccaaagacaactggtgtaccagattcgccgaagaatgaactgaattcgctgtcgctaagtgcacggtcatcgttcaatgggccgttcttcttttgcagacgttctagttcaacaacgttcacgtaacgcatcttaacagctgggaaagcatcgttgatcaagtcaacagctgccaacgtttcgatggttggttcaacaccagcagaagcaaagacgatatcagcatcttcaccttcagcaacagtagaagcccagtcgatggtcttaagacccttcgtagccaattcttcggcttcgtcgattgagaaccattgttgacgaggttgcttagaagcaacaatgtggttaaccttttgacggtccttgaaggcccggtcaaagacagctaacaatgtgttcccatcagctggaaggtattgacggataaagtcagacttcttttcagccaagtgggttaacatacctggatcttggtgagtgtaaccattgtggtcttgttggaacacagtggatgttgaaaccaagttcagggatgggtaatcattccgccatggttctgcagcggcttgacgaatccacttgaagtgttgcgtggtcattgagtcaacaacccgcaagaatgattcataagaagtgaacacaccggtacgaccagttaaggtgtaaccttcaagccaaccttcagcttggtgttctgataattgggcatccaaaatacggccttctggagcttcatattggtcatttggttccttgaccttactcatccattgacggttcgtaatcttgaacatttcccaaagacggttagacatcgtttcatcaggtccgaagatccggaatgatgatgggttctttgtggcaacgccagcaaagaaggttgacagaacgttcatatccatgttcttgttgccatctggtaacaaagtcccacggttagattcgttgatgtcgttagcgtagtctttccagtttggtaagtcgagtgtttctggcttttcgccacgagcacggccaccattagcaactgggttagcagccatccgcttgtcacccttaggtgcaaagtcagcgacttctgccttcaatgaaccgtcagtattgaacaattcagctggcttgtatgagttcatccattcttcaaattcagggagttccttgaagttgttttggctcagaccaagtggaacttggtgagcacggaatgaaccttcgattggatcgccgtccaagttcttcttaggaccgccccaaccctttggtaagcgcgcaataacaactggccaagctgggatagtcccatcttcgtacttgccgttttcacgagcgtctttttggatttgcttgatatcagcaattgcttgatcaaataacttagccgctttttcgtggtaagtcatgtaatcatgaatgtcatcgttttcgaggaaacgaggtgaccaacccaaaccttcaaagaacttagcgatcttgtcatcgctcatccgtgagaagatcgttgggttagaaatcttgaacccgttaaggtcaagaattggcaacacagcaccgtcgttcttagggttcaagaacttgatggagttccatgcagtcattgcagggcccgtttcaacttccccatcaccaacaaccgtgaaggcaatttggtctgggttgtctaagacagcaccagttgcgtgggaaagtgagtaaccaagttcgccaccttcgtggagagaacctggagtttgagcagtcatgtgagaaccaatcccacctgggaatgagaaccgcttgtataaacgggacatcccttcgaggtcttgggtaatttcagggtaagcatccgtgtaggtgccatccaagtaagagttggttaccattacttggccaccgtgaccaggaccaccaatgtagaacatgttcaagccgtacttgttgatcaaacggttagcatgtgcgtacaggaaagtttggccggagatagttccccagtgtccaataggcttaaccttaacatcatccttttggatgggtgtgtttgtaactgagaacaatgggttgctcttcagaaaaatcataccaccggaaaggtaagtcgtggcacgccaccaagcgtcaactttttccaagtaagacttggaatcgtaatctactgccatgaatttttacactccttcttcaagtaacataacgtcaaaaaaccatcaacgtaaatcacaagaggtcaatttacactacctatgatactgacttttttcaaaaagtcaacattatctgaaattgatacggtccaattccaaataattcggttctcattatgccatttcacaaacaccccttcaagtaaactgctcaactttaggcaattttcttcaaggggtgcttgcttgtgtaagagccaaccgctagtctgacaagtgttctagtcctgatccagattcacaaacgtattatatttcagatactgataatgcaagcgcatattggaaacttcaaagggggtaccgtcatctaagaagaaaatgcccgccatgacgccaaccggttcagttttagaaagatttaataactgctgatcttctctggttgatggctcagccgaaattgacaaaaaagaacgactgacagactgtcccttaatctcttgtaaataattaaagattgagtgctgggcaactgtcggcgttaatgccggcaaaatcttaatcggaatataccctgtttcaataataatgggtcgctgatcaaacaaccgcaagcgtttaatctgataaacaaaatcagtactttctaaaaatagatcttgttgcaactccggggtggctgcaatcacttggtagtctagtaattcactcttcggttggctatccccgacctgaaagctatccgtcacacccaaatttttcccttcatagtgaaaggccgatttattcttcaaaaagaagggattaataaaggtccccgccccacgttttctaaaaacaatgccctgctcagccaatcgattcacagcccgctttactgtactacgactgacttgataccattcgcttaattgctgttcatctggcagtcttttagtggcaaaatctccagccagaattcgctgtttcagatcatgaatgacccgttttgatacgctatctaccatacaaataactctcctaaaaactaactcacacgttcacatcatttgcgttcagtataccagatttttctgagtagtcgcagcggttcttccccagaagcatcttggctaactatcatgggcaaacgtaacttcaccctttagcaatttacccgattttttaaataactggcctaaccaccctgaattttgattattttcagtagtccttgacccccctcagttccttaacgtggtaacctattcgcaatcgagaggaggtgacgtgcgatgaacaccagagatttcgctggtaaggtcggctgtaattgtagcaccctgcggacttatgaacgggcggatttgttgattcccaaacgaactgctacgaatcaccgcaactatacaatagccgacttagcaacctatcacattattcatagcctacggcgggcgggcttaccattaagtgatattcaccatattcttcaactccgatcggcagatgttaatgccacgtgttcggcggatacactgcggtttatcatgggcaaacacagccaatttattgccgatcagcacttttacacggcgttatccggactcactgaccaactctcagccgccctcacccgttcgaccgtctctcgtagcgaagtagaacggatgattgaagcaatcggtgaactggacgatcaagtcatctaagataacctgttacgctggaaattatggctggggggacccccagcctttttgagtataaaaaaggcagtcgtcaacgactgtctttaagtcaaatttaaatggtaaaaacgattcccaaaatcacgtagcagacacctgcgactaacccaaaacgggcaggggcattgatgacaatggggctgttttttacgcttgccacgtggcgcacgggtactttctcatctggcaatggctccaccttttgtctaaaggcgcggcggaacaatcgccgagtccccgtcaatagatgcccgcgtagcaacacacagatagcaccaaaaacaattaaggctagaccaaccatgaataataaattaccaatggttaacaatgactggcctaaaatcttcatcactaaggccaccaataagcctgcaccaaccgttccggtcgctgctcgttgccatttcttcatattgtcattcctcactctcgcagccaaacctaatcccatctattgtccatcacttaatgaaaaaacttgagccaacgcaccgcgccgctcaagtttttagatgactttattgttcttgactgtgaaaccgattcttgaacaatggactgactgggcgattctcattaatccgcttgatagcttgacccatcagtggacccacagaaatctgttcaaccttatcaatcatcttgtcagcagttaactgaatcgagtccgtcaccactaacttcttgattggcgacttcttaatccgttcaatagctggcccagataagaccggatgagtacaactagcatacacttccaaggcaccggcatccattagagcttgtgaccctaatgtaatcgttccggctgtatcaatcatgtcatcaatcatgatacaccgcttacctttgacgtctccaataatattcatgatttcagccacattagccttaggccgccgcttatcgataatcgcaattggcgccttcaagaattcggctaacgcccgggcccgcgtcacaccaccatggtcaggtgaaaccacgaccgcattttcagccaaaccactgttaatgaagtagtcggccaggagcggcgcacccatcaaatgatccactggtacatcgaagaacccttgaatttgagctgcatgcaaatcaagtgccaagacccgggtaaccccggccgtttgcaacatatttgcgaccaatttagccgtaattggttctcgtgaccgggccttccggtcttgacgcgcgtacccgtagtacggaatgaccacgttaatggttgccgcactggcccgccgtaacgcatcaatcataatcaacagttccattaagttatcgttaacgggagctgacgttgattgaatcacgtacacatgacatccccggacactttgttcaatgttgatccgaatttcaccatcactgaaacggtccaccgacgttttccctaactcaacaccaacctcgtcagcaatcttttgtgccaacggtttgttggagttcaacgcaaaaatctttaatttagggtcaaaatattgcgtagccataatttcctccaatagcattagtctgcctgaatttcctacaacaattttatgctatcgcgtcgggaaacacaagaccttccgcttaatcttcaccgcgataaggtagtttctgataataattgggtttattcgtttggcgctgacgagcaattgccatatcgtagcggtttacggcatcggtaattgtagagccggctgcaataaaactatggtcggcaacgtctagtggcgcaaccaaattagagtttgagccgataaaggcatcatcccccacgacagtttcatgcttgttcttaccgtcatagttgacgaagactacgccacaccccacgttgatgttccggcctaatttagcgttacccacataagtcaaatgccccactttggtgccttcaccaatcgtcgccttcttaacttcaacaaagttccccaaatgaactttaggtccaatgtgagattctggccgtaaatgactattgggtccaatgttcgacccactggccatatcggaatcttccaataaggacgaggttactgtgacgtggtcagccagtaccgcattccgtaattcagagtgggcaccaatgtaacagtcctccccaattactgtgtttcccttcagtaaaacaccaggttcaatgatagtatctgcaccaatcttgacacctgcatcaatgtaggttgtcgcgggatcgattaacgtcacaccatcacgcatgtgggcttcgttaatgcggtcacgcatgattttggttgccgcagacagggcgacccgatcattaactcccatcgactcatcaaaattagccatttgataagcagccacaatgtctccttgatgcttcaaaatttcgatgacgtctgtcaggtaatattccccttgggcgttatcatttgacgtctcatggagcgctttaaataacttttgattatcaaacacgtacacgccggtgttaatttcgtggatttcttgttcttcagaattggcatccttttgttcaacaatcttttccacgataccaatattattccgaacaatccgaccgtaaccggtggggtctggcgccattgacgttaaaatcgtggcagcggcatgtttggcttcatgataagcaaataaatcttcaaacgtctctgcccgaaataatggcgtatcaccactcacaattaatgttgtgccggcttcatcctttagcatgggttcggtctgtaggaccgcatgccccgtccccagttgttcggcttgtaacgcgtattgcgtccggtcgcctaacgttgacttgacctcatcagctccgtagcccacaaccgtgacaatcttggacatatctgtcttttccacttgcgttaatacgtggtcaaccatcgctttgccacaaactttgtgtagtaccttatacagttttgacttcatccgagtgcccttaccagcagcaaggataatagtatttctcgttgtcatttaacgatctcctagctaatttaattgagtagttttgtcaccaaaaatttgcgttaaatagtttccgggcgcaaccttgatctgttcatcttgcgtttgaatcttgaccagagacgtatatttgctaaccgttcgttgcccagcaaaatccccttcagcaaagacggcgacacctgccaactgggaatcaaactcatcaacgagggagcgcagaccaccgactgtcccgccacccttcatataatcatccacaattaatacacgtgaaccgggtttcacacttcgcttagagagtgccatccgttcaatacgtttagtcgagccagaaacatagttcacactgaccgtcgagccttctgtaatctgtgaatcgtgccggacaatcacaaatgggacattcagataattagccacactctgggccaatggaatccccttggtggcgacagtgacgacgacgtccacgttttggttcaaatactgggtggctaaaatccgcccaatctgccgtaatgctgctggccggccgaggatatctgacatgtagacgtaaccaccgggcaaataccggtcggctgcagacaactcatcaatcatgtcttccacaaaatgttcggcttcttcacggagaatataaggaataaaccgtgccccgccagccgccccgggaaccgtttctaacaagccggtaccgcggttctgaaatgtccgtttcagaatcgttaagtcttcactaatcgaggacttggctgattcgtaacgggccgcaaaaaaggtcaatgagaccaattgatggggccgttctagtaaataccgggtcatatcgaccaatcggtcacttcttctgactttcaactacttcacctcaactattttctatcaatgatatgtaaggccaattttagcataattgttcgggtttttcgctatatttccgtgaaaaatctgaaaacttgcggaattttaagaaaaccaaccattactcacagcttattcgctgtaaaaatcagtcagttccgcatgctctcccttgctgatccgccttccagacacgcgtctcatgtgagtcgctgtgaatattgggctaggctttgtggtaaaggagacaaccacgagtaatttctaatgtgccagcatcatgactcggtgctattaattcatcaaattaagtaaacgttctaggcccccagtttgcacattcaccaccgtattgaaggaataaatctcatctcgtcactactaaccaaagtttgaccaatttaaaaacaatcccacctcataactgtactttctttgtcatcacgtataataattataacaatggggaggggatcgtatgcaccacaatatactggcacttcgcatgcaagtgactgctgattttagtcggccactgaactacgttgtttcctatttgcaaggtctgccaatcttcgtattactcattctcgtaaactgccggtttatccctggttactttattttcaattgagatgctacctcttggtacttcactctttgctatagcctattaccaattgcccaaattctcattgccaagcgcgaactaacattcagattaacaacacatgatcattttaatttctcaagaaaagaccccatatttttctcaagtgttttgcaacttcctatttatgatagagaaaaagaattcttagatatccgagtagccacgctgttcatagaaatgatcgctatgccaatcattctgccagttctgacattttcactatactttaggagaaaaaacgcatgaaaaagcaatatgcaatagttgcgttaagattatctttaggtttattttttccgaatatttctgtttcaaatatatcagactttgcaagaactagtaaacgggacgcagaccatcactggcctacgtcccgtttactattatctattctgctgtttgaagtcgttgccatcccaacgcaataaagtagaaaattgcctcaattgccgcgatgaaaaacgacacgggataattagtgacatagcttagcgttaagccggcccagactccaattagcgccaacccaatcgccaggaccatcatgccactcacggtatgggcaaagtatttggctgtggctgcaggaagcgttaataaaatgaagatcagtaacgaccccacaatttgggccgccacactcacactcaaggcgactaaaaccaggaaggtgatggataaggtattggtccataaccccttaacccgggcacctgtatggtcaaaagaatcgaattttaagaatcgatagatcacaaagaccacgattagaactaagatggatagccacaacatctggcgcacatcactggcactgatgccaatgacgctaccaaataaaatactggttgcgtaactggcattcttattggctaatgacaagaataaaattcccaacccaataaataatgccgagatcgcactagtggcagcctcccgccgttcactccgcgcactcaactgaccaacaatgaccgaactaacaacggtaaacaggagcatcccgttcagcggcgcccagccagcgaagaccccgaaagcggccccggaaaacccaatttccgacaaggtatgggtcaaaaatgacatattccgggcaatcacgaagacccccataatgccacagataatcgcaataatggttcccgccgcaaaggcgttacgcataaattcataattaaacatgttcaccctcccacaccttctcttgcgttagccccgcaatcggtccttgctcggtaccttggggggtcaacatgaggtaacgtgaactgtacttacgggccatcggaatatcatgggtgacaaatagcaccgttaacttcaggcgttgatttaactcaacgactaaatccagtaattcggtcttggttactgggtctaagctcgccgtcgattcatcgagaatcaacaagttaggcgcctccactaaggcttgggcgagataggccttttgtcgttctccaccggaggcttgaccaatcggccgcttagccagcgtggttagcccagtttccgtcaaaattcgctcaatttttttccgctctgaccgcgataaccagggccatttccaccccgtgaggtttaagccgataaaatcttgaatggtcagcggataatcggcatcgatgttacgaaattggggaacatacccgatcttgacatccgcggtatgcggtaagtattgcacctgtccgtgtgttggccgcagttggtgtaggatcgtgcgcattaacgtggtctttcccaccccatttttaccaacgatactccaaaattctccttgatggatcgttaagttcagatcggtgaaaacggggtgattggggaaggtcacgcctaaatgatctaattttaaaattggcgttgtcgtcatgagtgactgtcctcctgaatccgtttgacttgctggtactgactaagcatccacgtacgatagctttgatgggccggcatagtctctgtgaccttgactaccggcacatgataccgtcgtgcgagttgcaccatggccgtcacattcttgctggaattttgggtattttctacaaaaaatgcgatgcgatgatgtttgatttgcgcttgaaggtgggtaatatcggccggagtcggatcgctgtcctcttcgatggcctgggcaaagtgcccgtcactcacacgataccccatggccgtcaaggcaagatcgaaaacaggttcactaaccgccacttgctggcctttcgcctgtcgcttgatctgccgcgccaacttaggtaataatgctagctgacgctcataggcggcaccgcggcgacgataggttgctgcttgactgggattcagtcggctgaattgggtcactagtcgctgagttaccgtcatcatcacggtgggatcggaccataaatgcggattgtcaccggtcttttttcccatcaacttaccaatcgttaatgttttggtatcggcatcttgattagcggcaaccacccgatccatccagctgtcatatcccaggccattttcaactaccacatcagcgtgggcaacttgtttggccgttttgatatccggttcataactttcagcatcaatgctggggctattaatcacagttgtcacgtggccactatggccgagaattgcctgcgccgcttcaccataaaatcccaatgtagcaaccacattaatttgtcgggactgcttagctgtcgaagtcggctgacaccctgttagtgtgaccaataccatgaccatcacacctaataaccctatctgatgcccatttagccacttctttcgctgcacgtccgtcatcccaatccttcaaaaattaaatgtaaacagtaatgattaccgtttagtagtttaccagatattgaaaacttgtcaaccagcgtttcactcgattacgcaatgaccgttgacaaaaaatccgcgacaagttgatcatatttgacggggtccgcatcccgcgtagcaatatgttcggcgttaggatcacaatatttttgtttcggtccggccgccgcttggtacaaaatatctaagttttccaccggaaccgtcgtatccttggccccgtgaatcagtaatagtgggatctggcttttcttcaattgtcccgcaatgtcaccatccgccaaacggtaatcgccccaccgtgagtattggtcagcaatcgttaaggttggccgggctggaacatgaaaattatgccacatgcgatagcgcgcctcacccaagacactagcatatcctgaatcggcaataattgctttaacattcgttggtaagtcctcaccagccgtcgccatcacagtcgcggcacccatggaaattcctagcagcacaatctggctgtccgcaccgttttggtcaataacctgcgtaatccagccctggtaatcgtgcctatctggccacccatagccaatcgtatgaccatcgctttcaccgtgagcgcgagcatcgggcatcaatacggcatagccccactcatgaaaaacccgggcccatggaatcatttgctcgcgagcatgacctaggccatgggctaagatgaccactttcgttgttggttgcttagcagctaaccagcttgcgcgtaagcataacccatccgccgtcatctgtgtccattcaaccggatgatggcgcaaataccaggcattatcagcagctgtattctcactaatcgcccgttctttggattgttggcgactgcgagcataagactttgtcgccgctaaatacaatccggccgcggcacccagtacgctaacagcacccaccgcaaaaagtgcagcagccccactcactactttttgccaagtcttcatcacgattaccccatttctttttgtattaccttcactgtaccgaaaaactgctaatcgtgccactaattccctgaccattttgacaaggtttaatcggttagagataatgaagaaaactgactaggagcgtgaataatgtgacacccattatcttcgaaaaagtcttaaaacaaacgtcgcaagggacgctgctcaaaaatattaccttgaccatccccacaggcagccaagttgggcttaaagtcacgcaccaagaaagtcgttgcttttttaatttattgactggaaaaacccgacccaccagtggtcaacttgtccgaaacgataccacaatcatggctaatttaacaacggatgcggggtacccccagcttaccgtaagtcaatacgcccacctatttctgaagcttagtgctcatccaatcgaccttgcggctgcccaagaagcactagcccttcatgaggtctggcatctaccactaaaacggctgagtcaagaccaacaacagcgcgttgtccttttacgcctggttgttttacatcctgatttagccttcttagaaaatcccctaaatgaactcagcgatgacgggattcagctgtaccttcaaggactcacatacctacgacaatcgggtgtgaccgttatctgcaccgctccttacttggaagaactcctcctagtcagtgacaccatttatcgatacagcccaacgggattagaaagcgtcgatttaaaaccagatacgcctgacacgaccggtcccgctattcaacccacacaagtctttaagattgcctgcaaacaagacgataaaaccatcttctttagtcctgacgaaattgacttcatcgaaagcatcaattccatcagtacggtccacgttggcaatgataccttttcctctaccttgacgctgacagaactggaagccaaacttcaacgctttggtttctttcggtgtcaccgttcctacttagttaatttacagcgaatcgccgaactgattagctattcacgcaacagctatacccttattctcaagggccatccagcgcctaaacttcctttatcacgcacccggctggaagaattacgcactttgatctctttttagtggtaccacccaccttactgtggtcactactcgccaatcattcagcacaattgacccgattttaacgacatatcgtcccgatgttgctaaattagaggcagcgattaagtcctgtgacctaatctattttaaacctcaaaggagcaacgacacatgacaaccactgccattcaggttcagcatctagcgaaacattttaaaaccactagtgcgctacgtgatctttcctttaccgttcatcaaggagagatcttcggttttctcggcccctcgggtgctggtaaaacaacgacccttaaaattttaactgggcaactcgctcccagtgccgggacggccactgtcttaggacacgacgtcacccaattaacacccgccatttatgaacatgtggggatcgttacccacaatagtggcctgtacgaccgattatcggttaccgccaaccttcgtttctttgccaaattattgggcgttgctacgacgaaggttaccccgctactagcccgcgtcggcctcagcgaacaacagcagcaattggcaggaaagctgtcacaaggacagcgacaacgattaatcttagcacgcgccgtgttgcatgccccagcagtcctatttctagacgaaccaactagtggtttagatcccagcacggcactggcgattcatcacttaatccgagatcttcgagatcaaggaactgctatctttctcaccacgcacaacatgaccgaagccactaaactttgtgaccaagtcgctttacttaacgacggtcaaatcgttgagttgggtacaccacaagccttacggttaaaatataaccggcatcaaaattatcgtgtcttatttcagggagagactgccgcacaaaccctcagtggtccagctgggcagacgattattgcccgggaaataaccgctggtcatattgtgaccattcactcaggagagcccacactagaagacgttttcttagaagttaccgggaggaatttagaatgaaccgccactggcaaaaaattcaggcaattgcacaactcaagcttcacatgattattcataacttatccatttcatttatccccgccttttcgatgttaatggtctatctattacgtctaattattcacgaccaatcaactgccgccgacgctgcgagtgccatgggtggcgcctacttgcttagtttcggcctgctattcaacaccgttatgggtggtattatgatgtgcagtggtccattggccgaagaaaaggaaaaacacaccctacgcgtcttgatgactgcttctgtcagcggattagatttcttcattggcagtgctttaccagtactggtaattattgaagtagttaacgttctaatgatccctattgctggggtggcgtggtccgtcattccctggggcagctttctgttaatatctaccatctgtgcgctcatcagcatgttactgggttacatgacgggaatcttgtcaaaaaatcaaacacaggctgggatcgtcagcatgccgttgctatttatcttcaccatgctgcccttcttccgcgttctcaaccacacgtttgagatgcttgccaacctaacctattcggggatcctcactcgattggtcgatcaaaccttgggtcagggctatcactgggatttccaagatattgccgtgctacttatttggctagttatcggcgtgggcctgtttctttacgcttatcgccgtaatggtctggatagcgattaatcttaaactactttcaaaagggagaacctggtcgccaatgaccacgttctcccttttataaattaatcaattgctaggctaactagaatcagtaacactgctaaccgagccacatgatgttgccagtgaatccgccccattccccaaccatgttacaacgccgccaaccaaatgataccggccaacacggcgataatatcgctaaacaacggccggagtagaaaaaagctcagccgccctatcaataggcatcccacgttcagccagcctgaaagctgcaaccacagactttcttttcgatagctggacccattcacaattgttacaatacccactattgatatgaatccaagtaatccgtattccccaatgacctgtgccatgtcgttatccccttacccctactttggcttgacgacccacttaatgcctttaaccagccagacacctaacactaacaatgggccaaacatcaacaataaaaaagtgatccactgatggacacaaaaaatataaatcggattcaaaatttcatcagtactttgcgtatttgccaagttatattcccagggattggttgacaccccattaggtgaccaccgatatccctgatggctattggccatatcctgatggtgtaaatctaatgatcgcttcttataggacgccatttcctgattattctgctgatacagtcggcgataagtttttcgtaatatcgggtaacagaccagccagcttagcatcacccagctaacaaacggagtgacttgaaatgaccagtgaccgccaccaccttcaccagcaattgccagcaaagctcctaggaccagggtgccttgggctaatgaccaaagatacgctcccaccgtccgaacttgcatgctcatcattgtcccacctccatttatcccctcgtctaactctcaaccgttacttataatattaaaattaaatgagaaaacgtcaacaaattgctatgttctctcatgataaatttttcaccaacctaacacaaaaaagagcctgagattttttcccaggctccatttatcacatgtcattactcgtttccattagcgcttaatgcggcactggccggatgttccgcataaaactgagccgctgcgccaatcaagttggcatcatttaagaaacggcagggctgtagatcaacggttaatggtgcgtggtgcgccaccattaactgttgaacctgatcctgtaagtcagcgacgaaacccggccgtgccgagattcctccgccaattaatacccgttggggattcaacccaacagacagattgaaggccccacaactcaaccaatgggtcatctcggtcacacaagtctgggcaacgggatcaccagcttgggccgcccgaaagactgtctgggcagataccgacgtcgccaagtgttccaattgggtaaaccgggcggccatttttaccggactcccaatttcgctcagcgttgctccctgctcgttcatcaccatgtaaccaaactcaccggaaaactgctgcgggccggtcatgagctgtccgttcatcactaccgcacccccaatcccggttccgataatcatgaagaccgcactgtcgagcccttgagcatttccttgccataactccgctaatgccgcacaattcgcatcattttgaatacttaccggaacacctaaggcacgggtcaagacggccttaatcggaaaattattcaaataactcacggcactcgtccctgaaattttaccagccattggatcaacacttccaggtaagctgatggcgacccccgtaatagcgctggtctgtctcacctttaactgtgtcaacgctgctaataactccggccacgtagcgggggtcatgaattttcctttatcggtgagctgttctgcctgccacacaccatatttaaccgtagtaccgccgatatcaatcactaataaaggatcacgcttcactgccatcatgttcaccaccagtcggcgttaagtcagccccattcgaggcaattacccgttgataccaataaaatgagtccttacggtagcgagcgaggctcccactgccatcatcgttccgatcgacatagatgaacccatatcgtttggataattgccccgtgctggcagaaacaatgtcaatggcactccacggagtgtatcccattactggcacgccatcttcggtcattgccaactccatttgctcgatatggtcatgcagatagtcaatccggtattgatcatggacctcatgagttgccgtcaactggtcaatcgcgccaatgccattttccacaatgaacaaaggcaagtggtagcggtcgttcatccagttcaagccataccgcagtccttgtggatcaacttgccacccccaagcggattgcggaacaaattggttggtcactaaatcatcagtttcgttataagagaattggtcatcctcatcgtcagtcgccgcggtggcaaaagacatgtagtagctaaagcccaaataatcgaccgtgccttgccgcaaattaactaagtcagctgcggtgatgtccagatcaaaccccttggtttcaaagtagttggtcagccaagtcggatactgaccttcaacttgcacatcggaataccagaagcgcgcctgcatcgcccgttgtgctttgaagacatcacggggcttatccgtggcgggataaactggtgaaaatgcgaccatcgccccaacctgaaagtccggattaattgtgtgggcgatttgaaccgcaatcgcactagcaacaacctcgtaatggctggcttgatacatcactgcttcagcgttttctcccggctgtacttgaatacctgaattggtaaagagcgtgaaggcccgatcgtagttaatttgattattaatctcgttaaaggtcagccagtaggtcgccttgtcgcggtaacgttcaaagaccgtttgagcaaagcgggtaaagaatttaatcgtctgccgacttcggaaaccaccgtatttggtcactaagtgatagggcatctcaaaatgagacaacgtcacgaccggttcaatatgatatttatgacactcatcaaacaggcgatcatagaaggcaagtccagcttcattgggttcgacctcatcaccttgtggaaaaattcgggaccacgcaatcgacgttcgaaaacacttgaagcccatttcggcaaagagtttgacatctgtgggatactgatgataaaaatccacagcctcatggttaggatagaactcattgggttgaacgccgacggtaatccgccgttcatcgtgtgtcccggcggccgtcataacatcggccacgcttaaccccttaccgccaacgtcgtaagcgccttcaacttggtgtgctgctacagcacctccccataaaaaatctgctggtaatgtttttttagtcacaatacatcctccttagggtttatccttacttatttttcagtcgctgtgacaccctctagccttgtccagtacattccagcccatttaccgcgaccagagggcgggcaagtccaaccaaaagtaattgtcatagctgaatccaactgcgttgtcataccacaacaatccattttgaaaaaaatacgatactgccctgctcaccgcgagctggccgtatcgtattttttcggtggcactaatggtgcagaattaaccgcgtgccagtcatgtccaacaccttgtgaatggctaaggaggccccacctaacagcgtggcatacttaacgtccttagacataaccagtggtggcactagtggcataaaactcaatttcatttgaacatttttcaaaatttccggtaactggtcaatcaatggggaattgaagaacaccagttgtggatcgtacgcaataatcaaattgctcgtcaccaccgccagttgatagcaaaagtcctcaattagatgtgtgatttgcgcatccccttgttcattagcccgcaccaagtctgctagcgtgtatgtcggtcgccctttcagacgggcagctttagctagcaaagccgattgtgaccattcctgatcgaaattcgtcaacttagccagtcgctgccgtggcttgtccggttcagtgagtagcatttgcccaacttcaccagctcgaccgtagtttccggtatacaattgtttatttagcaagattccggcaccaacgccttcgtgaatgctaattgacaccaagctttgtaattcttgcttgctgtaatcctgttcaaagatcgctgacaagttcgcttcattttccataatcactggaacatgatagcgctgctcaaaatggcccaccaaatcaacatcttcaaagtccacgaacggtgaactgataatttcattttgataaaccaccccaaaaatcgcaatggaaatcgcctgtaaaccattgtccactttgaatttaggtagctgccgaaccatttcttccattttggcaacaacttggtgcaccgttagattatcaatcggactttgactatattcaagtgcccgtccatccagttgcgtgaccaacatttctaacgttaagccggaaatgctgaaattaatcacgtagccgtacgtcacattgtaagccactaattccggccggcgaccactgccggaagcggcagctcgggcctcgccctgactcgtaaccagcttgcgttcagtcaacgacccaataatgtcagaaaccgtgactttattgagtcctaagagcttagaaacttcggttcttgaaatggggccgtggttcacaattgtttggagaacggaccgttcgttatggtcccgcatgacatccttattgataatcatcttgggtcactcactttttgatttattcaccgtcttcggcgttttcacgagcatgcttttcagccaagtcgctttgcatcttcttttcgatgccatcaacatggtagaacatcaacgcaattccggataaggcaaagcccaagagtggtacccaaatgtagtttaattcgatcccgtgtaaggcaccagccgtttgggtcttgttggcaacgtaaccagtcccagtcaaaatccaaccagtgatcacaccaccaattcccatccccagtttggcactgaagctagaaaatgacgttacaattccttcggcccggacaccgttgatccattcgccataatccacggcgtcggccaacataacggcaattaaaccagacacataacccgttcctaagtaaccaataattgtcgcaaagataatcattggtacactcagattgttagcgcccaagctcaagagtaattgaccaatcacggccaagatcatcccaccgagcatggtgtttcgcttaccaattcggctagccgtccatggtgtcaacaccacggccaccaaggccaccaactgtaaactcaagacaagcgaagctaacgtggcatcatgcatgttgtacttgaagaagtaaaccgtcacttgtgaccgggtttgcattcccatccagtaaataaagttgatgaagataatgatagcccatggccagttacgcttcaaggctttcagagattctttaattggaattgacttacgagaactcttggtttgaacccgttcagtggtgtacttgaagacaaagccaaagatgaccaccacaattacagcgacaatcaaggcccagataaaccaaccgcgagcactagtggttgatccgtgaccaaagaaagcaaccattgtcaacgtaatcccggtgattaacgtagcaccagcagttcccatgaattgtcgaatagtggataatgtgacccgttcttgtgggttactcgttaatgatggcaaaattgaggtaataggaatgttaactgccgagtaaagcacatcgaccccaatataagtgacgtaagcccagactaatttaccggttaaactcatattgggtgtcgtaaagactaacacacagaagactgcaaatggaattgagaaccataaccagtacggtcgactcttcccccatttggtgtgggtatggtcaatcatgatcccccagaaaggcccatcaaaggcatccacaatccgagcagctaagaataacgttccgacagccgcagcacttaggccaaaggtatcggtatagaaaatcattaagtatgttcccaccatttggaaggacaagttgcaggcgaagtcactaaagctataggcaattcgctcgttccaaggaaccatatttttcatggctggctcggctttagcagcattttcactcatattaaacacctctatagtttatgaatccattatgtgatactgaaaattaatgctgaatcgtcgacattcaagaaaattcaattttcgaaactaagcatactggaaccgcttacacttgtcaatacccagttggtttagtaaaccaatttactacatgagtcgtcactatttcatgcttttggctaaatgaaagcgttgacatttgcaaaaaccacaagtacactgagtttgtcgattaagaaattcaattttctaaaaattttgagaggtgttcttccatgaagtttacgaacggctactggttaacccgaccacaataccaaattgaatccccacgagaagtctttgactacaagcaaactgataacaaattaacgctgtacgcgccattcaagtttatcaatgaacgcggcgacgaacttaacctaggaatgagtacgatcgacctaacctcacccgttgaaggggtgattggtgttaagctgacgcacttcgatcaaagcgaaaaaggccccgcctaccatatcaacaatcaaaacccagatgttgccattaccacgggcaatgatgaattgacctttacctctggcggactaacggcccggattccctttaagcaggcgttccaattagacttcttaaatggggatcatttgttgacccaatccttagacaaggcccaaggggtcatccatgattcctcaactaataaggattacatgcgcgaacaactgaacgtgggcgtagacgacaaggtttatggtctcggtgaacggtttggtaacttcattaagaatggtcaagaggtcaaaatcaccaatcaagatggtgggacagcttctgaacaatcttacaagaacatccccttctatttaacggatgctggctacggtgtcttcgttgaccaaccacaaacggtcgatttcgagattacctctgaaaatgttgaccgggtacaattcagtactgaaggtcaatcactgcaatactatgtcatctatgggccaacgccacaagaaatcttgcaccgatacacccaactgaccggtcaaatgcaattaccaccagcatggtctttcggcttgtggttgaccacctcatttaccacagactacagtgaaaaaacagtcatgaaattcatcgatggcatgaaggaacgcaatattccactagatgtcttccactttgactgcttctggcaaaagggcttcgaatggagcaacatggaatgggatcgtgacgagttcccagatcccgctagcctaattaagaagattcacgaccgcggtattaaggtctgtgtttggatcaacccgtacatcgcccaaaaagggaagatgtttgaagaaggtaaagaaaaaggctacttcgtcaagcgtgaaaatggcaccatttggcaatgggatctctggcaggccggtaacgccttcgtggactttaccaaccctgacgccgtgaagtggtacaagagcaagcttcaagccctacttgatatgggggttgattgctttaagaccgactttggtgaacggattccagtcgacgatgccgtcttctttgatggctccgacccgaaacgagaacacaattactacaccctacaatacaaccaagcggtctttgaaaccattgaagaagccaaggggaaaggtgaagctgtcgtctttgcccgttccgcaacagtcggttctcaaaagtacccggttcactggggtggcgatgccttgtccaccttcaagaacatggccgacaccttacatggtgggctgtcattcttgagttctggctttgccttttggagtcatgacattggtggtttcgaggatggccccgatacaccaacggctgatctgtacaagcggtggacgcaatttggtttgctatcttctcacagtcgttatcacggtagtaacgtttaccgggtcccatggaacttcgatgacgaagccgtggaaaatacgcgcaagtatgtcaatttgaaactatccttaatgccctacctgtacacccaagcagctcataacgccgcttatggtaacccactaatgcggccaatgtggtttgactttacccaagacctcacggcgcacacgttggataaccaatatatgttgggaagtcaaattctggtggcaccggtcttcaatcatgaaggtcatgtcaacctctatctgccagctggcaaatggaccagcattatcgatgacaacgaattctacgatgtcaaagatggtaagtggctcagtcaaaactacagtgagttagacctccctgttctcgcccgtgaaaataccattctcttgcggaatcctaaggccgttcatgccgactatgatttcaccaaggacttggatattcacttatacgacatgcatgaaggtaccaccagtgttgcggttgtggatcaaaaaggcaaagatgctggtaaggtcacggttgaccgaactggtaacgaactcaaggtcacaaccactggtttaagcggtaatgctaccatctacgttcatgaaaacggcaagaccactcaggtcaccctggatggtgcagctacaacgatcaagctgtaatctgacaaactaaaaacagttcccctaacgaccggtgagtcgttgggagaactgtttttttgatcaatcccccgctacagggggattttcattttataattgattgaattcgctgttgcaacacgggaaccacatccgtcataaaccacgggtgttgattttgccacccataattcaacggtgacgggtgaactaacggaaaatacgccggtaggtagtcttgaaaatgggccaccgtggcggtcaacgtcttttgccgattaggtaagtaagctttttgcgcatattgaccaattaataaggtcaacttcactttaggcatcaacgctaataacggcgcatgccatttttccgcaaagcccttccgtggtggtaaatcaccaccgtgagcgtgtttgcccggatagtaaaagtctaacggcaacacgccaatcttgctggaatgataaaattggtctttcgtcacgcccatccagctacgcaatcgatctccactgggatcatcccaaaacgtcattgatgcctgcgcctgtcgactgggcgcttgactaatcagcaggatctcggcattttcctctatatgatacaacggcaaaataccttgcgccgtgaaagcttggttttctggatctgcctgaatcgcttgaaaaacttcatctgccgtcatttgtcagctctcctctaaggcaatggccgcaccaaatacacctcgcgacagaaccccttcattccattaaacacccgttgtgctcgagactgcttactacatagcccaaagactgtgggccccgtgccactcatttgcgctgcatccgcaccaaatttcatcatttgctgtttaatttgggtgatctccggatagcggtgagccgtcaagggttccagcgcattgcccatcaccgcacacattccttgaatatcttgctcgcggatcgcgcgtaacaagccgtcaatgtccgggtgttccaaatgatcatactgaatctgctgtaagatgctgggcgtcgacacactcaccttgggtttagctaaaactacccacgctgccggaagctttgatagtggtgtgatccgttcgcctcgacctcgtacatgtgctgtccgaccatacacacaataaggtacatcggagtcaatttgcaaccccaactccgccaactcttgccagctaagtcccaacgaccacaattggtttagtccccgtaagacagccgcagcatcggaagaaccgccacccaagccagccgctacgggaatattttttttaatgcgaatattgaccccttcgtcaataccatagtttgtctgtaataaatgggccgcctgaaaagcgaggttccgttgatcattcggcaaaaagccgctatccgaagccacacgaatccgcttatgcttcgtcaacgtttgaatttccacatagtcagccaagtcaacggacgtcataaccatattccactcttccgccccatcttggtgatggtaaggcgtgtcgagcccgaggtttatcttggctggcgccttttcgatcagttgcatgagctccaccttacttctcaagtagacgcatcgtctactgttctcgtgaatctgattaagcccattatactatggttgacggcaaaataaaaaggccttatccggcccaattatttattcatcaaagtcaacttcgatgttcttggttaaaatatcggtataactgtaggaaacccgttcgaacgagttttcatcttggtctaaatcaaccacaaaaactgctgggtaagtttcccgaagaattccatgccgctctgtcgtttttttacgaccggcctgagcaatcaccatgagcttttcgccaatgcgatcgtccagtttgttcttaatgttcgctaaacttgttggcatgcacttcacctctgtgaaacaattatatcatcgtttcacaaaaattgcaaattataccacaacaccctcaaaaccgcaagaatccatagttggtaagggttacatcaatccctcattgtggaaagcgttcgttaattcgataaaattaagcagcgttaagcgttctggccgcagctgacgcgaaatacccgtttgattcaaaactgtttcaattcgttcacgaacctctggctgtttaccaaaaatcccctgaagattgttccacaacgattttcgacgatgtgcaaagcaccccttaacaaaactaaataaagccttgtcttcgtacggattcactggtagtgcttcgcgtggcgtcaagcgaataatggctgaatccacgttaggttggggaatgaacgctgttcgaggaacattgaaagcaatctccacgtgcgcccggtactgcataatcactgataaagagccataggctttcgttcctggctcggcgactagtcgttcggccacttcagcctgcatcataaccacaattgcctcaaacctaaccgtactctgcaaaacgcccatcaagattggtgtcgtaatgtaatacggcaagttggccactaacttcaaaggccgatctgcttcgaattcatctgctaccactgctggtaaattggcctttaagatgtcttcattgatgattttaacatttttataatccatcaaggtttcatctaagaccggcaagaggttctcatcaatctcaaacgccaccaccttgtgggcccgtttggcaatttgctcggtcaacgccccaatcccgggcccaatttcaatcacattatcgtgatcattcacatcacccgcagccacaatattacgtaaaatattgaggtcagacaggaagttttgcccgagactctttttagctaccaggcgatagcggttcaaaatcgccttggtacgggctggtgatccaatttcaggaagttcatttgtcatgtgattgctccttttcacggacctgctgtaaggcagcggcaaaatcggctggctgaataccaaacatccgtagtcgtttttcaagttgtttgccattaacgtagccaatctggagaatctctcccaattgttcacgtcgtgctttagcgccagcaccaccaattaaccctgccgccagcaaatcatcatgcgtaatcaaggtaggggctgccgttgtctctgtataaacgtgatcgagagccgcgcgaatagcgtctggactggcatgttcgacgcccagtgaaccacccgctttttccggacgtcccgccgctttaggtaaaaacgcgtgcttggcattcggaacggcttcagccacaatcttgcgaattttttcacctgagaagtcaggatctgtaaaaatgatcacgccacgctgatccgccaatttttgaattaacgtcaacgtatcatcgtcaatagcggacccccgtgtttcaatcgtatcagcattcaccgcgcgattaatttgcttcgtatcgtccttgccttcaaccactaggacttctttaatcttcttcaatcttataaaactcctctgcgtttttaaacgtggcagccgcaattacttccggtgtcgtctcacgttctttagcgatcgcttccaccgtgtaacgcgtaaagcccggttcattttgctcgccacgatgcggttcaggtgtcaaatacggcgcatccgtctcgaccatcatcacatctaatggtgtcgcgcgaacggcatcgtggacctcgtgggcattcttaaaactagcgacacctgaataagaaatgtgcatccccaaatcaagaaacttctttagccactcggggtcaccattaaagctatgcataacaccgccgatatcgcgaatatcagcttctttaatgatacggtacgtgtcggcaaaagcatcccgattatgaaccactatcggtttaccaacttctttagcaatcgcaatttgccgagcaaatacccgccgttgcacgtcttggggtgacgtatcccagtgataatccaggccaatttcacccaatgcgactacgcgactatctgtcaattgttcttcaagtaatttttcagccgcggcatcataattctttgagtcctcgggatgccaaccaactgcggcgaataactggtcatattggtgagccagcttaatggcatccgcattcaactgcgtgttggagccaatattggtcatcttaaccacgcccagctcagccgcgcgtttgagataccccggcacgtcatccagaaattcttcgctattgagatgggtatgcgaatcaaagattttcatcatgggtctccttttccttaagttaaaaaacgtggacggacggcttaacgcctctaccgtccacgttttatgttagacatacaacaatcaccggtcagacatgtgtgcccgacaccattctagctaacgtcagaaccgttaaccagactgtcaggtaaggtcagcaaggtcacttgtccatcgttttcggcagacaataacatcccttgactaacttgtcctctcatctttcgtggcttcaagtttgccacaatgacgaccttcttgcccactagttcttgtggttctggataccactcagcaattccggaaagaatttgccgggtcccctgatcgccagcatctaattggaacttcagtaatttatcagccccgtcaacatggtcaacggctttgatttcagcgactcgtaattcaattttttcgaacttatcaaaccgaatttccggcttggttaaggttaagtcctcagccgctggttcattagcggcctgttgggcttctgctttagcggccatggctgcccgtcccttcgtcttttctgacttggtcatcttaccctgaataaagtcgacttcttcttgcacatcaatccgtgggaaaataggggttcccttagcgacgacttgcttacctgctggtagatcagctaacgccaagtccgtcatcgttaaggtggcaacgtctaagcccaattggtcaaagatttccttaggggcatgcgtcataactggactgataagcgtggcaataacccgcaagctagcagccaaatgagccataacagcagccaactctgtagccttgctatcatctttggctaacttccaaggttccgtttcatcgatatacttgttactccgcgccactaacttccaaatttctgccaaagcatcagcaaaatgcatttggttcatcaagtcatgatagttcgtgatgactgcggctgctgtggcttccaaatcagcatcaaactcggtaactccagcttgatattgtggtaattgaccaccctcatatttgttaatcattgcaacggttcggttcaatagattccccaaatcattagccaaatcatagtttagccgatcaacaaagtcttctggtgaaaagaccccatcattaccgtaaggcattgctcgcatcagatagtaccgcaacgcatccaacccataccgatcaaccaaggtttctggataaatcacgttacccttagatttagacatcttgccgtctttcatcaataaccaaccgtgggcaaataattccttgggcatttctagccctaaggcatggagcacaattggccagtagatggaatggaaacgaacaatttctttacccaccatttgcacatcagcgggccagaacttcttaaagaggccatcatcatcactagtgtaacccaacgcggtgatatagtttaaaagagcgtcaatccacacgtaaacaacgtgcttaggatcactcttgactggtaccccccagctgaaagttgtccgcgaaacagcgaggtcttccaatccaggcttgatgaagttattaatcatttctgtcattcgtgattctggttggataaagtgcggatggctgtggtagaaatccaacaaccagtcagcatacttactcattttgaagaagtaggattgttcctttactagagagacgtcatgaccagaaggcgcttgcccaccgatcattttgccatcggcatcccgatagactttggccaattgggtttccgtaaagtattcttcatcatcttcggagtaccagccttcatattcacccaggtaaatatcaccctgtttgagtaaccggtcaaagatcgcctgaacagcggccacgtgttcatggtctgttgtccgaatgaacttgtcattggaaatctctaacgtcttccacagctgcttaatgcccgtcgccatgccgtccacatattcttgaggcgtttggttttgggccttggccttatcttcaatcttcaggccatgttcatctgtcccggttaagaagaacacatcatacccattgctccgcttgtaacgagcaaccgtgtcacacgcaattgtcgtataagaattaccgatatgtaaccgtccagatgggtagtaaatcggcgtggtaatgtaaaaacttggtttgtctgccataaaataaaagccttccctcgctctaaattatttcgtaatttttaggttagattctaatgtaaattctaatcaagtatagcataaaccccggttgagccatagcagacaaccggggttttatggataaatctgctagtgtcttttgcaggcaactgtagacgctgatttttcttggccgtcacaaacatctcatattagtggttattccagcccatttgacgcgaccagagggcggtaatttaaaccaccagtgagccatagaactaaccgctactacttcaaaacaagtctagctgttgtggcgccagattctgccaatgtaagcctaaaattttctgtagccgtaacgcattaggtgccgcgtccttagctgaattgttgttaaaaatcacacacacctgttgggcatgctgtgcgacccgtttcaccaatgcagcaatgtcttgcaattcggcttcactataacgataaagcgtacgggtcttccgccaatcagtgccctggttgaaccagccttgtgcattgcgaccatgaagccgcaccactgctaactccggtgtcgtgaccgtttcgactaacggaatcccatcatttaagttgtggggctcatcagtcgtcacattggttaacttcaacgactggagataggccatgacatccgcagtcatgcccggtgtctcaaaccaactgggactccggaactcgacggctaccggcagttttcccattttcagccgaacatcgcgtaaatattgaatattcgccgttgtccgattgaagaacggtggaaactggaacagcaccgtcatgagttttccggccgttaccatgggctgaatggccataatgaactggtcaaaagccgctgtaatccctgcttcctccagagggtgttgccgatcatggcgcgtcatgacctgattggctttcaaaatgtattgaaacccatcaggtactgccgcttgccaattcgccaccgtactttggcgagggataccgtaaaagggcgtatctaactcaacgacaggtaaacgtcctgcgtattcagtcagggttacagggcgctcctcaccgccaatcaaagcgggatgttctttccaagtggtcaatccaatggtaatcatccaatcccccctcacttaaaccgttcaaattgcttaattagttcagcctccggtgttgtcaaacgcccatttaactgactaatcaggcgtttaccagctaaacggtcgttataccgaatgcccgtcacgcataaatcaattaaggcaaacagaaccgttattaaaaccgcctgttgccgcgcaaaactctgattgaacaacgtcacaatctgcccgccaaaagccaattgtaaaatgccatagataatcaacgtatcgggaatcaattgcagcacatttagccaacgcaatcggcgcaccagttggcgcagctcttggataatctcctgatggctcattgctagacccccctatacgattaacgtttcaaagaaactcgttgcatctgtctgaatcatttgataatcaattcccaaattcagcgactcttgattaatcgccacaacttgggcctgtggcgcccgataatctaataaaccagcaaacggataaacacgcattgacgtgccgacaattacaacgagatcggccgtctgcatagcagcaaccgctcgctgaacattgacttgattcagtccctcttcgtaaaggacgacatctggccgtagccaatcgccatcactctcatgataaggtgactgcaaatagtcttgccaagcaacctcttgcccacagatctggcaatatacccgatatagattcccatgaaactcaatcagatgttgcgttttcgccagtcgatacaggttgtcaatattttgcgtgatgactgtcgcccgtccttgttgggttagcgccgcctgcttggtatgaatgacattgggttgcgcctgcggataatataaattttgtttgacataatcgtagaacgtctcgggttcctgagccaaacacgtgtggctcaaatagtattccgcgttgcgatgaccggtatacaagccatttttcgagcggtaatccggaatccctgacggtgttgataccccagcacccgttaagaaaacaatgtgtttagctgcatcgaatgcctgttgtaaagttgctgccatccccatcatcccttcataacgttatggttaccgtaaaatatatggcatcttcaattgcttaaagagctcctcaactgtcaaattataatacttagtaaagtactctggtgagtcttctttaggcgccggtgctggcagaacaaacgcattttgttgatccgttcgattgattccaacataagcccggcgttgagttgtcttttcgtgcatatctgagtgataaaattcaaagacttgcttcacttctaggcccaattgacgctgagataatacactcgatagcgtcgtgaactctgtattgtgcagggctggcaagtgccaagcctccaactgttcatcaaatgccttgaagagtttgacgacattgcgacgtaaagagaatggtgacgtcactggtttttcggtaataattgcgtaaagcttttttgcagccgctaaactaatcggatagtctcgttcaaactggtccataaccgcttgatcgcccgtcccgaaaaagaccaacgcatccaatagtgtcagcgttcgtaacgtcatttcgtcatcaactggtgttggttctggcttcaaagttgccgtgactccgtttaagtaaagctgtttaatctcgtcagtgatcagctgatgtttttgctgctctttaacgactaccacatggctaacgatgtcatatagttccgtccccataatcataagttgttcatccaactgcggttgtcccgtagttaaggagaagaaaacttggggaaagccagacagtaccatgagtaaatgaaccagctcatgagctgctgtgtagtttggcgcggtcagatcagcaacctgaatgacaatatcatcgcccactttaacttgctgagcctgatcgtggcgcacaaaccccacttgttgatcactaataaaagataccgacaccttacccggatacaaggcgttaacttggtctaacaggccttgcacctccgtattgagttgcacatcttttgcttgcatgtttgtctattcacctatttctttaaattttcttgtcgaatggcagccaaagctgcttgtgcctgtgttgtggtcggctgggtaatggttttcaaccgatcgagcaccgctggtaattcggctggtgtcgcgcccaccgataaggccagggatttgcgctgtagtgccatgtgcccccgttgaatgccatcgctcactaaagcgcgcagtgccgcaacattttgtgcaaggccaacggcggccgtaagtcccattaactgccgggctgtcgtgatctgagcgagttgttgattgacccgtacgagtggtaaaacccgtgtggcaccgccaacaacccccaaggccaacggcaacgtcaattcaccatgaagttgcccatctgctaaccaccagcgactgagtccctgatactgaccactgcgactcgcataagcgtgcgcaccactttcaaccgatcgccagtcgttccccatcgcgagaacaaccgcatcaatcccattcataatgcctttattgtgtgtcacagcacgataaggatcaacttgggctaacgcgctggcctggtagattcgttcggccacctgctggcccgtgagtgttctggtggctaattgggccactggcactgcacacgtagcggtggctaaactatgggtcgcataattgcttaaaatgctcattaaaatatcaacgtcgagttgtgttcgaatctcggtagcaactgcctcagctaacgtgtttaccaagttagcccccatcgcctcaccaacatcaatgaataagtcaagtgacacccaatctggtggtagacaccgcacacgaatcgatcgtgcgccaccgccatgggataacaggctcggatgagcggcattcgccacttccaagagtcgggactcatgagccattagccactcacgtaaatgtgcctgattggttacgtgactaaaaacaatctggcccatcaattcacgttgtttgactgtggtggtaatgcccacctcactcatcaataagcgaccaccattactagcggcagcgatgacggatggttcttcagttaccatgggaaccatcacgtcatgcccatcaacgcgcagattcactgccacaccctcgggtatcccataagtcgtcaaatagttttcaatgagttgatcatcagtcgcttgccgtcgtgcggcaatcaaggctaactgcgccacggttaagtgagcgtgttgtgctaaatgatcccgcctagccgcatatgataatcgataaaatggcattaacgtcacaatcggacctcctatcgttggctcaggtactcagagataatcccctcacgcacgccactttccgagaaaatcacccggtcagaatctaacatttgcagtagtgtgactaatgggagcatcccaccaataataatatcggcccgttcaggttccaaccccgagatacgtttacgctcggccagtggtacccgtaacaggcgttcaaaggttttcatgacttgaccagtggttaaccggtagccgtgaatgttttcaacgtgtaaaatcttttgttgctgacggttcatccgggccaatgtgcgattggcaccccccagtagaaccaagggtaagtgcttggcatcgtttagccaccaaatatcttgtagtcgttcccgcaaaaagacctgcgcggagaataaatcgacggctgttacccgatcatctaatcggaattgttctgagagattaactgccccaaatggcacactgattaagctggctgctttaccgtctttgacgtgaactaactcacaactggccccaccagtatctagtagcaagcaatccttaatcttcaaccgattaacagcgcctaaataatcataataggcttcctgatcaccggacaacacttctaactcaatgtctgtagcggccgcgacccgttttaaaaattcttcgcggttgcgtgcctggcgaactgccgctgtggcaatgccccgaacaatgaggtgcggcaattgctcgtaatacggtcgaaacgattttagtgccgcaatcgtgcgatccatggccttgggttgcaagatcttttccgggcccatcccctcggatagccggctatcggctttgatacggttcacttcacgataggtgccatcgtcgtgaagctcattaacggccatccgcacggaattagaacctagatcaactatggctaaattttgcatcgcacatcccccattcccggttacccgaagtagtcaattccaatcgcgtgacgcacttcatgtaaggtctgagcagccacttggttggcccgttcactaccttgcttcaaaatatcataaacaccggtttcatcagcggcaaattgttcgcgccgctgccgaataggttctagctttgcctgcaagacctcattgaggtaccgtttgatcttcacgtcacccagaccaccatgttgatattgggcctttaaatcagcaactttggctgtatcgtcggcaaaaatatccagatacgtgaaaaccgtattgccctcgacatgaccgggatcttccacgtggatatgttcgggatcggtgtacattgacatgatcttcttttgaatcgtgtcggcactatcgcccaagtagatggcattatccaaagacttactcattttagcgttaccatctagtccaggaattcggccttggcctttaggtgggaaatacccttctggttcaactaaaatttgttgaccataaatattgttgaaactccgcacaatttcacgagtctgctccaacatgggttcttggtcttcacctacgggcaccgtgtcggctttaaaagcagtaatatcagcagcctggctcacggggtagataaagaaaccagcgggcacactttcaccaaacgccttttgcttaatttcagtcttcaccgttgggttgcgatttaaccgagaaacggagaccaaattcaaataagccatcgttaattcattaagcgctggaatttgtgattgaaccaaaatcgttgatttagccggatcaatccccactgctaaataatctaaggcaacttgtaacaaactgtgccgaattttttccggatctcgtgcattatcagtcagggcttgcatgtcagcaatcatgatgtaggtctcataatcgccagtgttttgtaacgcaacgcggtttttcaatgaaccaacgtaatgaccaatatgtagcttaccggtgggacgatcccccgttaaaatgacgtgtttactcattatcttcatcctttccaaaaaagcgccctcttagctacttgctaaaaggacgctaacgcgcggtaccacctaatttgcagttcatgactgcctcttgtcgataacggcgaccccgcgacactaatcatcgaattttaaagtgatctaacgacccacttcgtcactggaaacgttgcaccaagccatttcctctctgaattcggactacttttatcgttagtcttacataggttcattttagaggttttaggggtggatgtaaactataatgtcgcaaaatctggcgaatttcagtgggcggtaagcatagagacttttgtaggttacaaccgccacgtgacttccaggctaagaactagtaggaatcaataacagccacaagtagttgccaatacaacaataccaacgatcacaaataattaggttaatacttccaaaacagctaaatataattgttctaatcggacttaaggtttaaccaacgtgaccacaccacgccacagtagcccgacgggaagtggcaaatgggctcagtaccgtcgttatccttagtgcgcgggtttagcgcgcttaggataagaccgagctttgagacaagtgatcttcttggcttaaagtcgtgtccggtacgttccagctcatttgctacgaccagagggcgggcaatctcgacaaatgaacccatttatcgtaagtcccaagtcaggtaatcctatgccaaaaaacttattaaaataaactaggcgcaatcgtttgacacactccccaaatatgactaaacttgttaggcactttagcctatccaaaggaggcggtcagtttgaccaccagcgaagaagcacaagaacaacagcgtgttgatcaggttgctcacgccattggtcaacgcatcgccaaaaccgatgcggactaccaagcggcccatcaagaactacgtaacgtgttgcaaaattacagcgaaaacacctcggttaactggttcgaagtcgatgaccgaatcgaaaccagtgccgaactccaacaacaacgggcattagtttctcgtttaactgaaaatcaaaatatcattcaagatcaattagatacgtttaaaaacttacaaaaatctccgtactttggtcgcatcgatatccaagatcccggtgaaaccgacagcgagtcactttacattggcactgcctcgttcgttgatgacgatcaaaatttcttagtttatgactggcgggcccctatttctagtatttattacaatggggtcttaggacaggtcgcctatcacaccccagctggtgaccagcagaccaagctactcaagaagcgacagtttctgattcaagatggtcaaattgaaagtatgtttgacaccaacgaaaccgttggagatgaaatgctgcagcacgctttgggtgagcaaaacgacgccaccatgcaaaatattgtggcaaccatccaacgggaacaaaatgatattattcgtgacacccgcagtgacctattagtggttcaaggggttgccggttccggtaagacatcggccattttacagcggattgctttcctgctatatcacagtcggcgcgatcttgaggctgatcagatcgtcttattctcacctaatcggttgttcagccactacattagtgacgttctgcccagcctcggtgagcgcaacatgcgccaagtcaccctagccgagttcctaacgcaacggttccaaggcttaacggtgcaaacgcaattcgaccgttacgaaactgatcagcaacatcccgtaaacctctccttacgaaacttccaagaaagtgccgccttgatgacagctatcaacgagtactgtcatcaatgtacggctgatgatttactgtttacggatatccggtttcatggtcgggtgttcttttcaaaagaagaaattcgtgatatctatcgccaatttccaactgcggcagcaccagctgatcgcttcttgcgtaccaaaaatgaactggaaaagcgcttgaagcagcggatcgctgaagaagccaaggccgactgggtccacgacaccatcgaccaactcagtgacgaggactatcacaacctcttaggcgaaaaacacttgggtaaatttgaacagctcgacgatgagatcgactacatcgctcggcaaatcgttcgccgacgcttgcgacaagtcgatgacgctatttataatgggtactttttagacgcgtatagccaatacactgcctttttgaaacagtgtccgttaccagaagatgtcacctctactgactggcaaaccgccatcgcgagttaccaacatgatatcgaatttcaccatctcgccttaacggatgctgccccactattgtaccttcgtgatattttaattggcggtggtgctaatcaccgcatgcagcatttatttgttgatgaaatgcaagattactccatggcgcaactcatttatttacaacacgcctttccacgagccaagctcaccttattgggtgacagcgaacaggccttattcaaagccgttgaatcgccggaaagtattctcaaaaaactcaatgccgcactaaatatcaagcgctcgcgtctgatcaccttgcgacgctcctaccgctcaacgttacccatcacaaccttcgcgaaggctttactccccgatggtgatcagattgaagcctttaaccggccgggcgacctgcccaaagtggtcattcgctacgatgaagcagtggcgttcaaagccttggctcacgaacttaaattagaattagcaaccaatggaacggtcgctattctgacaaaaagcacggctgaagccaagctcgtgtaccaaaagctccatgccgactttgatctaacccggttaacggataccgaccgatcactgcctaagggtgttgtggtcttacctatctacctggccaagggcttagagttcgatagcgttatcgcctacaatgtctccgccgaaaattacccagatgagcaattaaccgggacgctgtataccatcgcatcacgagccatgcatcacctgacactactatgcatcggtgctgcatcccctctgattgcctctggtaagattccgcaagcagacttacagattgaacatgaatttcagaattagttgctacgaacgttttccgggaaataattctgaccccggacaacactaaacccgtccactataacctcgattggttatagtggacgggttttattgtaagccgactttatttcaaagctgccggtgtcttcgtcgtagtaaactttacctgacgaatataattgtgataacccttgtaaaaatgtaattgcttagctgtcaccttaactttatacgtcattcgctgaccatcaaactgaaccgtttgtccagctggagaatactgaatgccagacagttggtagacgtgatgccctaaagactgatatttcagcttcttcagcccatacccgggtaaccgataataccggtcagttgttgcgtctaacccaaagagatttccggtacttttagtcttggtgtatgtgatataggccttattatcccctttaccattataaaaccacgtatggcgcatgaccttaggtgttcccgcatgccacgttgccgcctgagcagatgtcagatcggtgacccctaacgccaaagccaaagctcccagaccaatcaaaaaagcagatttatgcatgattttcctcctatataacttccctgcgctttaatttacgcgtctattagtgcgaaagcaagtcctatttaccgaaaagagtccatggtatactgactgtagagggagatgtcaagatgcatataactaagcgacggatgtggttggaactgggaattaacggattatgtctcggattcccgttgttcttaatcatcgatggcagtgtggcattagctcagaatgacccctttcatccagatgtatttattcttttcggtctgttaatgatgggcgtgctcagcctcataatgactgggctgacaatcagccgtttacgtgcccatggctggcgggggcttcctcactatcaacagggactcgctatcttttatcttatttggctcgtcattggcagccttacctggctagtttctctgggcatcatcccaataaaataacaaattattttaaaaaaagttggccttttcctgttgctgaaagggccaacttttttactgtaattttgctgggatcaccattttttctggtgctactttttcgcccgccaattgtcgcaacattatttcagccgagctggcacccatgagaaagggattctgcgtaatcagcgtcagcttcggttccattcgccgaataaagtccgtatcggcaaaacccgtggctgtcacagtttgattatcaatcagtccggaaataattaaattcgggaaaaattccaataaccagcgttccttcagcgcaaatgccactgttttctgatcattttgagtaatcaactgggttaaccgctgatgcacctcactatggttgtacgaggattccgagacttccaagacatccacatcctgggccgccgccagaatgccccgataccgttcctgtcgggtgcggctaagttccaattcagaagtcaacacgaccacgtgctgatagccttgctgtcgaaaggccgttgtcgccgccttagccgcttcaaaattatccgtcaccacttgcggccaaggacaagcatccatttcccggtcgacactcacaaccggcatctgctgatgcaaaatttcttgaaccgtctggggattactaaacgattgtaagattaacccatcaaacctccgcgacccaatcgcccgtagaagtgtcttttcccgttcaatatcggcattggcatcgaacaataccccaatataccctctactttccaagatagaactaattcccttaaacaactctgtagaaaagtaatcatcaatgttagcaacaatgaccgcaatcagtttgctggattgggtaatcatctgtcgcgccactgagttgggcacgtagttgagcttcgtaatggcctcttgcactttagtggctgtcgctgccgacattcgaccaagattgccgttcaaaaaccgtgagacggtcgcaatcgaaacgccggccaacgccgcaacatctttaatatttgcatttttattcgctttacgtgccatcgtttcattcgccccattaacccggatttatagctgaaccgttcatcagcttattgttttagtctaccagaaaaaggtgccgctggaaaagtttcttaacgacaaaaaacaggcaacgcccccgtatgcgttgcctgttagtcagatattattccatattactatgtgtggcggccgccgcgtcattagataccttatcacgccgacttaacttcaaacataaaacatctaacgttaagtgaacactctgatcaaataacgtgctcaatagctgaatcgatttaacaccgtccccagtcttggttgcaccgggaaccacaatcaccgcttggcccacctttcctaacggcgaatctgcatggctggtaaccgcaatcaccgtcacgccactcgcggcagccttttcagccagttccaaaatgctggctgtcttcccggaaccggaaactgccaataatacatcctcagcttgaattgacggcgtaatcgtttcaccaattacaaacaccgtatagccaatatgcatcagccgcatcgcaaacccttttgccattaagccagagcgaccggcccccagcacaaagattcgtcgatccttttgaatcaatttttccgcttgatctaactgactttcgtcaatcatgcccataacttcattcacttcttgggtgacctgatcaatcaatgtcatttgtgcataacctccataaatttttgtgcagaagccactggatcggccgtcttaacaatcgcgcttcccacaataaccgattcagcaattccttgagtcgctaacttctgggccatggctaaatcaattccaccggctacagagatgtgctgaaccatcggatagtcttcatgaaaggccgcaacggtagcagccgcatcaaaccccgctttagaatccttggcatgatgaatgccataaattgccgccggatgatccacgatctgagccgtcttattggccgtaatctccatcatatcaataaacaattgctttcctcgtgactgggacaatgcgtatacttttgtcagcgtatcggctgaagcagcgcccatcgccgtgagaatatctcccgttgcaaatcccttgtcaaattcatactcaccttcatcaatggtctttaggtcgagtaatagtttggcatgctggagcttagggagctgcgcgtgaatctgttccaaaccataatctttaatcaatgatgtgccaaactcaatcacatcaacctgtgtgtctaactgtttagctaagtcaatcgccttatccaacgtgacccgatcaattgcaacttgtaaatccattagtcttcgacaactccttcttgttgataaaatgcttgtaagccagctggcgttgggtagccatcgttatcaccatacgtttgaacctgtaaggcacctactgcgtttccccgcatcactgccgaacgtaatgatttatgttctagaagcgccgtcaagacgcccatggcaaacccatcaccagccccaacggtgtcagcaacctgagcaaccttaaatccagtgaccgtatagctttcacccgattgctgcttgacgtaggctccggctgggcccaccttgacaataaccactttagttcgcgccccccgcaggtaaaagtcggcaatcttttctggatcggtcgatcccatcaagatttccccctcttcaacccctggcaaaacaatctcggcatgtccagccaattcatttagcgttgtcaccatcttgtcacgactaggccacagcgttggtcggagattggggtcgaaggtggttaagatattagccgcctctaatcgcttaagtaaagtgcgaaacgccgcttcagcagttgccgaaatagctgggaaaatcccggacatatgggctgcccgtacatcggtcaaatcaatttgatcgaccaccgctggcgttaaatgcgcagccgctgacccccgtcgataattctgcgtcgtaggattaccttgcgtcactcgatctttcaattgaaacgccgtccagtaatccgcatcccgagtaatgtagcgcgttcccacgtgatgctccttaatcgtcttaatgacgtaatcgccaaggggttcttcacccacttgagaaatgtaatcgacggagtggcctaatcgttgtgccccaatagcaacgtttaattcggctccgcccaaaattttgtggaattctaaagcatcgcgtaaagaaacatccggttctttagaagcgaacgtgacaatcggttcgccaatcgttaatatttcactcatcgttgtgttctccttttctgccatgtttaaccaaagaagcaataaactagtagttcattaataatcgacacgccccacatgatgggtaccccgtgttttaagaaatcccgggtttgaactttcatgtaatccagtccccagacattccaagattgtgtaatatccgttgagaccgctaatagtgtcggtacataaagtagcggtaacaagaacgcatctgagaacaagccaattccagatagaacggctgcagtcgctgctccggcaccccacacatgaaatggtccccggaataaggccaacggcgccaaaacaccaaaggctaacgccaaaatcagcatattatgtggtaggacggcctcaaataaggggcgaaaacgcaccgcatccattgatgcagcaccgctgaacatgattaacgccatcaaaaacataatcaatccggcaatatcactgattgcttgtttaatcgtatcgtttaaaaaggtaacaaacttctgataccccttaaacttaccggttaataacatcgctagtagcgtcgctaaggttaaggctggaatcgcatcccatttgaatagcatgttcatcaatacggggataattggcacaacaaaagcgagcttaggtacctgaatatcagcagtttgctgcgtttcagcaccaatgactctcaagttctcatcggcctttgatggatcaatttttttacgatgccagaaaataaagagcatcaccgcaaccaattgtactaacatggcacaaacaccaaagatcaaataggtcccgccgtattgtgctttaggaaagaaagccttgatctggttatacagcaccacgtttaaatacattggcgccccaatggccatcgaaaatgccgatagcgcaatgtctcgtggcaatcccactgacaacatgattggcagtaagataacaccaatagcaatcaccgaccccacaccataagcactcacaaagataaaagccgtcacgattaagaccaataagacggcaagtaatggccgctttttgcctaccctattcgttgcttcagagattgctggggcaatgccactatcaactaagactcgaccgaaccaggaaccaaagataatgtaaataatcgtgggaccataatttaaggctggctcggcaaaaactttttgaatcacttggtcggccggaatttgaccaatcacggcccagagaatcgccatcacgaagaaaccaatcatcaggtttccccctttgacgatgtagtaaataaatccaacaaaggtcaataacagcaaaaccgcgctcatcgtggaggccatcttaatcacccacttccgcacgtagtagctggagttgttgggtaattgccgcatccgtctccattggatactccaaagcaactggcacatcatggggtaaaagcgtcagtaattgtcgccaatcatacattcccgtatccaaatccgccgtcgttactaactgaccagcctgatcctcggtgtttttcaaatgaatgtagttcgtatatggcgctagagcctgggcgctagctgcggcatcaccatgcgtgaatgcccaattccccaagtcatagacatagccaatattggccggtgttgcctgctgcgctgctttgagaaaagctgtgatggctggtaccgttccagaaaccgttgtctggtcattttccacattcatttcaatttggtcgagtggaagcgctgacaattcagcagctaaatctccagtaaaccggtcgaagtgtcctgtgttgaatttgattttactaattcccatggtctgaccctcagcaaagtaagtggctaattgtggattgaatgcaccagtagccgtaaatacatcatcggggacactgtagttcaccgttaatcccagccgctgtgctagccgaccaatggccgctgtttcatgtggtaaatcccggaaatattcacgacgtacctcaacgccatcggcgccaaggtcagcgacctgttgcatcagtgctgtctgagaggttccctgtttaaccaatgcctcaaaaatccatgtgtttaaaataactgtcatgtgagcttccccctaatattgattaagctgactgatacgctcgagtagctgttcaaaactcatatctttaaatttaacctctgaagtcgtcgcaaaattttgagcttccgcttgattaaaatcattagccaagtaaaaggcggttagataacttaataaatattttttagccgcgggagtcacctgtttcgtctcaatccctgcctgagctgccgcactggcaaatgcttgggcaaaaactgctgcatcaattacggttctatctgccattttcaagcctccatcatcctgtcattcactaaaatccagctggtgatttcatgatgttatggtaaacgttttcctaacgattgtcaaacgctttcattacgtttttaaggcaaacaaaagcaactaagttccacaaagccattgacagcggtgtatcatttgggaaaacgttaacctaaaaatatttttttcaatagtcgacaactttgctataaaaaaagagagcctccaataggagtctctctagctacatcactaattagttaatcgattgtaatggtttctgtggtaatcgttttaacgtttgctttaacaataacggtgctaacacggtcgccaaaatgatgactaaaatcattgcggaatagtcgctgccttgtagtaatcccgcctgatgaccaatctgagcggtaattaaccccatctcaccacgggcaatcatccccgtaccaatgaccgtactactcgttcccgtgaatccgctgagtcgggcccccaaaccgcaaccaaccaacttgctaagacacgctaataaagtcaaaataagaatcagtcccagattttcagcaaagtgatccaaggtcatgttcaaccctacactgacgaaaaaaactggaataaaaatagcatttcccaagggttcaacgtgatcggccaacaccgctcgatatggggtgtgggccaccgcaatgccggcaaaaaacgcaccaattgcgccacttagtcccactaagtccgcaatccaagccatcccgagacaaatgaccatcgacataatagtcacactggacgccatcaccagtcgctcgcttaaatgcatcagatacggagctaaccattttacgagaatataagtgccaccgaaaaaggccacctgctctaacaacacaatggctagggctggatgatgtccggccgtttggataccctgactggccagtagactaatcatcagtgacaataaaacgacgccaatgatgtcatcagccactgcggcccctaaaattgtcgctccttctcgactggtcaatgcatgatattccttgagtaccgccactgagatcgaaacggacgtcgccgagaaaatcaccccgatgaacaatgcctccaatggtgaaaagccccaccaccaggcggccgctcccattaatacaaccggaaaaataacaccggaggtcgccacgatgattgctgggcgcaaatacttcatcaataactgtagattactctccagccctcccagaaacattaaaattacaacaccaatattggcaaataaacttactaggctatttagctgaatccaattcagcatggccggacctaagatgatccctacaaccagttcgccgataaccgccggcacacccaatcgattagccaaatggcctgccaatgtggttagcaccagaattaaacataacacacccagaaatgtcatccggacccctccttttgaaattgatacgttctatcatacgctaaaacagacaccgacaacagagtacatgacaattaaccagcctaaaatttctaaaccgatgtttcttattttaaaaagtaattttccatattttccacaaaaagagttatacatcgctagcaaatttctgtatactgcctttattaataagggggaaataaaatgagaatattaggtataatatttgtggtactgtcacttatctgcataactttcgctaaattttttgtaaaaactcgattattctttggtgatacgagcatgattaaacaatatatttggggaataattttattaattcctggactaatattgttatatttttcaggcgctttcacgcaataagcccctgacaaccagccagcagtcaacctaaattaaaaacggtatcgacaatggatggacaccttgtcgataccgcttttaatttctcggaaataatctaatgtatgtagaccgttaccaccgtaatgatccccaaaacaactccgggaatatttgaaataataattggccaatccttatgcgcacggtgccagccatattccacccaggcaaaggcacaaattgcggccgtaaatggctgcaacggtgatactggatgacccataaaattcgccacgatttctggaatgtacgcgacatacatcaaaatacacagaaccacagctaattctccccatagatggacctcacgcttatgtaatccggaaacatgcctaatgctcttagcataattaaagttatcaaattgaataacatatcatcccctctcaaagtcattaccgttattcagatgataatcattggttaactaaaattatagacctatcattttggttttgctcactaaagcccttataagtgggccaaccggtgattagctggcgtaccttttgacatccaatatttggaatcgtaaaaaaacctgagacttttgtcccaggctcaaagttaatgatgactatccaaaataagtgaggtcagacgccaacgtcgggtaagccaaaatagcctgatcaatatccgttggtgtgagttgattttgaatcacaaaatctaagtaattgatgagttgttctgcttcactgctcaacatggttgccccaacaatccgttgggtggatcgttctgtcacgaccttgattcgcgcatcagcgtcttgaatccgccgataactataccatgacgttaaatccaaatcactaacggcataagtctctggctgctgagtcgccgttgctggtgtgacacccagttgggccaattgcgttttaccataaacgaccgctggaatcacaggatagatgatggctggttggtcttttttggccagcgtttgcgtcaaatagcgtccttcaaaacccgccactggggtgagcttaggctggggacgatccacgacatcccccaaggcaaagacccgtggattagtcgtctgtagatgatcattcacctgaataccatgagccgtggtcgtcacattcacacgttccaaatgcaatcccgccgttacgggaagccgtccagctgtggcaaatacaagtccagttgtccaggtctttccactcgcggtggtcacttgatattgatcatcagctggcgttaccgccgtgatatccgtgtccaattgcacatctatgccatcaaccattaagcgtttcaacaaagccgttactaattcaccatcgaacccccgtaatggccgatcactatgatggattagatggacctgactaccagcggcattggcaatggctgccaattcaataccaacgtatccggcccccatcaacgtaatatctgcgggcagtgtatctaggtccaagaaatcattactggtacgcaaccattcctgtcccgtaatattgggaatacgtggagcttgtcccgttgcgataatgaaattcgtcgctgacagttgggtgttccccactgtcaggtgaccatccgcctcaaaactagcttcaccatgatagttggcgataccagctgattgtaagccaccctgagtgcccgttggaatcttctccgtatacgcccgtttcgttgccatcaacgacgaccagtcaatttgtggtacaccggttaagccatgcccttgcaacgcttcactccgtccttgagcttcaactgccgccatcaaaattttcttcgggtcgcacccgcgattgggacatgttccgccccataaatctttttcaaccacagcaaccttcaggccacgttcgtgtaagccatacgctgcggccaacccaccggggccaccaccaatcacaatgcaatcaaagtctgccatccgaaatgtcctccttctttgactttcataagttcagtttagcacgacccgtcactcgtcgttaccaatttgcttggttgccacgctgtgatggacccgccacatgttgtaactgagatagccgataatgacgagtcccgttaccaaatagactggcccggccgcacaggcttgaaataggctaccgtaaaccagcgtcccaagtggtaaggccaactgcatgagcgtactaaaggtggcatccacacgacctagtagctccgtgggaactgtcagctgcatgtacactgacatcggtgtattgatgaatgctaacacaatcccaaccagcagtgaccacccgattagtagtccaatcaaccactgaccgtttagcgtgcttaaaaagacacttcctaataaaacaacgagtagaccaatgacagccccaagtcctaagaccagccgtaagatccgtttgactgttggcatcaccattaacaatagattacctaataggatacctgcggcaaatgcactcagtacccaacttaattgggcactgctaagatgtcgagtttgcacaatcgcataaggcaacccaatatcaattgagctgaataagaaattcagtaaaatacccactagaacaattgtccgcaacgtgaagcgatcacgaatatagcgtaatcccactcgaaattgttgccattgcgacttagcgtggtcatctgccagcaaacgagtaaccggatgaaaacgcatagttagtacgattaaggccgaaataatttccatccccaattctatccacacgataccagcaaacccaatccatgcgtataaagcagctgcaataatgggtgaaaccaactgaatggtagcaatcgccgcctgctcaatagtcgccaaggtcttaatatgagccggattaactagctcccgtacagctgccgtaaaagctgttgtcgtcaccttatcacaacaagcaacgatcgttaacatcattactgctaataacatcggcatgctgagccatggcaccagtagtgcatataacgcaaatgctaggataccggctaatttactccctaaaattagtagtcggtggggctggtgatcgactaggttacctactgggatcactaacaataggccgaccaacggataaataatcgagcctaacccaaaactcatggccgagtgcgttgtgtgtaatagcatcagccccagtgcaaaaccaaatgtgtctccacctagtgtcgtcataatatcactgctggcagccttaacaatttgtataaccgattgacgattggaaatttgtgtatccatctgatacgcctcctcagtcaacaccgcccaatcggtattggcgcttaagtcaaggttaattgtattggtatttatcaaaaatgtgacgtataatatgtggcaaatttgccacgtattattaattaggaggactgagtgatgcagacaatcggttgtacacttaaacaaatccgtttagctaagggcttcacgcaaaaggaaatttatcagggcatcgtttcacgatcatttgccattcgtttagaaagtggtcaccatgatctgggcgccagcaagttattcttaatcttagatcgtctaggcgttagtgccggtgagtttcggttcatccaaaacgactatcaacctgacaccgcaaccgatctcaacagtcaaattatgttagcttacgatcaacaaaactttccgttgctcagtcatttagcccagcgctaccaagccagtgataaccccactgaacaacggatggcggtgatggcagccacgttactggtggctttcgatcacgagcatgtcgttctcagtcccgccatggcgcatctttggcaacaattcacgttcaccaaaacgtggacgctgcaagacctgaagatggggcccgtgttattagcactggcagggtttaaacacgaaccgctgcccgcaatcattcgccgctttcacgtcacgtgtgaacgctacgtgaccgcaaccaccgatcaatttgatgtcatggatgatcgctcgagctttgacctcgttgccctacaggttttactggttcatcaagaatatgcggctgcccgggcatttagaatccaagtcgtggctggctatctgaatcatctcagcactgacggtgcccttgcacagcagttatgcttatgcatttggaatgcctactttggagactttgaacaggccaatgacttagcctcccgccttaaaacattaccgttatctcgctaccaaccaggtattcatagcctgctcaactcctggcttcctcgagccaagcactatcgtcaaacgcaaaattcgtgataaactatatcctagaaactattgaagggagtacataatgacattttatacgtatcattacctcacgacacagcacagcacgtggcaatatttacgtattgcgctactaattgccctgttagtcgcgttcatggggttattcttctattacttgcgtcaccgatggaatgttaaatataaggatttgagtatcatcaccgggaccttactactactcgttttgggattgcaaatcaacagcctggtctccttgcgatcggctagcgaacaaaccggtgaaatcacgggaattgttactaatgtcgctcagcaactgcgcgtcagccctaaaaagttagcagtcaatgcgacgactagtaataccaatctgctgattaaggcgccggatgggtactatcgcttagattataattccgacaattccgcataccttatagagaaagtcacgttacatcaacctaaaataaagcttgtaaaggagtagcccatgttcgattattcagatgttgccattaagttagtggttggttttatttttatgaccgttctgatcaacttcactggtaagggtaatttagccccaacttcagcgatcgatcaagttcagaactatgtattagggggaatcattggcggggtcatttataacagttcaattacattaattcagttcgtcattgttctattaatttggtcactgttaattctagtcatgcgctatctaaaaattcacgtacaccccgttggtaaattcattgatggtggcccgattacagtgattcgtaatggccacctgctcgtccataactgtttaaaagcaaacctatccgctaaagaaattgactttaagcttcgaacggcaggcgtctatcagattgatgacgttaaacgcgcaattgtcgagcagaatgggagtctcacaattctacgtcagggtgatggatctatccgctatcccattatcgtggatgggcaaattgacgcagatgtattagagctaatgaatcacgatgaagattggttaatgcaacaactcaaacagcatggcgtcaataacatccgtgacgtttatatggctaaatacaagaatcatcaatttgaaataacgcgctacgatgaagcctaaacgtggtaggcttaacgtaggagatgagcggtatggtggcagatcggttaacggaacattgggatatctacaatcaccagttccagcgaattggtgaccgccagcgccatgaaacattagcttcgggtgagtttcatctggtggttaacgcctttatttttaacacagctggatcagtactcttgcaacaacgggttgccgataaaataaactttccgaattattgggactgttcagcgggtggctcggttttggcgggcgaaacgattgaagcagggatgcaacgtgaactggcggaagaattgggtttttaccgaactgttacttctgcggataacttctggattcgctcgtacagtcattgggtcgaggcgtggtttgcttttcaaacaacacagtcacttagcgatctgacaccccagcatgccgagttacaacgtatcgcttactttactccagatgtcgctgaacgccacttaacccagattggctttaacaattatcacttagaattggagcgggcttggacccatctgcaacaacgtaagtaaaaggcactcgcactggattcgtgtgggtgcctttcacttacgttgttttctttagtctcctgaacaactgtcacttggctttgccagctgtcagtttcatttagactggtttttccattaagccgcttattggatttgaaccaacgacctcttccttaccatggaaacgctctaccttctgagctaaagcggcataagtctattatcaccgattttaaaaacgatggcaataaatcaatatcatatttttggccatataggatatctccaatcttgataaagatattctatcaaaagttgtccatgatttatactaactccatcttttattgctaatccaagcttccagcaatttgctgcaaaaactgcgaagaaggctcaaatttcatatacgcgagcggtaagaactggcgggggaatagatggcagtgaaatccttacttacgaggggattccaacaatctgtatcggaattccagtcaggtatgaacatactaattatggaatggtagcttaccaagattttgcttatacagtcaaactagtagaagaaattattactggattgtcatccgaaaaaattgcagccttttagaaagaaaaaatttattgtctaattgttaatagtcgataccatcaagcagcaaaaaatgtgggcgaatacttaaaagttactgcagccgttaaaaatggggttattgaagcattaaaatcaattgattctcagcaagtgttggttcttcaaaggcgcccagaatttttagtcgagacaagtccgcaaatacaaattatttttactgatttgatcgtaagatgttgattataaataacaagcgcaaaggttaacaggaaggtattaatggtaaattatgcacatagtctgagtttaattatgagtaattaagtccagaggatccaactgctgaataatatgaacattacaaaaatagtacaagagaccaggtcagattgacctggtctcttgtactatttttatttagattaaatccaatctttacttgatagctccttctgtcacacttgtcatgacttgcttttgcaataggaggaacagaataataatcggaaccattgacaaaacaagtccggctaaggctaattgccattggctgtttgtttcaccgaagaaagaatacatcttaagtggaatcgtgtacatgccatctttattaacgactagtgatggtaacaggtagtcattccatattttcattgcattcaagataacaactgtacctgtcattgggctgaccgctggaaagataatataaacaaaggttttaaaaggataggctccatctaaagcagcagcttcgtcaagagtttttgagactccttgaaaagccccataaaaaagaataattgagaggcttactgataacccggtgttcataatgaccagactcgttctgttaaggaaattaactttgccaaaaagtgaaagaagcgggatcataattgactgaaaagggatcagcatagtgccggcacaaagatagtagagaattgaactgaaaggccctttaacacgagaaagagcataggcagcagctgccgaaaccaatgtgattacaatgacactggctactgtgataactaaagagttaaagaaactgcttgtaaaatcaagcgcctggtaagcagttttgaaatttgaaaacgtaaagtcccgtgtaaaccataacgggttttgaaaaattcccctttttccctttaaagcattgataataacaatgataaaggggtagaaccagaatagggcaatgattccaaaaagaaagccaagtaagattttagttgattttttcatcttctatccctcccgctttcttgaaagtgctaattgaataaaggaaacaatggttacacaaaggaaaaggataattccggctgcctgagcgtatccctgctggaagtttacaaaagcagtattataaatatacatcgaaatcatctctgtggagcggtatgggccaccatttgtaagtgctaagttttgctcatagagtttaaacgagttggcaagtgttagaaatagactgattgtaaaggctggcgccaattgtggcagctggatgaaaaagaaaatctgggttgcttttgcaccgtctagaacagctgcttgaatggtattcttaggaattgcattcaagaaagaaatatagattaacataatataaccgctcatctgccaaacaaacagaattactatcccccaaaagcctgttgaagggttgctcaaccaacctttgaaaaagtcaagatgaaaagcagcggcaattgcctgaaaagcagaagtaaaaatgaattgccagataaaaccaagtagtattccgccgatcagatttggcatgaagaagatggttctgagtgattttgtgagtctgttgttgtgactggtgacgattaacgcaaaagccaaaccgactaagttaattagaattactgaaacaaaagaaaatttaactgttagccaaaaactctgcagaaaggtggagtcttgaaaaaggacttcaaagtttttccaaccaataaaagaagagcgtaaaccattggaatcggtaaaggaataataaattcctatcagaaatggtacgacaataatcaatagtataaagaaaactgctggtaaaacaaaagccagatattgatgttttttgataagcatttttatcactccccactttggatttccctgagctgtcgatatttagccgatgtttcctttttcaattctttccaagagatcccatttacaaaatagcgctgtatatatggcccaagtgcttggttagtaaaaccattcgggtactgtttgtgaacaggagattgtgcgtttttggaagtgccgatccgataaatttgtttagaaagatcatcaggcagcctcgaaacatcaaagtttttagttgcaggaacgaaacgcatttcgttaatgattacgttctcagcttcttttgaagtatacatccagttaataaaatctttagcagctttttgccgcttgggatgatctttagtgattcctaaataccatgaggaaccggtcaaaagacggtcagtaccatcatttttaacaaagaacggtaacatgccaagatttttttgcacgtatcccttttccagaccatcaagcgtcggaataatccaatttccttgaggtatcatagcaactttaccattgaaaaaaaggtcttggacagaaggatcatacttaactgaaagaatcggttgtacattatatttttttacgagatcataataatttttcatttgcctctcgtatttccaagggaaagttttgcttttgaaagctttgacaagattattgttgtacggcagagaagtaaattgtgctgaaacagaagcaattgaactggtatcagctccgttaaagccgaaaacggcatcgattccaatcttctttttttctgaattgagtttttcaaccgctttcaaaaattcagaatagttattgatctttgaggcatcaatcccagccttagcgaacacagctttgttatacgaccagccataagcctcaagatcgactggaattccaaccatatgtttatttgaaattccaccgctaacaagatttggtactatgtttttacttgccttaagatcttttagattaatcaaatgatccttataccgatctatttcaggtagcccgccaagcataataatatctggagcttccccagaggcaaacttcgcttgtaaagcagcggccccaccgccttgacctgaagtagtaatttggatattgacgttgggatgtttagcatgatacatccgcgctaatttttgatattgtgcggttatttcaggcttttgattaaaaaagttaagtgtaatttttgaatttttttccttttgcgagctaaaactacaacatgttaagacaattaatgataaactcaacataaaagttagcttagcgattttaaaaaatctttttttcatgtcttccgccccgattcattgtcaattgtttgtcaagagcaccattctttcttacctaaattttatgtttttattatgaatcactgcagaaacaaaagcaaagaataaactcgaggaggcgtttcttatgagtaagattcaaatcgaacacctttataagcgttatgataatgcggaaaatgataccctaaaggatatcaatcttgagattgatgacaaggaatttgttgcaattattggaccatcaggttgtggtaagtctacactattgcgttgcttttcaggtttggaagaagttacaaagggaaaaattaatgtagatggaaagcgcttcgataatattccaccgcaaaagcgcagcattgcaatggtttttcaagattatgcattatatccacatatgactgtttacaataacatggcgttcaacttaaaacttagtaaattttctaaaagtgaaattgattcacgggtcaaggaagcagcacaaaagcttaatctcacagactatttggctcgtaaacccgcgcagctttctggtgggcagcgacaaagagttgctttagggcgtgcaatggtgcgcgcacctgaagtctttttaatggacgagccgctttctaatttagatgcgaagttacgtgtttcaacgaggcaggatattatcgagctacataagcagcttggaactgtaacgatttatgtaacgcatgatcaagctgaggcgatggcaatggcggataaaatcttgatcatgcgagacggagtggtacagcagtatggtaaacctgaagaactttatgataacccgcgtaacctcttcgttgctcgttttatcggttctcccagcatgaatattttaaagggtactctttcgaacaagggaatttttaattcaggtggtgtaaattatgaccttagtgaattcgtgaaaaaagaagttttgccaacggataaaagagagattgtacttggctttcggcctgagaaagtaacgcaggtaaaaaagtcaggagataatgatacagctcctgaaaattctgcacaaaaagagggattttttgtactttctgcaagtaaaaatctggctgaatacatgggcggccatacgcttgtctatctaaaaactaaagatggtgttaatattgtgactcaaacgcctaaaagaattcctaatgatgatagccacaaaaaattagatctttatattcgtaattctaatatttatctgtttgatgctaaaagcggtctgacacttcaaaatggttagctttaccagataagaaagaaaacggttaagttggagagaaagatttgcttaccataaaaaagcaaaaacgtactaatttgcaatttgccatcaaaaaaaaacactccccttatctgctaatatcaattattaactattgcttgtcttttagtcaatcttaccataaaaagttacacttgatttgataattcgtccgacaaaaagagcccgggaattgatccctgactcttttttttaatcgtttaaaccggcgttggcccggcaatttcaaagctaaagtcgtggtcgctgtcaccagcaatgtggtaaggagcttccgcatcggagccccaactatcgattcccccgactccgcgaacggcgccgtaaatcgtcagaactgtccggcgcggcaccggcaactcctcttggtgcgtcgcattttctaattccgttggcgtatagggtaagcaactaaacgcaaagtggtgctgcgtttgccggacttttaggctaaaggcatcgtggtcagcatccgcattgttttgtgtggtccctcgtgtcaccgtcacccactgattgtcgacgtgcataccgcactcttgcggcaccagataaggggttaccggcaggccagctacctggtgaatccctttacggccaccggctttgcgatccggatacgtttccccagaaagtccctggtaagcaaatcctaaggctggcgtcggcatgactaatcgcaaccccagcgctggcagttccggcaagtccgccttgcctgcatagtgtaccgcaaccgtcatcgccccactagcagctaccgtgtaggtcaccgcaatggttgtcgctggcgtcgttggtgtggtataggtaaacgtcacagccacagttgtagccgtttcgtgatcggaatagcggttattttcaggggcaatcggtaacggaattgattggccgtcaattgccacgctaatatgatcgcagctgctaaagagatctgcccctagccattgggccgacttagtcgaaaatccattgccacggtcattatcggtcgtggctcgccacaacgctggcatcggcgtccggtacaaccattccttgccgtcttgcaccaaggattccaagccgccgcgatcataggcaaaaatgtaatgaaaacctggtccgctgacccctaacgtcacgtcaccaaaaatcacgtttaacttagtcgtgttgtccatagtaatagtccacctcctgtaaagctggcttgggtgtccggtcagcaaataacagcccgtcaccggaaaattcataatcagaatggcgatcgtcaaagtcaccgccataccgcagtactggctgtcccgtaacctcatctttaacccacaaggcctggtcaatgaagtcccaaataaacccaccctgatacattgggtattggtcaatcaacgcatcataactggccatcccgcccagtgagttgcccatgtcatgcatgtactcgcaattgacaaagggtttctggggatcgtttttaaggtaatcttcgatcgcacgtggcggatcatacatcatactttccatatccgagatgcgatcttcatagacccgattacggcacaccccttcataatgagttaagcgcgtcggatcggcgtggtggtagaaggcatccattgccgcgatgttatcgccagcataggattcgttccccagtgaccagaataaaacggctggatgattcttaaacatctcatagttactcttggcccgatcaagcacggctaactgccattgtggcaagcttcctggcacattgtaagacggctccacagcccccattttttgccaagttccgtgcgtctccaagttattttcagccatcatgtaaataccttgctgatcacataagtaataccaggcatcttggtccggatagtggcacgtccgcaccgcattgatatggttgtcgtgaaaagtttggagatctcgcgtcatgtccgccatggtcacagcccggccacgatgtgcattccattcgtggcgattgacaccatttaaaattaatcgctgaccgtttaagcacatgactttatctttgagctcaatgcgccggaagcccactggataagggacgacttccaccacttgaccagcaacatcttttaaggtaatccgcaattggtaaaggtaaggatcgtggtgatcccacaggtggacgtgatcaatcgcggccgccaagtctaacgtactagccgccggttgctcagttgcccagacttcttgaccatcggccgttagtagttgcgccgtcgcagtccccgaaagttggctagcagccgtcagttgcaagcgcacttttaaatcacctgtctgaaacgcgtcatctaaaccagctcgaatggtcagatcttctacatgcagcgctggcttggcaaccaaccgaacactccggaagatacccgaaaaccggaacatatcttggtcttccaaaaaagcggccgtactatgtttaaagacttccacggccaataaattttgcccggcctgtaaataaggcgtcagatcaaattctgaacggctaaagctatcttcggcgtagcccacaaactggccgttgagccagagaaacatggcctgttcgacaccgtcaaattcaatgctaacccgttgattggctagcgctgggttcaaggtaaagtgcttgacgtaagccccaactgtattttggggatccgtactaaacatccctttttctggctgatcagcgcccatactgtaagccggtcgtcgataatgatgcccctcccacggataggcggtattgatatactgaatctgaccataaccagctagctcaatatgacctggcaccgtcagccgatcaaaggctgaacggtcataatcaggttggtagaagccttcaaatcgatgcactgggtctggcgcaaaggcaaattgccaggtcccgtcgagactttgaaccaggctactgtgctgcgcggtggcttcctcaactgaagcatacccacggtgatcactgtgcgctggtagttgattgatccgaaatgtctgcggatcatctaaccaagtaagatctgctttcaagctacttcctcctttttataaaacgcttacactgaccattataccgaatccgggttatcgaacaaccatcaaagtaaattgactgcccccgtcccgtttagatttatacttttttacacaaaaaccagtacgaccaacacactatgtgtatgggacgcaccggttttgaataaccgtttaaatttttataaaacccgattaactgacccgtgcttgtcgtaacccttgcacccgatcaacaatgtcttgaacggttagttttgctagctcggcttcggctgcctgttggacacgggcataggcctcatcgagtgcttgctggatattagcacccaccggacaatcaatattggtctgcggatcaacatgcaataaatcgtgattcatttcaaccgcgtgaaagaccgcttgtaacgttatttgactcgccggtcgggctagtcgtggttcggcggtccccgcacgactcatcagtaagcctgctttcttcattgccgccattaaccggcgaacaacactgggattcgcttcaacactgttggcaatcgtagcgctatccaattgcccagtcggcgcaatttgcacgtacactaagatatggattgcatcacttaacttgtgagagtatttcatcaggtcctccttcaaccacgaccgccccggtagacgctaccgggaaagaatttcgcgaattgccgttgctaatggcgtcactgggcgtcccaaaacatcagccaagtctgatgaggtaacgtctaattccccggcacgcatcatgatttgcatactaagtaaaacttcaactaattctggtgccacaccggcttcacgcatggcctgccggtaagtgtcatcactaaccgccttaaaggtaacggcttggctcgtcaccgtttgtaacgttgccgccaattccgcgtaggtgactggcgtcccagcaaattcataaaccggtttagggactggcattgtcatgactttagcagccgcttcggcatactcacgttccaacgcaaaaccaattcgaccatcaccagccgcataaacactgtcttgaccttgagcaccagcctgtaaatagctgagctcattttccaaataccaagcattacgcaaaaaactaacctgtagtccgctagctttcagtaaagcttcagtagccacatgatctttagataacggtgactgagccgtatccgccttcgcaaaactggtgtaagcaacatagctaacgccggccgcctgtgccgccttaacgacattggcgtgttgttgctgccgtgagattggaccacctggaaccgaagaaataaataacaaccgatcgatgccagccaaagcggtagtcatcgctacttcatccgtgtaatccgcctggcgcaccgtaataccagcaggtaagagccgttgccccttttcgcgattgcgaacaacggcaacgatatcaccagccgcaacggtcttcaacagttcttgaatcgccaattggccaaaatggccggtagcagcagaaatcgcaattttcatttaaataatctccttattttaacatctgtcatttttaatacaacaatcccattggaactaatctggatcatcacagtgttactttattaagcacacgtagaactataaccttctgttgttttaaagtcaacaggtgatcgtcttcttttatatctatgtcaccagtcaaaaaaagcccagacgtgttcgcacgtctgggtcttcttaacttctattctacttactctccagccaaaacaaatccccaaagtaaacattatggtcgcgaccgtcgccaccaaactagactgcctagccaaccaccaataaccaatatccaagcccaccagttaactgtcgccacattttcgttggtttgcgggagggtaacctgcttatcagtcagcgtcgtcacgggatgctgactgcgtgaacgaatagtggaaacaattacccgtttcggttgttgaccacgcgttgggtgtttcgtggacacagccatttgatcaagtcgggagggccgacttggcacaacgggcttcgtcggcatagctggtgttgttggtaccaccagtggtgtcggcttgacgggagtgcttggaataattggtatttgtggaagaactggctctgccggttcgctcggcttatctggtatcattgtcgatgctatcactgactgataatacacggtaaggtccaaatctttactggttgtcgttaccatctgcgccgcaatctcactcaaattgctattcagcgcatcagtactgacagcctgataaccctgtacattcggattagtaaccgggctaaatgtcgatgcttctcctggaatccaccgaacagtggacgttaccaacggctgaccggcagtatttaacagcagtacctcattatttcccagggaataatatgtgctaatgctgccattagttggatatttcacctgtaaaaaggttatcggttgggcctgatagctgggggcaatcacttgttgctgctcgttaaggtaatgaatcatttcatgaacaacccgtgttgtcgcataatccactggattttgatcgtacacatagataaccgtaccattatcgccaacacgattcaggtaaccattggccggactactaatccccgtagtcggattgtcacccatatttacaaaatgatatcccgaaatatctagctgcgacgtcgcgtaggttccgttaaccacggccccatccggatagttaacggtggcttgcgctaattgttgaccattcaaatcgacgtactgcacgttcatcgtggccgcttgctggaaatcaaagctttccagcttaaactgctgcaagttcttagccccaccggttgaggcactcactaccatcgcgaaggcttgtcgatcaactggcgctaacttggtccaagttaacacgtggccattagtttcctcataggtcacctgcaacgcttgaacagaattaaagtccgtttgagcccaccaacgatcatacgcatgcccatcaatggattttatctgctgatcggtggtcgtcacgaaaccaccaaattgcgcaggatcaggatcatttgctcaaccataaccattagcatccgtcgttgacacttgtgcgcccgaccgtaatgcttcaggcatgtgtgcgccgttgtgccatgtatctaacttcaacccaagcgcgtcaatcaaaccgccaattcctaagttatcaccggcattaccaatatccgtactattgccattatgaaaagcaaatccaataccatcggcaccacccgtagcggaggttcgattacccaagttaacttgccccagtaaggtgaaattagtactagcgtcaattttaggtttcaacgcaaaattaccaacctgatcatttttatcaggtgtcactgtgactatccccgtcggtttatcgtaagtagcggagccattcaaatcaaaatactgggtgaaattatcttgatcaacatgaacatacgcaggccgctgcgtggccatcactggcttagcaactggcgctgcgatgtgcgactactgagccaatggcgccgttgaagtagtaggagacttgttgactggaaccgttgtagaatctgaacccgttaccgttgccgtcggtcttgacgtcacatcatttgcagcggcgttagttggcgctaccgctgctcccgtagttgaaacatgatgtgtgaccgaatcagcaaccgtaaccgactgatcagttgtcacgtccgaattcgtggcatgactgatcggcgtcgacacagcatcagctgtcgttgctggtggtgccgtgtcgacaccatcagccgcagctggtaataccgttaatcccaccccaaaaaccaaaacccctgaaaataaccatagccgttgatgacgcttccacccgcgttccatcgataactctcccccagataaactcataacgttcgtttagaggcgagtatacagaatttcttttcacccgaaccggaatttgtactttaatgcaggaagatatatttaaaaataccgtggcaaaattcaatccttttgcgaattaatctgtcggtactctagcggtgtttggccaatttcacgcttgaatcgcttagaaaaatcggaggtgtcatagaaccccaattcctgagcaatttgcttgacggaaacagtcgtcgttagcaatgctcgttgcgcctcgcggatcttcttcacgttgatatagtcgcgaatcgacatctgcatttcatcactgaaagcccgctgaaccccgactggattacaccgctgattgacgtgatctacaacttgtttgaccgttaacttatcacgtagatgggcactcacgtaataaataatatccaacgttgattccagatggtcgtcgtaaggtaacccatccttcgccgctaggttgccaaagtcctgaacaatttcaataatccatggtacatatctggccgttgtaacgggtaatgtcttaatttgccgatgatagtcatcacgcagttgaataaactcgtatataaaggcatggttctgaactccttcaaacgctaaaatatcaacgagtccatgcagctgtgcccgcttttgctgcggtggtaattcatttaataagagacgcgaacgggccaaattttccttggcaaattgaatgccctccgcaattcgtccagcacgataaaagcggataaaatcacgttcgacatatcccagcaatattagagccttagctgtttgatctcgagaccgataagtctgcatatcgtctaaatagtgcgtgaattgcaaatcccatcccattattccaaacctcctcgtgaaattttcagtgataatacccagatatgccatatcctatcaaaaaagaatcgacaattctatcccccttattcgcaggttgcacacttatcaatatatggttaacttattatcacaacttctcttaataaccaataactttgtgcatgacgttattttcactcgttaatagtttattttccagttaaatgctcaccatcaccgctactctaccgtagtcaaactgcttttttggttgatcgattgcgctataaattttctgtagtttaaatgactaaatttctctccacttgctcaccaataacccgggttatacggcacatttaaccaaagcttccctgcatctttactggatttaaggtatactttaagaaaatcagattatgaaaggagccgatgaccatcattacgcggatcatcaaaggctgtctctgcttactggccctggggactgttactgttggcagtttaagcggccgtgctcaaacagaaaaacccagcgccctcgtcaaggtcggcgactatcgtgctagtacggactttttaaatctaagcgcttattaccaaactatccgaccagtaactgtaaaagtggcctacgtctccacctacaagacccagcacaccatcatgcaaaagctgacgttaccggctggactcacagttgccggtaatctcaccactaccaagcatggcagctacttggttcccagcttgcagctctatttggctcgtttgagctaccccgcgctgcaaaacagtgctaaggcgaactacacacttgatcccggaaccagtgcgtactcaccacaggccaccatctcagacaccactaagttgcgtgccttcaagagggttgcagctcccgactacatgccggggtatagccatggtgatctctacatcggcggtgctaaagcggcattaagtccggttgaaccaaccactaagagtatccgcatcacgccagatggttatgtcgaagtgcttaaatacgatactaaagccaatgccggtttaggcttctaccaaaaacccgttagcctagctaaaatcgtcaaaacacggttccacgatcccaaccggaccctttacttgaatcacccactcgcaagtgtcaaaacgaaggccattacgcaaaatgggcagactcgataccgtttgacccttaaaaacttacacacgccgcagcatattgctggcgatcctgaaacgggaaccgctggcacctttgatagtctttattctattggcggcaccacatattacacctttattgggtatgacggtgtcagcaattaagtcttggctaatcaattataaaaagcaggctttccaagagttcaaatactcttgaaaagcctgttttcgttatctcttagattcgtttctactattccgacaaacgccgaacttgttgctcaggaacggccactaactcgccaattgctaagaggtataaatactggcccacaattggttgacccgtcatttgttttaacgctgcggcatacaggtttacctgacccccatagcgttccacgatcttttcaatactggccgcttggttctgggcattcacgtggtccgtcttgtagtcgaacaaaatcacaccagccggcgtggttaaatacccgtcaataatcccgtggactaatacctgtgagtcggtctcttgaaaatcttggaacaagctgcgagccggcatcaacaatgaaaatggcacttcacgatgcagctgatccggtgctgctaaaacctgctgaccaaccgaactgctaaagaaacgtaaaatcaattccggttgtattcgttgggccacttctgccgtcaagacttgatcggcaaccaactgatcaataacgccctgtacccggtcgagtgtgggggttacggtcacatctaactgctgcaaaaccaggtgggtcgcactcccaatttccgttgcgagtggttcacggaccgtttgtaaaaagtctggtcgggcaaagtcgtgagtgacaaatcgatgcccccccacttgaccggtagcgctcgcctgatattccccaatcgtggcgttatccgggtcctcaaacaggcgcttggcctctgagacagattgataagctgtggtcgccgttgccgcttgatgcgggtatcggaaatccataatttgatgaagctgttcagtatcgaccggtggggtcgtcaccttagcagctgtttcgctggccgcttgtaaccagtcaaccgccgtctcattcactccttgggttggacccaggtcatgggccgtgacaaagtgaacggtgaaagtcgcaggatcacccgctaaaccagaaaaggtcgtggttccctgacgcaactcagcggcaaactttggatcacgcaccaaacacatcccaatccaatcaagataattggctagcgtatttttctcacgcagggtggcgtttaaaactaaattggggctttggtaagcctgttcccatgctgatattgcggcttcttgtgtcttgtgagagccaacaatatagacgcgcgattctgcacgggtcaaggccacgtaaagtttacgcatttcttcagccaaactggctcgtgaaatggcttgcgccgtcactaatttttgcaaactgggcgccttaacccggctatcaggatctaagtaatcgatcccgattcctgtcttgccactcatcacataattaccttgctggtcttgtttattaaattgccgcgacgcatccataatgaagacgactgggaattccaaccccttgctaccatgaatcgtcatcacagatacggcatcatcagcggcttgcaccggcgcaccggcgaggtcatcgtcacgttcttgaagccgttcgacaaaccggacaaactggaagaggcccttgaagctactttgttcataactcttcgcccgttcgtacagagcgtgcagatttgcttgccgctgttcacctgccggcatcccaccaacgtaatccaagaaccccgtctcctgataaatccgccagattagcgtcaccaactcatcttgttgggcaatatcgcggaattcctgcaactgttcaaggaaatgactgactttctggtacactgcctgctgaaagtcacttgcctggttggggacgaacgatctctggaagtgtaaaaccgcttggtagtaatccccggtccgttgattgattcgtaacagcgccaattcgttttcatttaagccaacgatgggtgaacgtagcaccgccgctaacggaatatcttgataaggattatcaatgatttgtagtaaggccatcataatttgaatttcggtcgtcttaaagtagttctgcgcatcattgacgacgaccggaattcctaagcgacgtaactcatccgtaatgatcagattgttagtccgtgttggagtcagcagcgtgatatcaccgtaagtcattggccgtacctgcttagcctcacggtcgtaaatcggggtctgatcggcaattaattgctgaattttttggccgaccatcaagacctctccttggtgtttattatcaacctggaaggtcgcatccatggcttcactatccgcgtcacccgcgctttccggggcatcttcggtcagatacaccagcaactcagccgtactcgtcaccgtatcgggatagtaactggcaccaaatttcagttgcgccgcccccgtataatcaatctcacccagctctcggtccatcaattgcttaaagatcagattggtaaaatcatcgacgtttttcattgaccggaaattttctgccaaaacaatcagctcacccgcagctgcatcggctgcatactggtccgttttcgtcataaatagcgtcggatcagcctgccggaaccggtaaatggactgcttcacatcccccaccataaacaagttgccttgcggggcaggctcagcaatcgccgttaaaatcgcttcttgcaagccattggtatcctgatattcatcaaccatgatctccgcaaattggtggcgtaactgagccgccacctgtcgcgactggtcactatcttgcgtcaaaatggctaacgcagcatgttccacatcggcgaaatctaagacgtgacgacgctgtttttcttgccggtacgccgttcgaaacgccgtcaccacccgcgatagttcgcccactaattcacccgaacggcgaatcgtggtcatggcctgctgctcgtcttgaatcaagtaggtctttttcaaactatccagttgcttacgggctggatcatagtaagtcgttttcaattcattatagatgggatagtcttcattagtcttacggaccgctggcatccgcccccacgcaaagtcttggatagccgctcgtaaggcgttccaactgtctccagtaaccaattgttggaccgcagcaacgttttctaatacggccgtcacatgcgccgcttgtttatctaaaccggcttggttcgccaaagcctgggcactcgtcaagtccgcttgtagttgctgcaactgtgactgaaagaacggtcgtaagcgttgctgataaaaactagtggtcatcagttggtcgctatccaactggtagggttggggcagttcagctagccaggccgtcggattaggcgttgcgttggcaaatgtatacgtttgttggaccaaatccgccaggccttggtcattgcgatctcccgaaaagttttccgtcaaccgcgcaaataatccactgtcatcattggcatataagtcctcacgcaagtcagcccagacttcatcgcgcaggagaccattctctgtttcatccgcgagcaaccggaaaaccgggtccaaatcaatcacataatagtagcgctgcaaaagacgcagacaaaaagcatctagcgtactgatatcggccactggtaactgatttaattgccgcagatagaactgttgttgggcactatccccctgactaactgccaactcttgtcgaagagcggtctgaatccgctcgcgcatttcagccgccgccgctttggtaaacgtcacaatcagaatttggtcaatcccgacccccgttttcagacgttcaatgacccgttgcaccaacacccgggtcttccctgaaccagctgaagccgagaccaatagattattcccggtttgatgaatggcttggtcttgactgggcgtaaaactaaatttcgtgctcatcagtagcctcctgttcttgttctgcggcaattcttgccatgacatcatctttatttagcgatggcaagtcccggtaattattttccttaagcaatggatcaaactgcatcacggatttatacggcgaatactgcaaggccgttcgattctgctcacggaatggagctaaatcaacccgtccgtcaaagatatcggttgcggcacgtttgatgagccgttccgtatgcgttagcaataagtcaagttcattggaattaaccaacaacttgccataagacgtaattttccctgtcttggtccgacgaagcccgcggaataacagcgaactgccactataatccggcgttccgaataaggtatctaaattcgtcagtaagtcggggtcatctaacaataacccttgatactgctccgcctttaacagtgaggtcaagggatcttcgcctaaaacctcagcggcctttaaaatggggttttgtaagtgcaggtataccgcgccggctagctcggcatccttggcggtcggggcatctaataacgttggcagattttgtttcacggcatccaaataggttaacatctgcatggcgcggccataataggcttcttggtagctgaacttatgctcagaactcttataatcaacgatccccaaatacgttttatccttaacctgtacggcatccaaccgatcaattcgaccacgaacggtcacctgacgccgtttgcccacatcaaaggataacgcggccaatccccgctcatcccccaacccgaattgaacttcggtccgcttggggcgtagcttcgtccgtttactctgttcctgaagggtcttggccatttgccgcatcgtcttcatcaactgctgacgaatataccccatccgatgggaactctctaagatcgcaaattgcgggttctccgtggtatctaacagtttagccatcacttcatccgtcatttcacgtaactgctggtcatctagtgccgctagattcagcttctggtcgttaacgagcttcattaacccatccaaggtggcatggaagaactctccggtactagcgggagacaacgcaaagacatcccgctcttgcaagttcaacccatacttgaggaagtaagcgtagggattggcataatattcttctagcttagaaatggaggtattaattttcgtgccatacaactgcgtcacgatgtcaggcgtcaactgggtcgggacatttcggtaactcaagctccccagtaactttgtggttaattccccataagtcgggtcagtccgtaacaaatttaagacgtacagccacgatcgcgacaagggaacctcacgtaattgactatcgtgactggcctgaaccagatgccgcagcgtggtacgccgcgtccccacaaagggcaaaatcgcttcatcttctgccaccggattagccgccgctatgtcgattgacagaccaaagtaatcctttatccgcgccacatatggcgatagttgcaaaccactgcgcgcatcatcactcatcgctgggtagctgaaaatcaaacgctcactgccgctcataaaggctaggtagttcagataaggctcaccagcaagttgtgtagcggcatcgtctcgcaaataagtcccgtcatcgacctgttgcagccgggcacttaggtcttgacgatcattatcggctaacaacgttgtcggaatctggttatccggcattgtatcagccgtagctcccatgataaaggtgattttgcggttattggcctgaacaatcccactttccgagatcaccacttgatctagggttgacggaatctggctaaatttcgccccggcaaatcccgcttgcaagagggcctgaaagtctggtagcactgtcggtaagtcgcctaaaatcgtatgaaactcgtctaaaatatcgcaaaaagccgcccatgtttgctctggttggcctgctttggtcaggtccccagcagcgatcgcttggtcgcgccacgtcatcaaacgctcactgacgccggcattggccacaaattgatacaagaccgcggcggcatctgtatacgttgcggcgacctttaagcgggcaaaaaagggtggcaatgtttgcttcacaaaccggcgaatgcggttaatttgcgcactgatttggtcatcacgggtggtctggacacccccatcgcccacggcaaaccggttatatacccaatctttgtcttgcgtccaccaatgttggccttctaacccattcttcaatacaaaattctcggtcaatgccagtgcctgccgataagccggcaccgccatcaactcgccatcagcatcacggggtaataatagttccgacttcaacacccgaaagacatctgcataccgataatttcggcgttgaacatcgaaaagcgcattcaatagctcaacaaaggggtgatctgccattcggatatcggcatcatcaaagtacggcacggcttgcgcctgaaaaatgggatcaatcaccgtctgataggcatcgagatgccgcgtcaataccaagaaatcacgataacgatagttgccagtggcgaccaattgccgaatctgcgtcgccactcgtgacacctcaacgtagcggttagccgcttgtacgatttgaatgtgggtgggtttttcgaccgcacttggctgtggtgataaggtttgactcgcttgccaataggtgtctaaggcctgcaagtcagcggatacccgcgccgttttagcttgttgatcgattaaaaccggaacccgattggcttgggcgaccatgtagagctgctgatagagtttggccgattgaaaaaaaagcgtggtcttatctggtaacttttgtgggtaaccgtgatccagattcaacgcaaccgtgacactggccgatcgttgaattaagatggcgaccaattggcgttcttgagcgctgagctgtgaaaaaccttctaagtagaaatgggcatgctgcaagtccacttgctgctctaaataggtcgccaactggttcagcaggtcggtattttccacaaactttcccatcatttgcgtttcaaaggcctcatagattatcatcaaatcatgaagcttggcttgtaaatccgtattcgttgtgtcgagttgctcaatggctgacatcaaatcagccgccgtgacttggcccaccttgaattcagctagttgggtcgccaattggctgacgaaacctggccgatccacttctcctctgaagatcgtcagctcgtctgcgtgggtttggataatctggtaaatcaacatgttcagtcctgctggcgagatccgtgggagttggtaaatcggttcatttttcatgaaaaaccaggctaaccgagtaaacgaaaagacttgcacctgcgtctgggcaaataaggcctgctccggtgcaatttgctccttcaacgctgacaacacatcgacttctgtttcaaacttgatatggttgggaaccaaatagtaactttgatccgtggggtgcgcggttacttgctgcgcgagcgcggtcaccattggcgtgcgatgatcctgccccgcacttcctaaaataaattgtaaactcatcggtcatcctccttacgaaattgttcgctatgtatgtgctgttcgcctttcgattgcagcaatcgggctggaaccgacctaagccattgccactaacctccgggctgctgtagtgtgcgtaataagccaaggattcagcttaccgtggcttctagttgattatattctagcatagctttagccgaaacgaacacacgttcaacttatctttgataacttttccaactatttcccccaatccgtgctacactgggaagtaatattaaagaatgatgagaaagcgggcaatcctctatggaagatagcgaacagattcagatcttacaacacttaattagtattaactcagtcaatgatcatgaggctgacgtggccgcctacattcaacaactctttgccgaccatggcattacctcacaggttatcccctatgcagatggtcgcgccaatatcatcgctgaaatcggcgataccaccagcgatcaagtctttgccttagccgggcacttagatacggttgccacgggcgatgttgctgactggaaatttgatcccttctcagcgcacattgtcgacaatcaactctacggtcgcggtgccgccgacatgaagagcggactggccgcgatggtgattaccttaatcaatttggctgaccaacagacgcccttaactggacgcttacggtttattgggactgtcggcgaagaaaatggcgccatggggtcacgaatgttaaccgaaaagggcgtggcagatgatctcactgccatggttattggcgaacccaccggtggtaatctggtctatgcgcacaatggttctttgaactatcacgtctattctcgcggtgtcggcgcccacagttccatgcctgaaaagggaatcaacgccattacgaacctcatcaaatacgtcaccgcagaggcaactgcctttgacgacgcgcccgtcagtccagaacttgggccactggtccacagcgtaacggtctttaatggtggcgaacaagtcaacagtattcccgctaaggcggagctgcaaggaaatattcgccccattcccgaattcgataatactgccgtcattcaccgtctccatgaaacggtggatcggttaaatcaagagcctggtgtcgatttagccttgcacgtagattacagctttaaacccattattagtgccaaagattcgccactggtgcaaacgaccaaggccattgccgaccaagaattcggtcacgcaatcgacttacaagtcattcacggggcaaccgacgcttcagaatttaccaaatccagtcatgacttcccggtcatcgtctacggcgctggtaaatgggatgccgctcacgccttgaatgaatccgtcgatctggatgaattccgtcatgttcaacacgtttatcagcaactcgttgaaaaatttcttagctaatctcccgatttcctagaagacgcgctaccttcgcacggatagtctaacgacaaaaatcgtcagcagccactttggtggctgctgacgattttttataatgccttatttaccaacggtccggtaatcatgggcgccaaagtattgtaaccctggcaatgcttgactgttcagaagttgactaaccgtcaccagcttgtaccctttagcctgtaatcgtttgataattgttggcgctgcggctacggattgagcgtggatatcatgcattaaaataatatcgccgccatgggtgtcgtgcataacttcattaatgtccttgctactattgaggtaagcccaatctcgagaatcgactgaccaacggataattggctgttcaatcgctcggccctctgccgccgtgatattaccgtacggtggtcgtacgtattgcggtaacgttccggtggcttggtagattgcccgattggttcgggttacttgactcactgtttgtgcggtcccaatactattaaagttgggatgattccacgaatgattgccaatttcattgccgcctgccaagaccgctcgcgagatctttggatagcgactgacactctgaccaacttcaaagaacgtcgcatgcgcgtggtatttcttcaacgtcttcagtaaccgtgatgtcagggttggatctggcccatcgtcaaacgttaaggccactaatttactggtcttaatggtactggttcggttagccttaggcagatagcgattcaacaccttacccttgagttgcgcatacggaatggtaatctgcttaaccttaaaactattcttcaataggttcatgcgtaacccactcttggttaacgtcgccgtttttgtcatatgcgttggcaatttcacctgatagaccgctgctacccgactacttttggccttagtggttgttaaaatttcctggcgagctgcctgccgaattgcggctagtcggtgcgtattcttgttcgttaactgaccgaatgtcaccgtcttattggtactcttagcctgccccgtcaccggcacactcccaacgcctagtgcaacggtcgccactaggacgccgagaacttttccaatctttaccatgttgataaccccctcttaaaatcatgcccctgaaactatcttaattttatcaggtttagggccaaacacaggtgtgaacgctcactaaattttcgataataaaaaagcacctaaccgtcgttaagtgcttcctagtcatcggtgctttccggtggattaactgtttgatgattttctttcaaaacctcattggtgtagcgttccagatccgccaacacctccgcattatcaccctgttgggccgccatgttttcagcgaccgcccaccgggccaaggtatccgtaatcggcacaatatcttggataatcaccatgtcagaatcatcttgatgttgttcttgaatcgcacgaaaactatcaatatccgtgattaaccgcaagactttgccagattcccgctcgacagattgaaaaataacgaagtgggcgcgttgattggcctcgtccatgcgttcgcgaattgcctgtagttgttgttcgtctatttgtaatgccaatgccttcaccccactaggtttattctaacaaactatcgcgccaaacacgccataatttggtaagtctcttaaatttttagcaaatcgccaacgattggtagtcggcgccacccgcttgtaacaatgagacggccacctgtgcgactgtttcacgtgaaacagttcccgctggaaccgcggcgccttccttaataatttgtgggtcgcgccgtggtgagtcggccaacgttacgggccgcaaaatcgtatatggaaattctgcctcatccactagtttagcggcatatcgctgttgctttagatattcggccacgtcggtgattcccggataagctaaatcgcctgtcacttcctgatcgaccccagccgtactcagcatcacgaaacgttgaaaggttaatcgctggtgatattgggcatcgaagagtgcttcaaacgccagatcaacgtccatccccgtgagtgctgaaaagatgatgggttggtcctgcaaggccgccgtataagtagcttcctgcgtcaaatcaccggtcaactccgtcacttgggtggctaagtcgctgggtaacgtttccttaccatcgtgtaagaggcgaaccgttgctgactcggtcgccagttgacgggccaccaattggcccacccgattggccccaataattaaataagttgtcatgtgtctcgctcctttttccttgctttagtgtaccagaaaccgtgcgaccatggtactcactcaggggatttttaattctagtaaaattcggtataatggaactgtatttgaatccggtttcaacattataggagggtccagcatgacacatgaattggtaacactcggtaagactgatgttcgcacgacaccactcggtctcggaaccaacgcggttggcggctataacctcttcccaaatttaaaggatgatgatggccttaacttggttaaagctggcttgaatcatggcattcagctacttgatacggcctttgtctatggtctcggtcattccgaggaactcgttggtcaagccatgcacgacttcgatcggcacagctttactttggcaaccaaaggggctcaagacttctcaagtggcgaacaggtcattaacaatgatcccgcgttcttgacggcccaagttgacgccagtttaaaacgtttgaataccgactacttagatatttactacattcatttccctgacaaacaaacacccaaggcagaagccgtgggcgccttacaacgactgcgcgaacaaggtaagattcgggcgattggtctttccaactttagcttggtacaagtcaaagaggccaatgctgatggctacgtagatgtcgttgaggacgaattcagtctcctccatcgcgaccacgagactgatttgatgccgtatctggccgatcatcagattagctttgtcccttactttcccttggcttcgggcttactgacgggtaaatacgaccaatcagttcagttcccggccgacgacattcgcagtcaaatcagtgatttccaagaaccgcgttacagtcaagccttaaccgccatcgaccaggtccggccgattgcccaagcgcatcaagctaccgtcgcccaaacgattctggcttggtacatgcaaaacccactcgtcagcgtggtgatcccgggtgctaaacgcgccgcacaggtcgaagctaacgcgcaggccttggaggtcaccttaacggctgcggaatatcaaacgattgataccgcctttgcgggtttcaaagcgactgctaacggtaaatcactcgccgatccagactagcttaacttttctatcagcagatgaaacgaacgatcaatagccgacacaagctcattagatgcttggtcggctatttttgacttatcagtaagttggatgggttgacgggttgagttggtattttccgaacattcgttttataaataaaactgtaattcgcaattgcaaatattttttaaaaatgatagactctaatagtggtatttattgatgtaaacacgaacaattatcattaatgttcggatttaaccaaattaattgctaagggagcacttattcaatgcaaagaattgccaactttttccattttgaagaactcggtaccaactataaaactgaaatactagcggggctaaccactttcgtctccatggcttacatcctattcgttaacccccaagtcttaggggcttccggcatcagccaaggggccgtcttcacggcgactgcctttgcctccgccttcgggtgcatgttgatggggattctggccaactatccgattgccatctctgccagtctagggattaacgccttcttcgcttactccgtcgttattggaatgaaggttccttggcaaacggcgctagctggcgttttcgtggcctcgatcctcttcatgattctaacggctttcaagctgcgggaaaaggtcgttgacgcgattccccgcgacctcaagatggccatcagcgccggaatcggcctgttcatcgccttcattggtttgagccaaggcggcttagtcgccgctgacaaatcaacgattgtaagcctgggttccttacaggttggcagtacgtggctcaccattttcggactactggtaacggttctgttgatgagtgctcgggtacccggcgccatcttcattgggatggtcgccaactcgattttaggtctcgttacgggtctgattcccatgcctagtcatatcgttgctgcagttcctagcatcagctcgactttcatggtggggttgacgcacgtcggcagtattaattccttacaaatgatcgtggtcgttttgaccttcttattagtcactttctttgatactacggggactttggtcggcttagctgaacaagctggcttggttaaaaataacaagctcccccggattggcaaagccttgatggctgattctagtacgatggtcgtggggtccttactgggaacttccccaatgggcgccttcgtggaatcctccgcagggattgccgtgggtggtcgaactggtttcaccgccatcgtcactgggatactcttcatctttggcgcgttcttctctccattgttggcagttgtgacggatcaagtcaccgcccccgctttgattatcgttggggtgctaatggcccaatccctaaagaacattcattgggaaaaattcgaagtagctgctccggcctttctgattgtgctgggaatgcctttaacctacagcatctccgatgggatcgcactaggtttcatcacctatcctttgaccatgttggctgctaagcgtggtaaggaagtcggtgctatgatgtacgggctggcggttgtcttcgtcttgttcttgtggattttaaatgccgcttaattaaaaataatctcgacactacaaaccaccgcacaattgttaggccaaatggctgatgattgtgcggtggtttttgagcctgattaccttgcaagttgtggtagttctttgcttgtgacagcgctacttccgctaatactagtagtttatggaagtagcggaaatgcccccacacctgtggggaatactgacaaccaaaaaatatacgactttaacttctgggatcacccccacacctgtggggaataccggaaagtttaaatctattaaagacgcacaataggatcacccccacacctgtggggaataccaccttttttaacgtttgacacaacattttgcaggatcacccccacacctgtggggaatacgttacggttcaatgaccagccagaggtagtttaggatcacccccacacctgtggggaatacactaaagaaaacctattataccggcattctcattttagcaataccgcgattctcatcactttgcttctgagtgcaggtcgtcatggttgtctaacaaataaaccagcccccataaatatcgccgaaactgacaccaagcctaccgatcttcgcctgaatgtaattgcgataacatacgattcataatgacctgatggaacttgttgaaccaggttgggttagcggcattaacttcttcatacatatgctgattaaccttatctaaaatatgcgcgagttgatccaactccgtatcatctaaaatcgttaagaatggcgggatttgttgcacatttttcgttgtttccttgcgcccagcatccgtgatactcaccacggtaactcgctggtccgtaggagatttcattcgtgtcacgaatccctttttttccaatttccgaacgaattccgcggttgactgcgccgtcaaatttaagcgctccgccaattctttttgtgccaaatgatcctcttgcatcaacgccaataaaatctttccttgcccttggaaaatcatttgtcgttcagggtggtcgtcatcgcgatccgcaatgtcatcggcgacatgccgcaacatcccaaattcaattaacttactcgctgtcgtctcttgcttaaataaatcgctcatctcgaaaacctccttgtctcattatactccaaaacaaaaagataaggggacctgaataaaaaggttgacaaattaatcaggggaccttattataattttgtcaggtcacctgattaattttatgacacatgagagaaggcattttatgcaaccatctacagctatcacggtaagccatttatctaaaaccttcggcgtcaaaaccgtcgttgatgatctatcgtttgcggtcaaacccggtgaagtatttggtcttttaggtcctaacggcgcagggaaaactaccaccttgcgcatgatgaccacgctgcttaaggccacgagtggaactgtcacgatctttggtcatgacgttcgcaaagaaagtcgactggcccgcgccatatttggtctaaccgggcaatatgcttccatcgatgaagatatttccgctcgcgaaaacttaatgattttttctcggctcaatgggttgtcccgaacggccgctaaacaacgaacgacggaacttcttgaagagttttcactgacagcgtctgctaacaaagcgctcagcgatttctccggtggcatgcggcgccgtttagatcttgccgtgagtctgattacgcgaccaggattgatttttctggacgaacccacaactggacttgatccccgaacccgatcgcagatgtggacaaccatccgccagttagtggcccacggatctaccatcgtattgaccacccaatacttagacgaagcagacgcactggccgatcgaattgccgtcatcgaccatggcaagctcatcaaacttggaacgccgaccgcgctcaagcagcaaatcggtggtgccaccttgaccttatccctcgccaaggcaacccaaggtccccttgcccaacgcctattggctcaggcactccatgcgcagccgaccttgcacggtgcccaactcactgcacatttggaaaaccccaaccaaatcactgacttacttgtgcaactccaggcagccgatatctcactgactaatattgccgtacaagaaccctccctagatgatgttttctttgcactcacaaccggaaaaaattaagaacgaggtgcccgatggaaattcaaacacaacatggtaacttaattggcaacacgctaacgatggcttaccggaacttacttaaaacgctccataaccctgatcgctttatggatgtcatcattcaacctgtgatgttcatgctcctcttcggctatctcttcggtggggcaatcgctggcggggtgcaagcctatctacccaccattgtccccggaattctgattcaaactctcctgtcggctgcgtcaggatctggcgcccagattcgcgaggacttggactccggggtctttgatcgctttaagtcattacccatggcccatattgcccccttggctgggcaactattcgcagatattctccgcttattggttgccactgtggtttctctactgaccggctacgcaatgggctggcgaccaactgcaggttttgggtggatcattgtcattgccgctttggccatcttcattggctgggccatctcatgggtctttgcgctctttggcctgctagccaaaagctcatcaatggttcaaagcgtctcaatgatggttatgatgctcctatcctttctttctaacgcctttatcccgctgaaaaccttacctcattttatgcgcgtgattgccgatgccaatcccatcacctatgtgatcaccgcaatccgccagatcctcgctcagggagcctggaacaataatgcttggatcgtgcttatttttggcattggcatcgtggtcctattcgcgccgttgacggtctgggcctataaccataataactaatccgtatcacccatgacgccaccatccttaataactcctatttaggcttaattaagacaaaataacccgggaaatagcgatgataatcactgtcatttcccgggttattttattagtgtctattttgctagtagctgatcgtctttaatgactcactttacagccacgttcccaacgcaaacaatacgggataggcaatgaagaacaaagaggcactcttaaccatcgccataaatgtcttacgcttgtcctgaatggcaaagaacgggcgcatcccccgccacatcactggcagtaagataaccgccaacgccgtaacgagtggtgctaaccccaaccctacatttaccagtgtccacaaggtgccaatcactaggaagagttggatcaaccgcaccgatcggcgtttacctagatagaccgccaacgtgtagcggtgattggcaatgtcttcatcgcgatccgatgtatcattagccagttgcaccgtgaagaagatcaacgtcaacggcatacacagcagaaacgtggtaccgacgattgaccaagacaacggttgttgcccataaatcgacacgtacacacaggttaactgaatcccaaaggcgattgccaacgccaccacggctgctgagaccggcgttgcgttgatgggatgcggtccggccgtatagaagattccaatcaagtaccccaccacaccaaagacggcaaccgaccagcccgtccgcatgactaagacaatccccggtatcgcagcgactgcatataacacccacgccagccaaaaacacccttagctggcaaatgcaagcggccaattggattggtcttttgcgcgtagtcttcacgatcatgcgcgtgtaaataatcgtaataattatccgccacgttgacggccaaatcgaagataaagaccaccgctagacatagcccaacattgatccaatccacggtatgtacgtgatactgcacaatcgcagcacctaaaataaaccacataacatttaatggtgctgtataaatttcggtcagttcataaaagactgaccagtttagccattttggcattaacttgtcctccccaaaatctggttaccactcctttctagtgtagcaaaagtgtcataaaaaagcgggacccacgacctggtcccgccaaaaatcattgattaagcatcagattttgatttagttgcgcgtgttttcgcctgaggatgtcgccaatgccaccagctcatttcacctaaccagaccactaacccaactattgttaggatcagaccaccgattagccccggcgtccggtaagtcaagcgaatccggtgcgtgcccgccgccaaacgggccccaacaaagccctcattaaccaccgtcgttgccgtgggccgaccatccaccgtcagtcgccagccactcgagtacggaatggatgtcgtcataacactggcctgtggcgttgttagctcacccgttaccgcgttatctcgtatctgagcatgctgcaacccccgtcgctgaacggcgtggacctgttggtcatagcgcgcgccaaacggtaccgcgatgagcttggccgatttaatattgagttgcttagtggcgttaaaggtcacatcaattgtcttgcgtaactgctgcgaataacccaggttcaataatacttgatgcttgggttcataatctgacagattgtctaagccaaattgggagaaggtcttggtcgcattccgcgtcttagccgtcacccagtaatcgcccaaatccgggttgctaatcgccgttcgccaagcgttcaacttggtcaaatttgaccgcggggtatttcctaaaacgctagtattgtccgctgtttggagttgatctttggttgtcagttgctgtgaactaatgccgtctaattctaaatacaactctgtcccctgggcctgttgcgggtgcttaagcgtgaccgtatatttaatcggttgtccttgcgcatcgctagttaactgatgcaggcccgtctgattggcttgagtggtccgttgaataatctgttgattatgggttaacacccgttgcagtgctgcttgatcccgatttaactgtaccatggggccgtactgctgaacctcctgcttacttaacaggccatttttatcaaccgttaactgaggcgtctgaattgtggtgccataggtcgctagttgcttgtcattgaggcccgtcttttgcccagccgcggcttgctttaaccggtactgaatgaccttgtttgtgctatcaattaccggaatcgtatccggcgttaccgtgtaagccagcgtgcgtttgggcgattggtagtgcgccgctttcacgccagcgactggctgggacgtcacagcagcttgcgttagacttcgctcccggtcaaccaagcttaaccggtgccatgccttggtcgttagtacttggggttgcgtataaaccagtggaaacgccaagttcgtggttaacacctgtgtgccaacaccatttgataacccgtacacgggctgttccggatagatctttttagccgcccgatacccatacggcagcgccgcgtgattagtcacttgatcggtccgcgcaaataaatacttgacccccagtagttgtgttagggtcgttcggtcatcggcttggcccatcggcgcattcatcgcatactcagcattacccaagtcgcggctaaattggccaacatagccattttgaacggaaaaataggacataatcccatgcagaccgtgagacatcgtcatgttattccccaccgtccggaacaaattatagttgcgcgtcgcacttacccgcgaaaacgcgtgatccgattggaccgccgactgcgcgccatcaaaataatcttgaatgtagcgcgtggcatcactgacgcgtagctgttgcgtcgcttgattgctcagattgggatcgtaataaccccaagcgttattgatcagatttagcccgattaaaatgccgatcccaccgaacgtccagcggcgcggtaaggccaccacaaccagtagcgtcgtggccaataataacccatacgtcagtaaatcacgcgccggattgctgaaggtaaagccgttactcaggtaaatgacgcctaataggccaaagctactccccaatagccaccagcggtcaggcaacgataacgccgtcaggtgatccatgagtgtcattaacgccagaccaaagggaacggctgctagcagaatccagcggttagatggcgtcgataagacgttaaagaacgcggccacggcaggaaagaggagcccgacaatcaccgcaagaagcgtgatggccagccaccgatgttgccgccagtgcaccagcgtatagacacaccctaagaaaccgaatccggtgatccccaacactgcccagtagttaagggtgttgcccgtcgttaaaatggtattgctgagtgttagataataattaagcggatataaccagaggccattcgcaaaaatggacaccgtccgagtggatttcagcatcatcaagagtgatggcagtaacaacacccccgaaatcagtagtcccgtaacagcagcggccaaaaaacgggccgtggcgactagccagctaaccgctagctgaccgcgctcacggcaactaaagtagcgaatgagggcataaattaggctgcccagccccagtatgtaagcaaagtagaagttactcaaaatagtgatcccggtcacagcggccaagaatccccacccttttccctgtaggattcggtcgatgccaacaaaaagtaggggtaaccagaccataggcaaaaggaagaagggatgatgaacccccaccatcaaagaatacccggtaaaggcatacgtgactgcgccgaccaattgactaccgggtttaaaggcgtagcgttttgccaggactagaaaagctagaccggccgcataaagccgtagaacaatggcccacccatagccgacctctaacaggcgcgtcggaagtagcgccaaggcatacgcaaacggatcacctaacacatagtaggctagcgtggttaatttgtcagcccctaagccaaaggtccaagaccaccccgtaacccctgctaggccggacttcattaacagctgatgaaactcgcgaatcaatgggtaatgttgcgtgatgccatccatgttccagattaaggtccgattagccaccccaaatattccgaagctaatggccgcgatcaccgcaaacgctagggtatataggacccaaagcggccagcggtggtgtgcgattctcatgataaatgcctcccccaataatgactatctagtatggtataacgattcaacggtggctgttagttagcgataaggctagtcaccgccgacatgcagaagttattcctaatttacacaagcaatacccccggtgtcaatgcttcacggtagacaatacccgattgtaatgtttcccgtggaacattttgctaaaatcccggttttgcggtacgcttactaaggtttaaaaactgaataattagcaaaggaaggaatttctcgtgaattctaagaaacgtgtttcgggagtcagcgacacccgcagtatggtgctcgcggctctcatagctgcactctacgtcgtgctaacgacggtcttgtcagccctgagctttggtccctttcagatccgtctgtcggaaatgtttaatcacttggtggtcttcaacaagcgctacattgccgcggtcacactgggggttttcattgccaatattattgcctcaccatttggctttttggatattgccactgggaccattcaaacgctgctggcattactggtcatgtattggctcagtaaattcgtccacaatcgcatcgcccaaatggccattaatacggtggtcgcggtcttcttcatgtgtatgattgcctgggagattgctattgtttccaagactgccttttggccaacattctgggccaactggttatccatcggttggggagaactggtcagcatgatctttgggggcgttgtgatttatctgttgagtttgaagattgattttacaaaataatgggttagtgtttggaagctctgtaaagccggattggttttatggggcctttttaactgataatgtccattccacaggattaatgagatttaaatgtcgttaatctaatttgtttttaatattatattgaatttattattttcgattgctatatttatcagagggggtgcatgattattctaaaagattggaacttttggctttcattattgttcattattaactttatttcgttaccgtctgatccatttctaggtgctttttggttctggcacttatttttaggcgtagtcggtattgtctggcttgggtcacttattattcataaaaaacgaacttagccgtattctctgtcgcataccaaaagatggactacttcttaattgaggtagtccttttgcatatacaaaaattggcaggccacttcgccgccttgatcgcggtcatgagtcatgttggtaaagctgagtgcaaaaccaaagctattcgcttcgttaccgcccgacttaatcatcaaggtatcactttacctcagcccgttatttctgccgctgtagaaaaagcctttagctatacaaacatttagttaccggcgatcaacgtttaggcttataaatccccaaatagttggttaaaataatatatttcataaaaaagtaagaacgtttcctttcggacaacgttcctactacataatccttttaatccaaaccccagtcagcaaaaccagaaaaatatggtttggtgttaatcgtgaaattagtccaagatgcggccgtatcatacgtatcatcaattggtgtgtaattttgatattgcctaccaagttgtttgatggtcagtcgatagtgatggggaccaatcttcttatcggaaaaactctttaatggtcgtgcatagtcaattttataagcggttcccgttttcaccagtttcgtcaccttaacactatctgtgggcttcaacttagcaaagtcactatccacatctgcattcatccacttatcgttaattttagtcattcgagcctgactgtacgtctgaatataattatccagtgtgacgaacagtgctgaagaataagtcggctgatttatatgagttgatgacataacgaaacccgttccctgccgcaacaattgcgttcgaatcggtgctcgtagcgtctttactggtgtaaagttagcggtggtgtaacggataaacttcttcatataaaccactttatttatttttgcatagtgaatatcgcccaatgtgacggccacatatgttttaaaatggggatatttcccgcgtatgttcatcgcactaattgacaacaatttatttttcttaatataaatcggcttgtatcccgattttgttttttctcgagcaccaatatccattgcatgcttcgtccgcacatagcttaccgattccggaagctccctgaccttggccgccgctggggcagttaatccactacctcagccaacaagtgcaacgaaaactaccaatccccattgatatactttcttcataatagataccccttataaataattactttacgttgatttcctttgcttattccactattagcaagtctagcacttaaaagttgcccataataggtactggtcactatctaattgacgacgcattcatattatcggctctacaccaaaagacccggcagccacatcccctggccacccggtcttctttccaaactatttaaaaggctccgccaccggaaccgccaccaaagccacccgaactaccgccggagaagccgccggaaccgcccgatggtgagctaaagttagccgacgtatcaattgctcccgcaatactcgtttggaccatgtcgcccaacgacaaattgaacgcgcccggatagtaaaggggataagcgaccaaagccccggccacgacatccttcccaaagtcgatcgccagtttgtcagccacctgtttggcgaggccaaatgctgcggcatacggtaatatttgctcccataatatgaggtcaccaatcttagccgtattgaaatgaccaatgtccttcaacatccgccggaagccgccaatctcatttatcaagaccaatccttccgcagtattacgatcaacttgccgccgctgacgcgaaatataggtccaactaccaaacaaaacaacgagtcctagtccggcgcttagtttaaagaccaacgggtcgaccaacgccgacacaccgatccaagcggcaattacaaatgtgagtccccacgcaatccctagcaagcgttggcggatggcgatattgtccccatcttggtagacctctgctgcttcatcaacctgattttgccactccttaaaccagtggctgactcgactccctttatcttttttcgcaaattgttttaaatcacgcaacgtaaagctatccagggagcctaatcgttcaaacgcccgttggagaaaaatgttggtcactgtacccgttttggtcaaacgcacggtgtcatgtttcttctctcgaaccggttctaacttaatctcatgccgactggctgccatcatcaattcaccacttaatgcatccgtgtctggcgaacgaaaattcagtaatgccacagccacggccggtgccacgcctgggacatcaaaaaagtggtcgactggaatcggatgcgggtaccgattagccgggtgatgtcgcatccaatggtagcttcccgctaacaaggccactaggcccaccgtcaatgctgcgtacccccctacgactagccagcgttgttgctggcgcttagcattggcgtctgccgctaatttcgcttcttgcttttgcgcagctgctcgccgtttttgtgtgcaagtattgggattagccgctgttacctgcgttggaaacagcagatgactttccacaaacgtattggccggattttctggtattgtcatcaccacacgtcccgtcttcgactgaactgccgtgtgtccagtcaatgggccatgcgtccacgcctgcaactgcttaaccggctgagtcggcagttgaatggtcaggcggacattatgtaacggctcatcccaacctgcaccaattaatttccaattcaattccgccgtatccgcataattcgtcacgaccccggtcaaatgaaagcggtaagtaacctgtaagcgatcacccgcggacaccgcccgataaactttaacctttagccgttggttactttggctgacctgataccgactgtcgccgctatcaacagctcttgccggccgcattcctccatcattcaaacgcgtgctaacgccggttagtcgcccaccctgaatgccgcgtaagtcttgcacattataaacaccatgataatcatcatcaaagtgataggtcatggtctccgtcacattggcatccccacgacgcgtcacgtctacattcattcgaaacggtttaatcgtgtagctcgctgccgcattgatcgtggtcatttgacatccaccaatcaacgccagaattaaacccagtaaccaccaaactccctgtcggtaccgcataagcacccctcctccaatcctattaggtttaagtgtagcatacccacgaaagacgaccaatgattaccgataagaaaccattgtatcccctaaccaagtcactactaacgcgattactgaccccttcagttgcaatttaacaaggactccattaacataatactcacagaggaagctctgtggtatttgcgctctaaccaatcccgcaaatgataatagccgccatcgcgtttcaacgtcgcgatggcggcttttttagtcatcagtacgcttgataccccttgttagatgccatactccccctatttattgcatttaaccttcccggttgcccattagttttctattagtattgggaagctaacacggcagattgtttattcgccgtccaatctgaccataaaaaaaaggctcacagcaatgcctgcaagtcctccagatataagcttattctgttaatcaggccaaccctatccaaccgaaaaacggcctcaatccggataggtacccactgacctgatcagttcactcatcatacaccccaacattagttgcgtcagcaaaaatgctcacgggaaaattacttactgcgtcatgctcacgcgtaattggtttccattgaaaacacaacgcaaaaaaggcaagaagaaaatcctcaaaaatcgagaactttcttcctgcctttcggtgaaactgagttatgttaccaaaaccgatagattaacttactcgttgcgctttaatctggcagttcttgataatcaaagtaatcaaaggtggcaacgcgcttgtaaccagcatagtcagcggccatcaagcccacgaacgcccccgtgaagaagccgccgtagttttgcaagacgtagtcatctgataagattgcagcatccagctcaaccggtaccgtttcccagttttgaccatcaaatgagtattcgtacgtataggattgcttacgaaccttcgttctgaaccaaacgtagtccgtcccatcaggaatcttaatcgcatcatctttcaagtaagacgtgtaattattgttatcattttgggcaacttcaatgacatggcccttcttttcatcccacgtaatgaaaatccaagaatagtgcttgtcattgtagatgttggctaaccctgccatctgttgatacgtgaatgggtcaaatttgaccttagtctctgcatcaaagttgaaggcttgccagcgccgtgcaatcagggaaacatcaaagttactggacattgtttgttgcccaatcagcttcaactcgccgttgcccacagaacccatttgagcggtaaagggttgccgcaacgtattccagttcaaatctagtgttggttggtcaaagtcatcgtgttgtgaatggtccttcggcgccgtcgtttcgatagcatccttaggggcgtcaacttcgacttgaccgccgtggccaccaacgacacgaggccagccagcgtcatcccattccaccttttggatcgacgtttcccgacccaacgtactccaaccacgaggatcgtgactggattcgttggtgtggttccatggccgcgagaccaaagacgcgtagtaccattcgccacttggtgtactggttaatgccccgtgaccttgcttttgtaagtaaaaatcaggggtatccatattggtaatgaatgggccatctggttcactttcaaaggacaattcatccagtgtcttagaacgagcgacgacttcttggtgggtaaatacggtcccaccttcagcagcgaacaggtagtagtacccattgatctgatacaaatgtgggccttcaaccaatttcacatcagtcccattgtagatgttgcgcgccgtttctggcttcaactgcatggtagctgtatcaaattccgtcaaggtaatcccattgaatgggtggtgatattcacggtgatcccaggtttgttgaaccaaatacttacggccattttcgtcatggaagagtgaggcatcaaaaccaacgccgttcaccgcaatgggatcagtccatgggccacgaatatccgtggcagtggtcaggtagttggtcatgtccttgaacggtccttcggtaatcttgacatcggtgtagatcagccaaaacttaccatcggcatagctcaaatcaggggcccaaatcccgccagatgcaggattacccttcatatcaagtaaagtcgtcgtggacagtggtgatggcaataaattccagtggaccaagtccttggattcatgtaaccgcacaccagggaaccattcaaaggttgaattggcaatatagtacgtatcacccacccgaatcatacttggatcagcgttaaaaccgggtaaaactggattttgaatcttcataagagaatcttcctttcatctaaacttgattggctttccgttctgctgtcaattcttcgttcatcttattaacatcactatccgttaaggtgtaacgactcatgacccacatcgcgacaaaggccaaaataatgggtagccaaatcatcgaccattgaataccggctaaggcgcccgcactttgagtcgtcttggtaccatcaaacttgaagaaggcattgatgtaccctggaataattcccccaagagctaaaccaatcttgaagaacagacccatgatggcgttaataataccggcaacccgcttcttagagtggtattcaccgtaagacacaacttctggaaccagtgaccacatgtaaccggtcgctgccgtaatcccccattgcatcaagaaccgaccaatgtaacctaaggcaacgctgttcttaaaggctgggaatgaccaaacccaaagaactaacgtcccgatgatgaataatgtcaggaaggcgtagaagaattgacgtttcccaatcttcttccgcacgattggccacaagaagaccaggaagatacccggaatggacccgatcaagttgattgaagccacccattcggagtgcccgatgttatattgcatgtagaaaggccaaacggtgttaccaaagaacatgaaagtaaagccgatcaggaagaacaatcctaaaatttgtaggggtttgttttgtttaaattcaacccacaggtctgcatacttaactgcagaggattccttttcggtcggtaagacccgttccttaatcccaaagtaagtgcacatcaacatgataaaaccaatgatcatgtagatggccatcaccatgaagtaggcaccacccgattttggtgaggtgtaatcccctaaattcatgtgaataccgaagaaaccaatatccttggattggggatttggtgaagccaattgcacgaacagtggcaggaatgtataaaccaacaagttcccaatattggcttcggtcatccgaaccgtcgtcaaagttgaaatttcatcgttgtcccgggtcagtgaagcattcaaggccccgtaaggaatgttaacgaatgaataaatcagcgccgttgcgagataggcaataaaagcatagaagacattgccccgaaccgcatcaattggtaagaataacagcgccgccatgatcgtcaatggaatcccaccgtagatcaagtatgggcgatacttaccacgcttaaatccatgcttgtcgacgaaagcgccgacccatggatcccagaaaacgttaacccaccggaccaccaagaagatggtggcaccgaccgcggcagaaataccataaaccgtggttaagtagaataagagcatggaaccaaccgtcccaaagatcaagttttgggcaagatctccggcaccgtaactaattcgctcgcgccaagacagcttagcaaattcatcatttgcagctggttgggcagtagcctgtgtgtttgaggccatttgcgagaacccctttcagaagtataatcttattaagtatcagtgcagttgcacaatgatccggccgaatcattgtcaataaaaatcggttagctaactatactttagattgtatccgctttcacaatagctgaccatcttcgttcatgactgtttttagttaaattctgacctttaaggcaaataaaaaccccgaaaaatcaacgttttccggggtgattggttgttttctaaccaaaattattcaaaataaccactttccttaaccgtccgcacgcgacgtttttgcttcaactggcgttgatatttactaggcgtgatgccggaccacttcttaaattgcttactaaagtttgaagtactgctggcacccatcaaatctgcaatgtcctcgatagaatactctggtgaacccagtaatcgcttcgccttgttgtatttttgattttcaatatagtggagcggcgtgacgccataaacctttttaaatgtgcgatgaccatagccgctactgacaccgacctttcgacaaatatcggtaaaggagaagaccggaacgtgctttttctcaatcgccttcttgattaatgtcgcaatcatccggcccgtcttggcctcactttccgtatacttctgtcctttctcctggacgtgggctttcaaattttcagtcaaggcaaagaaaaattccaagaccgcaatttcaatcttcaagttggcttgttccttggttaactgatgatccgcactataggtcaccactttggtagcgacttttacagctgcttgtgcaatcgactgatcggccggaatgacggcgttcaccatactactcagcatttctgattttaattccaaactctcaatattgaaatgaaaacagatatatgtcatttcttcagtatcactagaattcttgttcgtgtggagggtgcccggtgaaataatcatggcatccccgggtccataggtgtatgtcgccaggtttttaatttccgttgtctggtgtccggctgtcacacacatgagttcaaacgcttggtgcttttgttcaaagaattgccaaccaccaggcaccgtccgctggtgccccccaaataaatataagctggaatcaacgactggaatcggaacaaagggcttcatcatgggcctcctttacacgacgatgtgccatgaaaacggtttaatttctctactgtcattatacccaattagttgtcgaaagcaaccaacctcaatgctcgctgtacacaaaaaagcagaccaccttactaggtcgtctgctagaaatactataaaataggggacaacaatcttgacgccgtttgtttaaacttcaagtacgccgactgctgcttgaatttctctggtgttattaattcactgtgccgcatgtcttcctcaaaaatttcttcgagttgtgtggctaactgaggatcatagatgaacgcgttaatttcgaagttcagtttgaagctccgataatccatgttcgccgagcccacagaagcaatccgaccatcaactaccattgtcttggcgtggataaagccattgtggtagaagtaaatcttcacaccatcatctgccagttgccgagcatagtattgcgttgcccgatagacaaaggcgtggtctggcttatccggaatcataatacggacgtcaatgccagccatcgccgcaatccgcagcgaatctagcacactatcatcggggattaggtacggtgtttgaatccacagacgtttttccgccgtttggatgagccgcatataccccatcttaatctgctgcaaatcggagtcgggaccgctcgacacaatttgtaaactggtttcccccttcaccttagtgagtgggaagtatttgtgttcaatctgatcgtccttaaagggatgatcacgatctgtggcgttccagtccaacatgaagcgggcctgcaaagcaaagacaccggaacccacaatccgcaaatgcgtatcacgccaatagccgaatttggccttacgccccaggtactggtcaccgatattaaagccaccgacataccctacttgaccatcaatcgtgacaatcttacggtgatcgcggaagttcagccggaaatcaatcactgctgatcgcgtgcccagaaaggcttccacgtgaccaccaaccgcaattagtggcttgaaaaatgacttccaagttcccatcgagccccacggatcatagataacgcggacttcaacgcccgccttggccttcttgaccaacaaatccaagatgtcattaccaatctgatcgttgtaaaaggtgtaaaattcaatgtgaatactggaatgggcattctcgatatcttccatcatcaaatggaataaatcgtgtccatcggtaatcactcgcacccggtttttacgggccaagaaagcatggtcggtctccataaacatattgaccatattgaccaccgagtgactgacttgatccgctggcataatctgattgccaatctcagcacgctgttgggacagccgttcatcgagctgcaccgcgacctgccgttgcagtcgaaacattcgccccttcggtagctttcgcccaataaaggcgtaggcaataaagccaaccacaggtaacaaaaccagtacgagcatccaagcccacgtcgcagcaatatcgcgcttctcccgaaagaccgtcaagaaggccaacgccgcgttgaccaccacgataatttcgaagattagcatgtaatttacgttcacgtgtaacgtcctcctcaaattctctgtggtttcatgatacgctaaatcttacaaatgtctttactttttcctaattttcttaggaaaatccccaaaaattttcaggaggttcctcatgatacatgttatttcaccgctgatcggtggcttacacggcaccggatttttgcgagtcttccattggattttccgtgataatcccgctatcggcatcatcttactagccggtattattctgtatagtatttaccggtatatgaaccggcgctaatcccacataacagtaaacacccccgctacctgaacgtaacggaggtgttttcatatcatggttttaaaaactgctagctggatcaccatattggctggccccagtactatagttaatcttcacgccagcctgaatgttaaaaatgtagacattataagacacgccgctatttttcaccgactgcgcctgcatatgaaccccacgtgcgaccaattcattgccccgaaagactggttgtacttgatagcgcacatagtcattgggatggctcttcaggtaactggctactgggttctcatacgccgtcatgccgggatcatttagagaacgcgtacccgtcatgaggtttttcagattgttattctgcccagtcaattgatagccaatcaggtgactccggttgtaaagatagccgcttttaccattaactgtgtattctttattcttccaaccagtcggattaacgtagagtggttctcgcttggcggtcggcatagtgctcttactcaataatgcattggccgtcgtgacccggttcaaactatccaattcgccgtaagttgcccaagccccctgtttagtcgacaattgggccgtggtaaaagttggtttattgtgattaaccgccacaatctgcgttcccgtgtacttctggtcggctaaccccttagtggccaccgactgtttgggggtgctggctgactgactagttgactggtcatgacgcgaactgttgctgccaactaagctggttgcgatcgtcgtaatctttcgcgccgtgggattgccctgctgactgagaccaccaatcaccccaatcacaatgacgacaatcgccgtatagatggatacgcggccgccactgcggcgaccgcgatttcgtttactcatgaaaaagctcctctcccgtaattaatctgcttattcattttatcaaaggaacatacgtttgtctctagtaattcgttggtcattccccttttttctgagtttgttaccgcaacttaacacttttttaattgagcggtgacctcccttacccagtcgtcatgctatactatgggggaatagaagtaggcggtttgtgtggtttccacataactgttattattttcgatgaggtgattgagatatgaagaaatcccgaatttttgccaccgtgcttagtttagtcgcggttatggcaatcggcctagctggctgcagtcaaaaagctaagtcggggagcaaccagcaagcaagtttcgctaataaaaccacgaaaaagtctgatgtgaaaacgactttaaccagttctaaacagctttggtacgtggccggttccgttaacgccaaaagtaactctggtctggaagcctacagcttcgattccaatggtaaagcaaccgtctacaatgtagataagtactacaagtccctcagtgcggccaaaaaggctggtgccttgaataagagcggggtcttaaacacgaccttcaccacaaagggcgacaacaccgtgatcaagttcaaagggaagttgtcagatattccaatgacgcagaaattcacggtcaaaaagaccctgaccgcaaccaacaaggcttctaagctcaaggttgctggttaccacattgcccgcgatgttgataatgacgttacgcaagcaacgatggttaaggtaacggattagatcccaggttgggttaaactacaatctaacgataatatgatttcagataaccactctataccaacaaattttggtgtggagtggtttttcatatgccaaagtttcagattaccttaaagaccttaaccaaagtcaattgtatcctcgttcttaaacaattcggagtagtatattacgtaagcataagatagttaccaaaaatcaaaggagataatcctacatgcatcaaaaaaatatttttgtaatccttgggtgttgtggaatcccaattatgctttatgccttggtatgtttagctgtcgcttcttatacgttccttacagacggtctcgtatccctgggactctttctttacgcactattaatgagtttaccagtcttcctttatatttttactttcttttatatgcgcctaggaaaactaatatttaaaacactttggctttttggtgttttagtgttagccgtttatattgattattttttattatcaggggagaggattcaactccattcattatctatgttctagtctatatgagcaccagtatggttatttcttatctgcttaaaagatatgtagatcgtcagtaattcaaatcaccagtccgaaccatccccactttaactcaaatacgccctgaattagccttatgccaattcagggcgtatttgagttaagttattaatcctgccgtcgccgtttaaccaaccccaaaacactcaaaatcaaaatcacatacccgtacactggtaaagacatgcgctgttcgcctgtctgcggtagacgggtagcccgtgaattcgctgttggcacatttccaatggcagtaaacccttctgtcgtgcgactgccatcagccttcgccacttgtccggcatcagccactagttgctgccaaaaccgcgtaaacgttgccgcctgcttaattcccagccgactcgcaactgcgttagccgaagctccacgtaattgcactgtttgaaccgttgctttcccactttgccgatcgacgcgcaccaccttaactactcggccggccttttcaaaaataaaatccgccggtcgcgtcttaaagtagccaaaccgatttcctattgttcttacggtatttgccgccaaaatcattccttgtctagcataaatgggctggagggtctgcaccgcaacctctgattgacctgcagaatctctagctaacgtcatatcaaacgggccatcgaaaatttcaatatattttaggctcccgtcagcatatcgaacggtgataacatctagcccctgctgcattcgacttgtaacgcggggaatctgatacacaaaacgaatcgtggtggcacccttaccaaaaactccggtgactgttttgggccctttcaattgaaaatcccggctatcttgaaactccgccgccgtggccgtataccgctggcctacacgaccagttaatgtgtcgcgatccaaaacaccgcccgtatccatcatgtaaatgaccttcaccgttgccgtcttagccgtgacctttgctttcggctgttgcgtagccaccgagcgagctgtgctggtcttggtactcgtagtgtcagccgctggtgccgtggtcgaatgggccgcatccgcgctagactctgatgtatcaaccgtgttggttgtcgaactgaccgtatcaataccagctgccgagtctccatttaccgctgcactcgtcgctgattggctcacttgggagctcgtcaccgcattagaggtactgctggttggttcaaccgatggcgccgtctccgcgtgaccaatcagcaccgatccgctaatgaagctgaccaccaccactatcgctaatagcaagcggtgtccgatgtgccagcggttatcaagctgtttttgcacattatctcctcctaaaaataggtaaaaccattcatatatttaaagatatccttaacaatattgaaaagcaacaattatctacgtcttatttgctaggaaaagccaacacgtttaacttaatctgtttcacgtgaaacaaatgggctgacaccgctatcactttgggttatgatagggccaaaggagtgtgatgatgatgtttaaacacaaattaatggctaatgactcggctgggcaggcctttaaagcctcgcgcgaacaatttactaccttggttcaagaacacccgtggttgattcccgctaccgtagccttagaagttctaccggcaacggctatgattcatggttactggaaacttcggcagttaaaaaaacagcttcaaattgagaaggaacatacgaagcaacgccagcttgaacgctttgcgcccaatcatcgccacgatggtcggcctcaattactagccgatcacccgcatcacccccattttaatcactaaatgacgcccctcgttgattcaaacgaggggattttcttagcgaatttttagcaaaatataacattatatatctctaataaaaactatgcgtataaagtaatatctctcaaaattaagaccttaatcttcttaaaactaacaaaataataagtaaaacaattagaaataaataatccaacccccatttcatcctttaaattccccattactccgtatatttagaaaaaactaattctacctatcattattaaataaatattcttcacagtttcttcacaattaccggttaggatacaaatataccaataaaacctattaaccaaccttttttcattttattcaaccgataaaatgatcgaccgaccctaaccaagttggtcattgccgccccttaaccacgggcggctttttcttttacattctgctaacaataaccgttggcggtcaccgctaagttaccttaatcgatcaaaaaagcacctcattgaccaatctactagattagctaatgaggtgctttttaactccaattgctacattcatcgttgttaatccgctaaattcactagttccgccggggtttgtagcaaatacgttggcgattcagcttttactgaggtcggatcagctgcaccccacattgccgcagcagtcgcaatatgggcattctttcccatctgcatgtcatatttggcatcaccgatcatgacactttcgttggccgccaactcaaagcgctgtagcaaatttaaaataccatctggtgccggtttgtaatgcgccaccatatccgaaccactaatggccgtgaaggttgttcccaaacccagttgcgtcagatttcgctgcaacggcaccgagtgcttgctggacacgacaaatagattttctcctcgttgctttaatgtcttcaagatcgttgccatcccatcaaacaacgtaattcccaattgctcagccacttggtattgggctcgaaagacatcatataagtctgccaaggttgcttcgtccaagggttcctgcgccatcttggcaaaggaaacttcgatcggaacccccatataactcaccacggcttcacgactggggatcgctaaacctttcagcgcataagccttttgcgtcgccgtcactgcaacatctcgcgtatctgccaaggtactatcaaaatcaaataaaaagttacgcatgccctcacctcattggattatcttactagcgtcctctttattctacacggcaacggcacaccatttccagtccgatgagtctgaaaatgacttttgtctttgattggccccaatgtttcatgtgaaacattaaaagcccaagacaaaagtcccgggctcatctgtatcactggacatctaacggcggctagttgtccgttcattttttacgtttatgccaaggaatcccaagccggtaattcggtgggagtcgtggccagcaccgcctgttgatcggccgtcaaataccgcttgtgcaccacgacttcgtaaacgaagtcactgaaccactcgtcagtcataacaaagtagcctttgtccccgttcttttcaccccagctattttcaaccttccagcgagttggctcgtcatccaccacgttgaccccggtaaaggtcattgcgtgggaaacttcggcttcacccaatgccaagcgctgggctttcgtcaagctcaagtcaatcccaaacagatcagccgttttgtagagctgactatctaaaaatcctcgttcccgactcatctgttgcagcacatcgttgccaaaccagaccgtctcgccatctttcaattgcgcaatcgctgctcgctttagctcagctaatggcaaattgagaaaggtaatctgctgaccaccgacaatgttttcttgactttccaatcgataacgttgattaaacgccttatccggtgaattactgattaccacgtagtcatccagatcgacatcaaagtatttttcaaagaagccctgtggggtcaatccagcatcacgatgatactgctggttatcatccttgtattccaaatcaaacgtagttggtggctcaccaaaggaataggccgccatgcggtagacttccttcaaggcttgcgcccgtgtagcagcaatttgttcctcactagcctgatctgccactaggtctcgtaagactaacgcatccttacgcagcttcaaattaaaagtcgccgcaaacccagttgtatcattagtattgaaggattctggcatcgcactcactggaaccaccccgtatttttgaacgagtgacgcgcccatggcccactgaccaccatcgccaccaggattgttgagaatcgcggccacttcacgcgaatccaccggttggtcagccgtgcgtaaaatccgatcgtaaaagatattagcccgttcaaccttatcccagaaaaacaggtaactttgtgagagttcaaagtctttcacatgatactttgccgcaaattgatgccgaatcgtatttaacgttgaaaataaccagcagcgtcctgaatgcttctgattagacacctttcccgtcggtaattccaccgagaaggtccggtttaaacgaacggctgcctggggatcttcggaagctgctagtaccccattcttaatcgtcgcacgggcaataacatcatgggcgggttgttgctgtacgtcggcccgcaaatctgccgtttctgcggcagtcagttcatgctgcgttttcaattctgccataaaagtcctctttcccaaattcccatgtgttttctcatagaaatctcataataaaagttagattcattctagcgctttagtcggggaaaggcaacgcgttttcattaaaaactatttctacacccagtcgctactttgacgtagctaaaaagactgaatgaatccgatcacccagtctttgttattaataactatttaattattaatcatcactagttttatcacccggtgtttcattcgccactgcacgcagcgccacctggcggatttgcccaaccaacgcatcgtgttgttcagctggaatatccgttagtagtccatccgcaacctcttgccgtaacttcacaatttccggataaagggcttcccctttttttgtcagcgacagctccgagacccgcttgtccgtcttagactggcgtttacgcacatagcctaaattcaccagctggttcaccgcccgcgtcacgttgctggggttcaaatacgtcaggctaatcagtcgatcctgcgtcagtttgggttgctcatggattcgtaaaatataatagtacatgctggcattcaaccgatagggctggaggcgacggtcaagcgcaatccgcgtatagcgattggcaatcgacaaccattttagaatgtctggatcattgctaccggtaaccataagccgcctccttctctaaatttacgtgcgcaagcatatactaaatttcgtgaaaagtcaagcaaactaatagtgtcacccgcacgcctcgcttgcttctaatcaatacaaaaacgccgccgcacattgtgtgcagcgacgtcattttgacttgaattagtacgccatatcgttgatattcgcccgtcgcgtctttgtggatgtccagaaaggcaccttgacgacaccgaccactttgtctttatcaacaaagccccagtaacgactatcatttgagacactccggtgatcgcccaagacaaagtactttcccttaggtacaactccggtcttaccggaaccccagccttgcgttttttccagactcttcaatgtccagttacccgttccagaggtccgttcgctcttgctaataaaactctgatcgatcttcttattgttcacgtagatgtaaccattcttgctagaaaccgtatctccaggcaaaccgatgacccgcttgacgtaattggtatgggtcttggccgatgggtcttcaccatgcgcatcaaacacaataacgctcaagtgtttaaccttcgacatcttccaagcaaaaaccttttcgttgttttgcaagttaggctgcatggatggtccatcaacccgcacccgagtgaagacgaacgacttgatggcaaaggcaattgctagcccaatcacaatgggcacaatccaactcataatttccttaaatgctttcatgatgagactccttatgttcaaaaatattcagatatcactatcggacaccccatcacgtaaaatcacgcaattgctaggggtcgcttacaatcttaccatttactggctaaaagtcccacggtttcgccgaatttaattttattgtcatccaaatttgcttcgaaacaccactgccgcttgcaaattcatttaaatccggcaataatggaagaatacgtttatgctaggccgtcatttcgttgcgtgaaatggcggtctaacggtattttagccattattattttatctatattgaaagggctgactgctttgaatcctgttttaactcggcgccggcgcatctggctgacgctacttctgggaaccgtcagtgccactggtccgctggccattgacctctacttaccggctctcccacaaatgaaggcccaattcgccaccaccgcttctttgatgcaattaagcatcaccgcttgtctcattggacttgcgttggggcaactcattgctggccccttatccgaccaatatggtcggcgcaaaccgctaatcattggctttgtgattttcggtttggtctcgttagcgatggccttcattcattcggtcaccttgctaattgccctgcgatttattcaaggactcgccggtgctaccgggcaggtgttggcccgcgcggtcgcccgcgacctcttctcgggaaaaaaattaacccgcttttacgcactattgaatacggttaacggggttttccccattatcgcgcccatcatcggtgggtttatgatccaatacgttgattgggaagccatcttcatcttgttggcactaatcggtttactgattgccctcgccgtaacgtttggcctccatgagtctttacccccagaaaaacgccaaactggcggctttcatacatctctgttggcgatgggtaaattggtcgtacaacccagcttttggccgttaatcctggcgactggtttggtatacggcggcctattcagctacatttccgcttcaaccttcgtctttcaaaccggctttggcatggccccgcaaacctttagcctgttgtacgcctttaacgggctgggcatcgtcgttgggagtaacttacccggacgccttgccagtcgcttcagcaatcgccagcaagtcaccagcatgctcgcaattgccgccggtgtcagtgcgcttttgattatctcgctattattccccgccaacgtgtgggtggtcagcggcttaatcttgttactggtgattttgattggcgcactgttgacactgaccgtcaccatcatcatggatcaagccaccagcaatgccggcggcgcctccgcggtcattggcttatcgcagaatgcttgtggcggcttagcctccccgctggtcggcttatcgggcaaatcatacgccgcgatggccatcatgctcttcgtctgcaacgttggtgcctatggattagtgaaggcccaggggcaaaaagcccagtagaaacctgacaaatacgctacgcgagaatcggcaagattctcgcgtagcgtattttattggtgtcgtgtcgtcattaatggttacgcttctcgactccactgcgtcaattgtgcgaccacattttttaaaattttaatccccaattggtaatcgggttctgatcccaacattcgaaaagccagcgtccatgcatcgtgatagacgctaacggtcatttgaaagtggggcatcgtccggtaagcgcccgcaaagtagatctgcgttacggctaagctaccgaagttcaagcgcgtatggtcaatatgaccaaagttagcaaatgagatggcggcatgcgcccgatgcttgcccgctaaccggcgaaccagctccggtggcaacgcccgactcatgcggctcaactgtaccaacgggggcaagtatgccaactcttctcgcaaatgactaatcgtcgtctgcgttcgggagacaatatcggctagctgctcgccctcctgcaccgtcaagggaatcaacatctcgccggtcaaattagccacttgaaccacattagtcgccacgactggcccatgtagacgcaagtcaacttgatacggaatcacgagctggtgttctccggtcaacgcacacagtgccaacgcataggccgataacaacaccgcgttcatcgtcacgtgttgagcctgtgcctttcgctgcaagcgccgactgtcaactcgcggaatcgtcgcttccccccggtgatgatgagcatccccccgtaagcgcggaaaggcttctgccgaattacgcagtaccggcgccgctgcgtgcccgacctgtcgtaaatgggccaaaatctgccgaacactgcgctcattggtaaaagtggtcaggtcttcgccactataggccgccgctagcaaatacaagtagtgtttaaatccctcaccgtccgtcagtaattgactcattgctaatcgcaaggcatcatagccggcatgatgaatgatctgaatcttcagttggggtccggccaagacatccaattgaactcggcccggatcatgactagccgtatattcttcaatcacctgattgagcgttcctgactccacttcaaaccgattccaacgtaaattatatcgccccaacacttggggaacgaccgtctgtgtcgtttgaacggcggcccgcaaccggtctgcatcgatggggtgtgtcaggctcaacgtacattctaataatgggtatgtctgcgctaaatctaacgttggcattaaatctaacggctcgccatgataaatcatgtgacacccctccttgctcaatttacccatagtatagcaaaggccgtcgcggctctcatttttttatcacaactattggcaaaaattaataaagctgtaatctaggggtctttaatcgtcgcttgtgaaattctctggtagaatgagagacatcaactaacttacgaggtgattgttttgtcagattcaataacgccggtctcttgcaatgccaccctaatcgtcactagccaccgggtctttcaaccggatttaaatgaacatcaatctgtttttggcggtaaaatcctatccctagtcgatgatagtgcgtccgttgcggcagtgcgcttaactcacaagaccgtggtcacggcttcctttgaccatgtcagcttcctaaaaccctttcgcttagacgactccatgagtctagaagcttacgttagcggcacggggacgcggtccttggaagtatttgccaaaatcattggtgaaaatctgacgacaggtaagcgatttgttggcttcacctgtttcattacctatgtcattgaagatgacagcgtcacgaccaaattaccagcgatgaagcctgtgaccgccgagcagcgctatatctgttccggttatgccacgcgaaccgctcaacggcggcaacggcgacaagaacaagccgaactcaatgctaacgtgacggttgcttctccttggcccgaataacgccaaaaagcgagtctgggggtaaaatgcccagactcgttttatattttcgactatccgatattgccgcgtctctttggcgctcgcattttcaaatgtttcacatgaaacatctcaacgtatcctaccaccattcggccgccaaaatcccataggcatacaaatctagccactgcccatcttgaaatacggcttcgcgattgattccttcacgttggaagccggcagcttcatacgctcggattgcagccgtgttattggcgttaacctcaagggtcactttatgcaggcctaactcgttaaaagcaaacgacaagatcgtattcaaggcatccacgccatatccttggccgcgatcactcgcaacgggcactgcgatactgagcgtggcccgccgattctttaagtaaacgtcatccaacatcacccagcccaataagccatcatcggtattggcccgaatcataaagaagaaccgttcatcattatcgggatcggccgccaactcactgtactccgcggctgtaaatggatgtagcgcatcagccgacagatttcgcagtaggcccgtctcccattgtgtgtcctgtaaccattctgcatccccgtcacgcatttcagttaagtgaatcaaatttccctgtaccacatcgcgcatggttgggccccctttggtttttctcttactctaccacagcttgccaataggccaaaattcttggtgatctgcgccatgacctttatactgatctcaatgataaaggaggaattggaactcatgaaaataatgattatcggggccaccggaatggctggtcaagccctcgtgacaactgctcttaaccggggtcaccaagtggtcgccgtggcccgttctgccgaaaagctagccactttacctagtaatcctaatctaacatctatcgtacgggacgcctttaacctgacaacaactgatctgtcagctgtcgatgccgtcgtggacgcttttgccacagcaccagatcacgcctatcttcacgttgatctcgccactcatctcattagccagcttcgtgaaacaactacgccgcgggtggcctttatcttaggtgctggtagtctgaccactggggatgacgcccacctcttcgtacatgacttggaacaagatccccatgccgctagcttcattagtgttccccagaatcaattgaaagaattaaccttcctgcgagatgtcgataacgttaactggtttggtgtctcgccagcggccgattttcatcccggcgaagcgcaacccgccttattgggcacggacacgctactattcaatgatcaacaacaatctggcacttccgctggaacgatggccgtcgcgattttagatgaattggaaaaccctaagcatcatcaaacccggttcaccgttgcggataaataacgtgattttctgacgtcgaccgtatcatcggccggcgttttttggtatgctaatctcgtgaaattttaaatagaaagttgcgatgctcttgaaaagaaacttaacttggcgggaaatgttattcatcagcatgatgttgtttggcttattctttggtgccggcaatttgatttttcccgtctttctgggccaacaagccggccaccacgtcggtctggccatctttggcctgttattaacggggattggcttaccacttctaggggttaccgccatcggattgacccgcagtgaaggcgtctttgatctcgccaacaaggttaatcgccccttcgcctacctgttcacgattcttttatacttaaccgtggggccattctttgttttaccgcggttagcgaccacgtcctttcaaattggaattgcgccattcgtgccccaaccccatcagggactggcattagctggcttttccatcctattcttcgcggcagcgtggtggctggcgcgtaatccgggaaagctgatgacctatattggtaaatggctgaccccactgttcttaattctactgggtattctcttactcgccagctttatcaaacccatgggaagcctcaacaccgcggcccagggcacctacgcgctgcatccgattctaacgggtttcaaagaaggttataacacgttagacgccttggcgtcattggcttttgggatcgtcgtcattgatagtatgcgcgcactaggcgtcactgaaccgggtcagatcgtcaaagatattattaaagcggggacgatcagtgtgagcctcatgggaatcatttacgcgctattagcattgatgggcaccatgagtttaggccacttcaccgcggccgccaatgggggaatcaccctagcccaagtcgccagctactattttggcacactcggcaatcttctactggcattgctcgtcatcattgcttgcttaaagaccgccatcgggctaatctcagcctttggtgattcgctacatgagatgtttccccgattgtcgtatgcgggactcatcgccggtgccagcctgctgccctgcctttttgccaacgttgggctaaccaagctaatcgcttactcaacaccggtattaatgttcatttatccgctagcaatcgtgctgattgtgttagccgtcttgacgccgattcttggtgatagtcactgggtgtttggcctagccatgttatttactctgattccggcgatcttttcggcgttagctgccttacccgacaatctacaacgcgctacttggtgtcaggcaatcttaagtatcaacaactacttgccactagcggctcaaggcttcggttgggtcgtaccggcgttaatcgggactgcttgtggttggctcgtcagccgcttagctagccggaacgttcggtaaccagcatttctaaccaagtcaccgtaccccacaaaggattgccaccccattaaaatgaaggtactaaatgaaatgaggtggtttcggtgatacctgctcgctatcccgtcacacccatcaaaatcggcgtgactttattgactattggcctacttatggcaatgttattagctcgtaatcctattctgacagctttcttatgctttagttcgttaattacagcgatgattcacttcaacgtctttgaagacactgctgatactcaaccgctcaaccgaattgatctgatccttcaggttgtctttgtggttctctcaatcggcaaggtcatcgtcgttggtagtcattagttcgaaaaaggacccggtcgttaatgcggccgggtctttttttgacgcgttttatgctacactcagttaaaaccactgaaaaggagctcttatgaaaaaatacgcaattctcgacctcgacgacaccctcctcgatttcaaacgtggtgaaaccgttggaattcaacgaatattgcaagaaaatggcgtctccgatttaaccgccggcttacagacctatctccaaattaatcacgacgtgtggacacagattgaacacggggctgcccgtgaacccctgctagctacccggttcactcggaccttcgcggcattgggctatcacgtcgacggtcagcgtttggaacaacaatatagccaaatgctggatcagaatttctacaccctagctggcgccactgactttctcgctgatctcaaccgccaaggcttaaccgttgtggcgggcaccaacggcaccaaatccattcaactcaaccgactggccggcgcccagttgacagcttactttgatcgtatcttcatctctgaagatatcggctttgacaaacccgatgcacgtttctttacccccattcgccagtattatccagacatgacggccacgaacaccttgatgattggcgatcgcctacagtctgacatattgggcgcccagaatgcgggactagacagtgtttggttcaatcccactcacgctaacaattcaaccactttacatcctacttacgaggccgcttcatacgcccaaataacgcaattattgctggcttaaccccattccattttatcaacgtcaaatgctgtaattgcgggtttgggcagcgacggtcgctgtaaaaatgccaactcgcgcagcgcttcccactcacgtttaggcataataaccgccgcgtgttcatcctcactgtccgttggtgtaatcataatggtctcttggagctgatggacgaccgttaatacttgttgaaaatcctgttgtgctgcaatcggcgaataatgtttcatgtgaaacctcctctagaattaaaaagcccgctaacgctgctaaacagccttaacgggtttttgattggttaatgagtggtataagtgagtaatgctcctaataaaacggcccctaataagagctggctacccgccagataccatccttgcttgcgccacaacagatggtggctcatcggctgagtctgtcgatggcgttgataacaactaatcgccaaggctacgccatcaacgattaagagtagccccacgacacgtgcatttagccaagttggctgccacaccccaatggccacatagaccacccctaagtaaatcaggccttgataaatgagccgattacggactcgttggccggtagcttcccgaccttgatgtaactgatgccacattcgttgatgttgccaatgactccccatggttaacgccaatcctaaaatcagcagactagtttgcatcttaatacgccccttaactcaaccgaccaccaggtggtcggttgccccctaaattaatgattccccgtttattagtttaccggatttggttgctaagcgcaaaaagccttggtcatcaagttattcaagcggcagttatcagcagtcatgccccgttcacgactacctcatacccctcgattcgtatctaaacttactttaccgttcctttattgtattttcgcaaagaacctgtaaagattgtgtgtaatcatccttgattcaattattaatcattaaatttaatgattaataaaagggtccggaacaaaagttccggacccttttatgtctctaactatctggctggaggtagccagtcactgactaactgcttctctagcctgcaagctttttgccttactgaaccttggcaatcttgccttgttcaatatacacactcaagatcgcaatatcagctgggttaaccccactgatccgactagcctgagccagcgtttctggttggattttcttcaacttctggtgggcctcagtcgctaagccatcgatggcgtcgtagtcaatttgggcggggatggccttggcttccatccgctttaacttagcaacgttttcttcggccttcttaatgtagcccgcatacttcaaggaaatctcaatttcctcgatgatatggcggtctaacggctgctctggcgcatcaataaactgtaataacgtctggtagtccacgtatggccggcgcaggaaggccgccgctaagacaccatcttgcaggggcttatcgccgtgactttcgacaaatgcattgatctcgtcgttaggcttgatgcgaatctgattcaatcgatccagttccgcctgcaaagtggccttcttcgccaagaaatccgcatagcgttcatcactaattaaccccaactcatgccctttggccgttagccggagatcagcgttatcgtgccgcaaaatcaagcgatactcagcacgactcgttaacaaccgatagggttccttggtgcccttcgtaaccaaatcatcgaccatgaccccgatatacgcgtcggatcgttttaaggtgaatccaggcttacccaaagcccgcaagccggcattgatacccgctaacaggccttgaccagcggcttcttcgtaacccgacgtcccgttcgtttgaccagccgtgaagaggttcttcaatggcttggtttcaagcgttggtcgtaattggtaaggcgaaacgacatcgtattcaatggcatatcccggccgcatcatttgcgcgtcttctagacccttaatggaatgtaaaatcttctgctgaacttcttctggcatggatgtcgacagaccctgaacgtaccattcatcagtcttacggccttctggctccaagaacagttggtgccgcggcttgtccgcaaatcgcacaatcttatcttcaatcgatgggcaataccgtggccctactccttcgatgaccccggtaaacatcggtgcccgatcaaggttggctttgataatctcatgcgtcttttcgttggtatacgttagccagcaagacaactggtttttcaagtccaaataggcgctgtccggtgtcgtaaagctaaagtggttcggttctacatcccccggttgttcctcagtctcatcgtagtgaatcgtattgccgtctactcgtggtggagtcccagtcttgaaccgctccaaatcaaaaccgtacttgggtaagttggccgttaacttggttgctggttgtgaattattcggaccagaagagtacatcagttcaccgataataatcttccctcgagccgccgtaccggccgcaatgaccacggctttggcacggtaacgcgctcccgtattggtaatcacgccttggcattccccgtcttcgacaattaggtcgtccacgattccctgacgcaacgttaagttgggttcgcgttcaatggtgtgtttcatttcagcatggtaagcgtgcttatctgcttgggcccgcaatgcccgcaccgctggacccttaccggtgtttaacatccgcatctgcacgtaggtcttatcaatgttgcggcccatttcgccacctaaagcatcgatttcgcgcaccacaatccccttagctggtcccccaactgacgggttacatggcataaatgcgaccatatcaaggttaatcgtcatcagtaatgtccgatttcccatccgcgcagccgccaaagccgcttcactacccgcgtgaccggcacccacgacaatgacgtcgtagtcttgcccagcgtattcctttacttccgtcatggttcatttccctccatgcctaaccgcatcatacggctaaacgcttttaaatttttcggtttaacacctgctaagcctatttacccaaacaaaactggctaaataactgatcgagtaactcgtcttggtaactatccccggtaatctcacccagtaagtcccaagcccgcgtcatatcaatttgaaccaaatcgaccggcatcccggccgcaatcccattttgcacatcgtctaacgctgcgctcgcttgatgcaagagcccaatatgccgggcattggtgaccatcaccgtgttttgactggactcaatgccctcatcaaagaacaagtgagcgatggtttcttccaattggtccatcccggtactttgtaaaatggacgtctcaatgatgggactatcgccggctacttgccgcaccgctgcgagatccaactgtagcgataagtccgtcttattcagaattaagattcgctgcgtatccttagtggctgtcaataaggcttcatcttccgctgtcaggggttcgctagcattaagcactaacatcaccaaatcagccgtgttaatggccttacgcgagcgctcaaccccaattttttcaaccttatctgtcgtatcgcgaataccggcggtgtcgatgagcttcaaaggaacgcccttgacgttgacgtattcttcaatcacgtctcgcgtggtcccagccacatccgttacaatcgccttatcttcgtgcaagaggtgattcaataaactactcttccccacgttgggccgtccaacaattgccgttgccagtccctcacgcaacaccttgccttgcttggctgtggctaacaacgttttaatctgctgcttgacctcgtgagccttctccagcagcattttagtggtcatggtttcaacgtcatcgtactcgggatagtcgatattaacttccacttgggccaacgcatcgaggatatcttgccgtaagtttcgaatcagtttagacaaatcaccatctaattggtctaaagccaccttcattgacttgtcggttttagcccgaattaaatccataaccgattccgcttgggttagatcaattcggccattgagaaaggcccgcttagtgtattctccgggttcagctaaccgcgcgccgtaactcaaacacagttgtaagatgcgattcgttgccacgatcccaccgtgacagttaatctcaataatatcttctttggtgtaggtcttgggtgcccgcatgacggtcaccatcacctcatcgacttcatcacccgtttccgggtccaagatgtgcccataatgaatcgtatggctgccaacttgggttaaatctgcccccttaaagagcttagcggcaacttgaaagacctcttcaccgctcaaacgaatgatggaaatacccccctcaccaggcggcgttgaaattgctgcaatcgtatcaaattctgttgtggtgactgccatgagccatcctccttttttcttctgtcggttcttatcaggtcattgacccagtcaaacataccgggcgtaccatttaatgccataaaaaaaagcacctactccacgccacctaacaagggcgcggataaagtactttcactactttatcggaaacatgataagaatgattgtctcaactataagggcattcgccccatttgtcaaacgaaacctaaaccggttgaatgaccactgcgcggtgcggttccttgcccgctgaataagtcgtgacgtattgattttttgcgagtacagcatgaatttgcttccgctcaaatgacggcatcgggtccaaataaatcggcttacctgaggcgacgacttcgcgcgccgtattatctgctagccggcttaacgttgcggcccgccgttcccgataccccgccacgtcaagttcaatctcaacgtgggcggcgccgtgatggttcaaatataactgggctaagctctgtagcgcattaatggtgcgcccgtgcttgccaatcaacaagccttccttatcggtggtgaaggccaaccgaatttggcgatgagcgctactctcaaggtcgagagtggcatcaatccctaactgatccacgatggtggctaaatagtcctggacaccctctatggccgcctgacgttgttgtcggcgctcggctggactaacgctgggctcagctgcggctggttcactaggcgcagttgcttccgcagccgctttgaccggtgctgcactcgacgccaggttcgccgctgatactggggttgaactagccgctggcgtcatcgcttttaagaccacgtcaacctgcgcgtcacggtggccaattcccaaccaacccttacgtggcgttgcaaccaccgttaccgtcacctgttcgcgtggcgcatttagcgtagctagcccagctgcggttgctgcttcaattgtcttccccgtaaagattgtcatcatcaattcctccagtatcatttcacgtatcgttccggtgtccactacggacaatgcgtgtttagtataccatgaatccccgatcaagccactggtttccgccgcgcagacaccacggttctgcctaaaattagccaaagaaaaacgcgctagcctgcgccagcgcgttaaaatgcatttatgtttaggttacttgcgtttactttgcttggcccgccgaattgctttcttaacggtacggtcatgctgtgccttttccttttccttcgcatcccgttccgcttgaatcttccacggattttgaataagaagggtttgaccaacttggaaaacgtaggaaacagtccagtaaagtgacaatgacgacgccacgttcatcgcggtgaagaacaccaccacgggcataccgacaatcatcatcgtgttcatggagttggtctctggtgccgatttagtcgtcaaccacgaactcaagaacgtggccagcgcggctaagattggcagaatgaagtacgggtccttgtggcctaattgtaaccacaagaaggtccctgaccgcaagacagctgtccgccagatggcttgatacagcgcccagatgattggtaattgcaccaaggctggtaaacagcccatcatcgggttaatgccggcttcggagtacagcttttgctgttctgcctgcagcttttgcatcgtttcacggtctttagacgagtacttcttttgtaaagcctttaattggggctgaacttcctgagttttgcgcatactgcgcgtttggaagatcatcagtggcatcaggatcacccggataataatggtgaaggcaatgataccgacaccataactcccgccgaacaagtgtgccaaccagataatcgcccgcgagaagttcaagacgatcaagccgtcccaaatcccggtactttgattggtgattggtttgttgctacaagcggagaggatgaacactaaactcacaatgcccagcataagtagggtacgtttgtactttttcacgtttattcctcgctataatcggaatccagcagttttgccagcttcaagacatgaaccaagctacgtttcgcatcggtcatggaaataccatcagcgcggggccgagcaatgacgagaaaatccacatcttgtttcagatgcggctttaactcaagcaagctctggcgaatccgacgcttcacccagttacggtgaacggcgttaccaatcttcttaccgacggaaatgcccactcggaaatgcggttgctgtggcttttccattgagtacaccacgaattgccggttagcgactgaattcctggtttcaaagacctgctgaaattccgcttctttcttaatgcggtaagattttcgcatggtgcatctccaaaattctcacgatttgtgaacagtccgcgcgggattggggttccagtccccccgcagataaaataaaaagaccactgaaccatcagcggcctatgcagacaatactttacgtcctttttgacgtcgacgtgctaatacctgacggccattgctagtgctcatccgcttgcggaagccgtgtacacgtgaacggtgacgtttctttggttggtaagtgcgcttcattacattgccacctcctcaatatattttgtaagttctatctgaatcaagttcagacatactaaatgcatttcctgaacatattagcataaaaatcgctagattgaaacaagaactttggttttccagaaaaaacttgtccccggttaaatttgtttcatgcactttgcttgtggataactctaaaattggaaacgggttattccgaacttgctaaccgagttatccactgttccacaagctgtttattttaaaaattacgttcttgctaattctgtgtataacttgtgaaacacttgatataatagcatttttagtcaacatgctcttgtggataactcaattggaaagaaactatccacagattctccattccctgtggataactcaatccacttgttgtgaaacaattatgcacagctcagaataacctgtggaaaactttttttcttcatgctacactagatttacgttttcgtttaaggggcctcgtgcgcccaaacgaaattaggacgtaaactaaaatagggggaaacatcagtgccagacatgttaactttgtggactgatattaaggcgttgtttgaggaaaacaactcgaagacagcctacgcgacttggattgaaaccgccaagccgattgccttagatggcaacaaattaacgttggaactcccatcacccctgcatcgtgattactggacccatcaacacctggaccagcaattggtagaatacgcataccaagccgctcacgaagatattcaacccgtgttgattctcgaaaatgaacgtcagcaacaggccaccttaaaagccaaaaccgcacccgttgcggctggcgaaccggttgaaccgacacccacgtttatgaaagaaacggcgttgaattcccgctacacatttgacacctttgtcatcggaaaaggcaaccaaatggcccatgctgcggccttggtggtctctgaagaacccggcgtgatgtacaatccgctcttcttctatggtggcgttggtctgggcaagacccacttgatgcacgcgatcggcaacaaaatgttagaagatcgccccgacaccaaagttaaatacgtgactagcgaagccttcacgaatgactttattaatgcgattcaaactcggacgcaggagcagtttagacaggagtatcgtaacgttgatctgctgctggtcgatgatattcagttcttcgctaataaggaaggaacccaagaggagttcttccatacgtttaatgcgctctatgatgatggtaaacaaatcgtgctcacctcagatcgcttacccaacgagattcccaagctgcaagaccggttagtttctcggtttgcttggggattatccgttgatatcacaccgccagacctcgaaacgcgaattgctattttacggaacaaagccgacgccgatcagatcgacatccccgatgatacattaagctatatcgcgggccaaatcgactctaacgtccgtgaattagagggggctttagcccgcgttcaggcttattcgcaactcatgcaccaaccaattgccacggatttagctgctgaggcgctcaagagtctgaacctcgccaatgctagtgacgccgtgaccattcccgtgattcaagaccgcgtcgctaagtattttgacgtgtcgctcaaggatcttaaaggaaagaaacgcaagaaagccatcgttatgccgcgccaaatcgcgatgtacctctcccgtgaattaacggaagcctcactgccacggattggcaacgaatttggtggtaaagatcataccacggtgattcacgcttacgataaaattacggaatcccttaaaacggatccacaacttcaaaaagatatcgacagcctcaaagatgacttacgccgttaatcagcgatcgccacggatcatacggttaaagatgaccagccccgtgacgatcttttggtgactaattgcggtatgatacgagtaggtcagtcaacaggtgtggataaataacggcaaccatcaaagttttccacaagttatccacaggtggaaaaccgcggctgtttgctagtttctcaaagttatccacataattcaccgctctactacggctactgttttttcttttaattaagttaatcaacgcacctagaaaaggagagtctgttatgaaatttaccatcaaccgggcagccttcattaaggaactcaacaacgtctcccgggcaatctcatctaaaactactattcccattttgactggtttaaaaattgtggccagtgacgcggggctcttattaacgggttccaatgcggacatttcaattgaaacgttaattcgtgcggacaatccggatgtcggcttaaccattgatgaaccgggctcgatcgtcctaacagcccgtttctttagcgaaatcgttaagcgacttcccgaaaaggaaatgacagttgaagtcaaagacgggttccaaaccgaaattacgtctggcgctgctgcctttaacatcaacggacaagacgccaataattatccccatttaccggaaattgatgcggctgattcagttgttttatctggcgccgttttcaaggaactcattagtcaaaccgtcattgcggtttctaatcaggaaagtcgaccaatcttgacggggattcactttgtcttaaatgacaaccaatttttagccgtcgccacagatagtcaccgattaagccaacgacaaattgaattgccaacacctagtgaggcgtcatttgatgtcattatccccgggaagagtctgaccgaactatcccggatgattggggatgacgatgcggatgtgaagatgcagttctccgaaaatcaagtgctcttcttgttgggtgacacctcgttttactcacgactcctagaggggaactatccagacacctcgcggctgattcctaaagactcatctacgacggttgaattcgaagcccctgagttattagcagcagtggaacgggcctctctgttatcccatgaatcgcggaacaacgtggtcaagctcacgttaacgccaactgatcaccaagtcacaatcttcagtaactcaccggatgtcgggaatgttgaagaagagttagcgcccaaagaaattggcggggagccgttggaaatttccttcaaccctgattatatgaaggacgccctacattcctttggtcaagccacgattcgcgttgcctttacctcagctttgcggccatttacattggtgccaacggaagataccagtaatttcattcagttaattacaccagtgcggacgttctagaaaatttcacaagcaatttcacaagcagaattcacaaactttgtgaggcaaaaaacgccgcggtaatcagcgcctaaatggtcgctggtgctgcggcgttttttgtggtgtagtcttggttagcagccgctagattccgactgagaaaatcaggaaatttcggcgacccatcaattagttgcgtgcgcaaaaaccaagctatcagcgattggggtggttagcgccagaaaaaaacgccaaaaatgagtgatttccgccataatggcgctatttttaattctcagcagatttaccgactttttaccaaaaatatcaaaagccccttagattggctgagacgctaaaaataaggtagtccatctgtaccttttcatgaaaaagcggtataatataagagacgaaaattaaggggtgaaattgtgaaaaaagaagttctcattgagacgccctacatcactttaggccagttactcaaggaagaatccgttatcagtactggcggtcaagccaaatggtatttgcaagaaaacaccgtaaatatcaatgacgagccggataatcggcggggccgcaagctgtatcctggtgatacagtggcagtaccagaggcaggattattttttatacgctcaaagcagggtgaataatgtatttgcaagagttgcagctgcagcaatttcggaactatccgacggctaagttaacgtttggacagggcattaatgtcttgttaggcgaaaatgctcagggaaaaaccaatctattagaggccatctatgtactcgcgttgacccgtagccatcggacagccaatgaccatgatttggttaattggcaagcgaagacggctaaggttagtggtcgggttgttaaggctgccggggccgtacccttggagctgactttttctcggcaaggtaaacgcgcgcgcgtcaatcatttggagcaggcccggttgtcacaatatgtcggtcagctcaacgtgattttatttgcgcctgaagatttagccattgtgaaaggcgcgccgacagttcggcggcgttttatggatatggagttcggccaaatgaatccgcgttacctatacaacctgagccagtaccggacgctacttaagcaacgtaaccgctacttaaaagatctccaacacaagcagaataaggatctcttgtttttgtcggtgttgtcagatcagttagcggcattcggtgccgaaattattgcccaacggttggcaatgctgcaaaagttggaacattgggcgcaggcgattcacggggagatttcgcagcaacgagaagaattgacgtttcattacgccactcaagtcgcggatgatcagctaaccgatgtgcccaccatcacggcggccttgtcggcactgtatgccaagcagcaagacaaggaactttaccagggcacgacactggtgggtccccaccgtgacgatttgcattttcaggtcaatggtaaaaatgtgcagacgttcgggtcgcaaggtcaacaacgaacgaccgcgttgagcgtgaaattggctgaaattgatttgatgaaagaagagaccggcgaatacccggtcttattacttgatgatgtgctttcagaattggatgatgcgcgccagacacatttattgaccgccattcaagacaaggtacagacgtttattaccaccaccagtttgagtgggattacccgccaactgattaaggacccaaccatttttcatgtggccgaaggaactgtggtggccgacgcggtggacagcgatgaccccgcagcatcaaaggaggattaggcagtggcagacgaaaaagaaaccaaagcgcaacaagctcgtgagtatgacgccagtcaaattcaagtcttggaaggtttggaagcggtccggaaacggcccgggatgtacattggctcgacgagttcccaagggttacaccatttagtttgggaaattgtcgataacgggattgatgaggccttagcaggctttgctgatgaaatccacgtgacagtcaaccaagacaacagcattaccgttaccgataacggtcggggaattccgattggtatccaaaagaagacgggaaaaccagcgttagaaactgttttcacgattctgcatgccggtggtaaattcggcggtggcggatataaggtttctggtggtcttcatggggtgggtgcttccgtagttaacgccttgtctactgatcttgaggcgcaagtgacacgtgatggcaagacctatgcgattgcctttgaccacggccacgttaagacgccaatgcacgtgattaaagagggcctgccacaagaccaacacgggacggcagttcactttttaccggacccagatattttccgagaaacgaccgtctttgatattaagacattgacgacgcggattcgggaactggccttcttaaacaaaggcttgcggattactattcgtgatgaacgtccggaaaagccaacggaagaagatttcctttacgaaggcggtatccggcattacgtagactatttgaacgaaaacaaagaaacgttatttgaaccgccaatttacgtggaagggcaagaaaacggtattacggtggaagtcgcgttgcaatacacggacgactaccacaataacctcttaactttcaccaacaacatccacacctatgaaggtgggacccatgaagaagggttcaaacgggcgttgacgcgggttgtgaatgattatgcccggcaaaacaagttgatgaaagataatgaagccaacttgaccggggatgatgtccgtgaagggttgacagctgtggtttccgtgaagcatccggatccgcaatttgaaggtcaaacgaagaccaaattagggaactctgatgcccgcacggctgtcgatcacacctttgctgaccactttatgcggttcatgatggaacatccagatgtcgcccggaagattgtggacaaagggacgctggcgtctaaagcacgtgttgctgctaaacgggcccgtgaagtgacgcggaagaagagcggcctggaaatcagcaatttacctggtaagttagctgataacacgtctaaagatcccgaaatctctgaactctttatcgtcgaaggggattctgctggtgggtctgccaagcaaggtcgttcgcggctgacgcaggccattctgccaattcgggggaagattttaaacgtggaaaaggcgtcgatggaccggatcttagcaaacgaagaaattcggtcactctttacggctatgggaacgggttttggtaatgactttgatgtgtctaaggtaaattaccacaagcttattttgatgaccgatgccgatgtcgatggtgcgcacattcggacgctgttgttgacgctggtttaccgctacatgcggccattattggatgctggctttgtctatattgcctgcccaccgctttatcgagttcgccagggtaagatgcaacggtacttggattctgatgaagaattaaaggatctgttggggcaattgccaccatcaccaaaaccacaaatccaacggtataaagggttaggggaaatggacgcggaacaattgtgggaaacgaccatgaacccagaaaaccggcggctcttgcgggttgatgcgcaagatgccatcaatgccgatcaagtctttacgatgttgatgggcgataaggtggccccacggcgtgagtttatcgaaaataacgccacgtttgccgaactggatgtttagttaagaacggagggtaactagttggctgatcaagattatttaggccgagtcactgacgttgacctgtcacaaactatgcggacatctttcttagattacgcgatgagtgtcattgtgcaacgggccttgccggatgtgcgggatgggttaaagccagtccaccgccggattttatatgatatgcatgaattggggatcacccctgataagccattccggaaatctgcccggatggttggggacgtcctcgggaagtatcaccctcatggtgattcagccgtctatgaatccatggtgcggatggcgcaagacttctcgtatcgctacatgttagtcgacggccatgggaactttgggtccgtcgatggagatggtgccgccgctatgcggtataccgaagcgcggctgagcaagatcgcgatggaaatgttacgcgatatcaacaaggacacgattgattttcaagataactatgatggtagtgaacgtgaacccgtggtcttaccgtcacggttccccaacctgttggttaacggggcttcagggattgcggtcgggatggcaacgaacattccgccgcataacttaacggaagtcatcagtgccttgcacattttgatgaagaatccagatgccagcttggctgatttgatggaagccttgccagggccagactttcccactggtgggattgttatgggtaaagcggctattcggcgggcttacgagaccggtaagggcaccattaccttgcgggccaaggtggacattgaagaagaaaagaatggcaaacaacggatcgtggcaacggaaattccgtacatggtcaacaaagccaaattgattgaacgaatcgccgaactggcgcgagataagcgaatcgaaggcattactgatgtcaacgatgaaactgaccggactgggatgcggattgtgattgatgttcggcgggatgccagtgccgaagtcatcttgaacaatttgtataagatgacgttgatgcagacctcctttgggatcaatatgttagccatcgtcaacggtgctcccaaggttctggggctcaaagccatcttgcaatactacttggaattccagttggaagttatccgccggcggactgagtttgatttgcgtaaggccgaagcccgggctcacatcctggaagggttgcgaatcgcgctggaccacattgacgaaatcattacgattattcggcaatcgcaaaccgctgacgttgccaagcaagaactgattacgcgtttcagcctgtctgacaaacaatcacaagccattttggatatgcgattggttcgtctgaccggtttggaacgggaaaaggttgaaaaagaatacgcggacgtgatggctaacatcaaggactacaaggaaatcttggcgtctaaagaacggcaacaagccatcatttacgaagaattattggaaattcaaaacaagtttggggacgatcggcgaactgaattgatggtcggcgaagttctcagcttggaagatgaagacttaatcgctgaagaagacgttgtggtgtcattgacgcacaatggctacatcaagcggttaccaacgtctgaattcaaggcccaaaaccgtggtggtaaaggggttcaaggcatgggcgttcacgatgatgatttcatcgaacacctggtggcgacgtccacgcatgacatgcttctgttcttcacgaacaccgggaaggtctaccggatgaaggggtatgaaatccctgaatacggtcggacggccaagggaattccagtgattaacctactgggcatcaacaataatgaacacgttcaggccgtcattaacgtcgctaaccccggcgaaaatgataaccgggatctgttctttacgacggtgcaagggacggttaaacggacaccagtggatgaatttgctaatatccggagtaatggtctcaaggctatcaacctgaaagaagacgatgaactgattgatgtcgacattattaatgccgatgctaatatgattatcgggacgcatttaggttacgcagtgagctttgcggctaccgacgtccgctcgatgggccgttcggctaccggggttcgcgggattcgtttgcgtgaacacgattacgtgattggcgcgagtgtcttgaagcctgacagcaaagtgtttgtcatctccgaaaagggctatgggaaacaaacggctgctgcggagtacccaattaagggccgtggcggtaaagggatcaagacggtgaatgtctcgactaagaacgggccattagctggtttgacgactttagatggtgacgaagatattatgttagtcaccaataaaggagtcatgattcgctttagcgcatctgacgtgtctgaaacgggtcgggcaaccttaggggttcacctgattcgtttagccgatgataccgctgtggccaccatggcgaaggtcgctaaggaagacgaaacggctgacgaagcaccagtagttgatggcgaaacacctgccacaactgatgggccagtcgtccctgaatcagacgacccaactgaagcttaattaatagtgaaacgtgggactttgccaaaagctggcagagtccttttttggttttcattcttttggtttagtgtgactaagtcggttacttttggctgtgattgcccacctgctggtcgtggcaaatgagctggaacgtagtatgacgtggccatattggttagggtgcctgtgtcaattacttttggctgtgattgcccgccctctggtcgcgacaaatgggctggaacgtaccggacacgactttaagtcaagtagatcacttgtcttaaaggtcggtcttatcctaagcgcgctaaaaacgcgcgccaaggataacgacggtactgagcccacttgccgcttctcgtcgggctactggggtgtggtgtggtcacgttggttggtccaactatgaccattactgcagaaacgttggatggtgctagtttgaagccacattggctgttgccgaggtgataattatccgtggttgtacggtcattaatttagtctgaacctggaagttacgtgtctggaaggcggccagacaaggctagttcgcacagcagtgagcggcttttactttttttaagttaaaaatgctcacgggggacgtaatccggaactacctatgtaacgtcagccccgccgtcggtcggccccgatttgcttaacttttaaatctatgctatactactagcttgtgagtatctggcttacgctagtgtctctccttgctcccacattgcagtgggggcctgaagtccataaggaggtgtaacattcatggaaactactaaatacgaaatcacctacatcattcgtccagatcttgatgatgctgctaagaccgctttggttgaacgcttcgacaagattttgacggacaacggtgcagaattgatcaactcgaaagactggtcaaagcgtcggttcgcttatgaaattggtggctttaacgaaggtatctaccacgttatcacgttaaacgcaactgatgacaaaggtttgaacgaattcgaccgtttagctaagatcaatgacagcattttacgtcacatgatcgttaagcgcgaagactaattttaaacttaaactgagaggagttattcagcaatgatcaaccgagtagtacttactggccgactaacacgggatgttgacttacgctacacccaaggcggtgctgctgtagccaccttcacgctggccgttgatcggcggttcaccaaccaacaaggtgaacgagaagctgatttcgtaagttgcgtcatttggcgcaagtccgcggaaaactttgccaacttcttccacaagggttcccttgtcggtattgaagggcgcatccagacccggaattacgaaaatcaacagggccaacgggtttacgtcaccgaagtggttgtcgagaacttttcgttcttggaaccccgttctcgtaacgagaacaacggtggtggaaactacaatggcggctccatgaataataatgctcctcaaaatcagaatcaaaatgccaatccatacacgagtgggaatccagctccggctgcgccttctcaaggtatggccccgaattctggaagtaacaatcagaacagtaatgcgaacaacaatgcagctgatccgtttgccaattctggcgattccattgacatttccgatgatgatttaccgttctaatatctaaaatacgaggagggaatttctcatggcaggacaacgtcgtggcggccgtcgccgtcgtaaggttgactttattgcagccaaccacatcgaatacattgattacaaagacactgacttattacgtcggttcatctctgaacggggtaagatcttacctcgccgggtaactggtacgagtgccaagaaccaacgtaagttaactattgctatcaaacgttcacggatcatgggcttaatgccattcgttagcgaagagtagtctaaatgacgactgaccttttgggttggtcgtctttttatgttccgtgtttgctgagattgaaacggtaataactgtttcacgtgaaacaattaaaatccccgtagcgtcagttgatgacggtacggggattagtcgttgcaattagaattcacgttttccactcaagtagacgtgcttgtccacctgttggacgttggctgtgtctgctaatggatcagcggccaagacctgaaagtccgcgaatttgcctacttccagggtgccgtagtcgtcagcgacacctaacaacgcggcagaattcaagctagagcactgataggcttgtgcgggagtcatgcccagtttggtcagtaaaccaaactcagctggagttaagtcaaaaccgttgaacggcgtacccgcatcggtgccacaggtgaatttaacgcctagttggtaggcgcgccgtaaattaacgtacgtatcgtcgagtgcatcggcggcttttttgacttcccagtctggcagttgtcccttaccaaattctggaatagtccattcggcaatcagggtgggtgtgaggtaagtgccttgggccaccatctgtttggcttcggtttcagttacatagaagccatgttcaatggaatctacgccggcatcaagtgcattttgaatgcccgggtttccttccgcgtgggccgctaccaatcgccgcttatggtgggcttcttcgacggctacgcgcatttccgctacggatagttgggggtcttccatgaaatcattgggcgtcatgacgcccccagttgccataaccttgatcgtttcaacgccgtgtttgaaggccgttctgaccgccttgcgcatttcatcgggtgagtcaacggcatgccccccgtgcggtgaatcgccgtggccgccagtcatggaaaaagcgcggcctgaagctaacagatggggggtgtgggggagaaggccgcggtgttgtaatcgcttgagcttcacatcaacatcgtagttggtgccgagttcgcgaacgtaggtgaccccggattttagtagtgtttggagattttcaaaggcaaagacgccagcttcggcttctgactgtccggaatcgccgctaaaggattgcggatcaagtgtgatgtgggtatgaacgttgaagaagcctggcatgacatagtgttcgcgcaaatcaacttggtggtcggtagtctccggtgttccgtgtccccgggccgttaaccggccagtattgtcgtcaacggtaaaccaagcagcgggctggttgtggtcagtggcaccatcgaataaggtaaaattaaaaaatgtagtttgggtcataaataagtcctcctaagtgagatgtgacagttatttccagtaagcatattgatacttggcttcgtgtagcagggtgtaggtcaagccaccaacttggttactgattaacttggcctcagacggttggtacaggggtatatatcccttaaccgccatcagtcgcttgtcggcggccattaaaccgttatagcgagccagtccggtttgactattagctttcgtgagtaactggttaaaggtcgtatcagaccaattggtgaaattaaccgaattccccttggcggcaaggctgagaaagtctgccgcatccagccaactggttgaccaaccggtgagatttaattcaaaattaccagcaaaatcgcgggccacgtgttgggcatgagggattgcggtggtggtaatggtcaggccgggtaaggttttctccaattcagattggagatatgtgccgactttcttatcgtcatcggtatcatcggtcagcagattcaaggttgccttagtctggcccgtttctttcaagtatttctgccagtaggttttggcctgttgcttatcttggggtagtagattaccgacttgagccgccatgtcctgccctgtttgtggatttttttgatcgccagttggtaccgcactcagggcagcctttgagccatcctgtaagacggatttagttaactgtgagcggttgatggcgttagaaatggcctgacgtaaattggtggagttggttgccgtttttttgctgttgacgtagaggtattggagccggccagttaaatgggtgtggaggttcttgctgttacggttagcccgtacataattacccgtaacggtggtctcttggaccttatcggcgttaaagaggttagcagcagtactttcatctttagtgacagctaccttaacgcggttgatcttaacgctgtcagcgttccaatagtggcgatttttaacgtaagaccaactggcattacttccggtccaaccaactagtttataggcgccgttgctgacagttttagcggcactagtgccatattgagcgccatatttcttcaccgcagctgtgtttagcgggtaatactcactggcgataagatcattaaagtagggtaccgccttggttaattgaaactggagcttcgttgaactcaaggccttaatgcctaacttgctcggagcggccttaccggtttgaacagccgtaaagttcttaaaggccgataacacactggcatattgggccttagtcttaggattcgccattcgttgtagcgacgtgacgaagtcttgggcggtcacccgttgaccattcgcccatttcgcctgcttcttcagcgtaaacgtataggttttgccattattcgtcggcgtaaccattttggtggcaacccccgcggtaattttaccgttgcgattataggtgtagaggccctccatggtttgaaaaatcaggctaccactattggtatcagtagatttattcggatcagccgtggctggttcgctggccaaggtgacgtttaaaggccgattcttattggtcgtatgacccgcagcatgaccgcaaccgctcaatgaagcgagtagtagcaggccaactggtaaggtccaaacaaaatgtttcatgtgaaacaccctcctagtgccaattgattagaggattacgcggaaaataaaaagcacccccacggaaataacttctccgtaagggtgctgttcgcacggtaccaccttattttttgctactcaaaaagtagccttatctatgaacggcggacgacctaagagatcggaatttagcgctaggctcgctaaaggacaatcctgcccgcgattcactgcattgataacggatgcttccggtgtaaacttacttaaattcagctaacggctccgaagggatgttcgtcaccagcacctgtccccgctcacactaaaccggggtcgctgaagaggtggttggtcactactggacttcatcatcactttttaattttctaatcaattgttaatgattatgagtttatcaccgattgaaaaattgtcaatggcaaattgaagattagttgaacgcgccggattgctaactggttgatcagagagattacccattactcactagatagataagctggtaatcggtgatgcctagatatcagttttgcacaatcgaataatatacggtaaacttcagatcagggtagagaattaagctttacaggaggagaaatactatgaaaaaagtggttacggggtcattagtgttaggggcggttatgggtggcctggcagttgttcaaatgccgcaacacgctcaggcagcaacgtatcaagtgaaaaagttaatggggtttagacacccaacgtcttattatgctaaaagcgccaagagcggttatttatggaataagtctcatacaaaacgcctgcataacctaaaaaattatcctaaaacgacttggtatgcgacagcaaagtattcgatgaagtctgttagaaatagtgggacatatttaaaggtgactaatgggactgggaaagccaaggggtatgtatggacgggatatttgaaaaagggggttaacccagccaatccgaatggaactctgacagatccttttggggcggcgatgagcacgtacaatgttgatgataatctgaacaagcagttgctgaatttgtttccgggaacaattccagatgaaccattacaacttgctgctgactttatttttgcgaatgcaggtgctaatcctgatgactatacgagtgtgattgaagaattggtaggagctgaaaatgaaccttctgtattcagactctcttctgataaacggatacagaaaaatcagaattttttgtcttttcagcgaaattccttaaaggaagaacttgtcacaaagcataaaaaattcacgagttttaagggatatcgaatcggtgcgtatgctttccctaagcacgacaaacggtacggagagtcgatgattcttttgctcccttcaaattaagatcgctaattatggcaatacagatatggacccaaatctcgttaaagttctgagatttaggtccatatttttaacgctatagcaacggctctttaagtcgaaatatcacactagcatactgaccagactcacctaaaactggcgcacaccaccgacatagacggccttatccgcttggattactgcggccgtgtcagctagtggatcggcacggagcacttggaaatctgcgaatttgccgaccgttagcgtgccgtaatcatcagcgatacccatgagagtagctgcattaatgctagaacactgataggcttgcgcgggggtcatgccaattttcgcaagaaatccaaattcttcgggggtgcgctcaaagccattaaagggcgtacccgcgtcggtaccacaggtgaatttgaccccaattttaaaggcctggctgaggttaagataggtgtcggccatggcatcagccgcctttttaacttcccagtcaggaagttggccctgtccctgattggcgactgccgcttcggccacgagcgtgggggtgaggtaggtaccctgttcaaccatctggtgggcttcatcgctgttgacgtaaaagccgtgttcaatcgagtcaacgccagcattaagggcgttttggatgcccggattaccttcagcgtgggccgccacgatgcggcgtttatggtgggcttcttcaaccgcaatggcgatctcagccgtggagagctgggggtcttccatgaaatcgttgggcgtcatgacaccaccggtcgccatgaccttgatgcattcagccccacctttaaaagcggtgcgcacggccttacgcatctcgtcttgcgagtcgaccagataggcagcgtgggggccgtccccgtggccccccgtcatcgaaaaggcccggccggatgccatcatgtgcggcgtttggggaagtttgccctgacgctgtaggcgtttgagtttgatatcaatatcgtaagtcgttccgcattcacgaatgtaggtgactccggacttgagaagggtccggagattttcgtaggcgaagaccgcggactccgtttccgagccaccgaagtgcccgctaaaggcatcaggatcactggtgatgtgcgtatggacgttaataaatccgggcatgacatattgtccgtggagatcgacagtatcggttgtgtcggtcggggtgccgtgaccgattgcggtgatccgcccggtgtcgtcaaccgtaaaccacgtatcggtttgattctggtcgttggtaccatcaaagaaataacagttataaaaagttgtttgcgtcatagataagtcctcctaaataaattatttccaataggcatactggtattgggcatcgttgagtagcgagtaagttaggccgccaacttgcttgctaattaatttcgcttcagatggctggtagagtgggacgtagcctttaacacgcatcagatacttatccgccttaaccaacccgttataacgagcttggccgctttgattctcagcgctcgttaggatttggttgtacgtctggtcgttccagttggtgaagttcacggaattacctttggcggccaagtcaagatagtctgaggcatcgagccagttggtcgaccagccaatgagattgatgtcaaagttaccagcaaagtcgcgggatacgtgttgggcgtgggggatctgcgtgagcgtaatggtcaggcccggtagattcttttccaagacggattgtaaataagtcccgactttcttatcgtcatcactatcatcggtcaagatactcaaggtcaccttggttttgccggcttcctttaagtacctttgccaatagcgtttggccgtgctgacgttgtaagttaacagattacccacctcacttgccatatccttgccagtctgcgggttggtctgatcaccgcggggaacggcacttaaagccgccttggagccatctttgaggacggagttggtcaactggttacggtcaatggcgtaggagacggcctgacggaggttttccgaggccgtcgtttggcgtttactgttgaagtacagtagattcattcggccaagcaggtgggtgtggagttgcttgctgttaccatttgcccggacatattcgccactaaccgtggtttcttggattttaccagcgttaaataaattggctgcggtcgtggaatctttggtgaccgccaccttgatttggtgaatcttgacgttctgggcattccaatagtgagggttcttgacgtaacgccaagtggaattgctgccggtccaaccaaccaatttgtaagggccattgctcattgctctggcggcatttgtcccgtattttgatccatactttcggaccgccgccgtattaagcgggtaatacttgctggctactaagtcattaaagtagggcacggccttggtcaattgaatttgaagcttagtcttactgagtgcggtgatgccaagtttagacggcgcgagtttaccgtgctgcacggcgttgtaattcttaaaggcggacaggacgctcgcgtattgcgctttagtggtcgggtcagccattcggcgaagtgacgtcacgaagtcttgcgccgtgacacgttgcccgttagcccacttggcagttttctttaaggtaaacgtgtaggtcttgccatggttggtgggcttcaccactttggttgctacgccggggatgatcttattggatttactgtaggtgtacagtccctccatggtttgggcgatgacgctggcactgttggtgtcagtgtccttgttggggtcaacggtggcgggttcatcggccaaagtcacgttgagcgttttattttggttagcactggatttactaccacaggcacttaagccagcgagtagcagtagggtaattggaatcagagatacaaaacgtcgcataaaatagcctcctaggcaaacggttagaacagagctgtcaggggaacggcaaaaagcgcccttacagaaaaatttctctgtaagggcgcttgcgcacggtaccaccttaattgggactcaatcgtgaacggcgacactcctagaaggccaaatgtcacgggctaggtcccgttagttgggccaggtcgcgattcacttggggataacggggccaccggtcgggcttactgtgaattcagctgacagttcagaagggagtttccaccattgttcttgacccgcttgcacttaaccgggctcgctaacaatgagcaacaggggtactagtcttcgtcatcacttttaaggttctaatcgtttgttaatgattgctagtttagcatgcctattgagaatgtcaacgagaaatttaatgaacaacgacccaaaacgcagcatactaggtatgtagagaactttttaaaaacgaatttgtgggagagcctccgtttggtaacccttaatgactaatcaatgattagcggaaaatgagaatttgacaactgaaatgggcggttagtcagcgggcgatacctctaggaggcttaagagttcgtgtaacaaatccggattgcttagtccgcgctgctggcgttcgaaagcgtacatttcactcttgagcatagcgactagcatatccgagcgaaacacaatcgtctgggctgaccaatcgggatgtaagggggtcagcaacttttggaaaagatctgtgagttgttggaataaggggctttggtaaaaatcttgaccggcttgtggcacctcactaatggtgttgagcaatgcctgattggcatcacgaaaggccaagtaatctgttaagacagctttaagtgtggctggcgtaggggtcgtttgttttatttgggcctgcgtcgtcgtaataaagacccgtagtcgatcatagactagcgcaaggcaaagcgcacttttattaggatagttacgatagagcgtgcccacaccaatcccagcagcgtgggcgatatcggtcattttcatggtcgcaatgtcttgtgtcgaaagtaggtgggttgcagttgtcaaaatcttttgatgattgtactgcgcatcttgccgcataaaaataactcctttcaagttatctctaagatagtctaaatacacggtattgacaagtggaatgtattccaattattatatggaacatattccacttttaattgaaaggtgtgttggccttgttaagtatcgggtatggctttatgatcggggtttttgttagtttaattggcggcgggggcgcgtcgttatatctgggagtcttgaccagtcaattgggattggcaacggctgtcgcggtaccaacgtcattatttgttgccttaccggcgttatttttgggatttttaacccaagttcgaattcataacgtcaattttaaattgggcaatcaattgctgttgacggcgattcctggagtcttagctggcgcgctcttagcaaaatacatcacggcaatgctgtataaccggattgtcggcgtaattttactcgtcatgggaatcattgtggtagtgaaggcccttcgaccaggaaaacaacgggacgtccggcaatcaggctggatcgccagtctgtttgggctattgagtggtctgatggtcggaattggcgggttaagtggtggcgcaacgactgcagcaggactagctattttgggcttatcagctttacaggcagctggaacggccacctatgttttatgggtcatgtccgccattgggttggcgattcacctgataacgagcaccgtagactggtccgctggaatggggctaatggtgggcgcgattatcggatcaattgggacaccgctagtcttgcatcgattaaatacagaacggcttaatcgctggttaatgccgtttttaggggtaattattagctactttggctggcgaatgctggtttaggtaattaggtgtcgtccgtcgagtcatcgtaacagggtgtttagggtgatgtttcacgtgaaacaacgcaagtacgtaaaatattgaaaatggccaaatacgctactaatcccgtcatgtcgcgggttatcgtgggaaacttgttttgtgattatgggttagtgtgataaaatgaaactgttatttgtaacttttttaccccaacacttggttggggataatctaacttttccagaagaatcagatgaggagcaaaatgaataaattattttcacgagcgaacgtgccggagtttttacagaaccggcgcttacggggcatcgcgatgatgacggccggactcgccattttgggtatcgtattggcgtttctgcttaattggatttttgggatcgttatcctaatcttggtgggcgtggcgacactgatggtgtttaatacgatggctgagattggtgcggatacgacgcaatatatttccgatctgtcttttcggattcaacagggtgagcaagaagccctgattcgcatgccgcctggtgttatgattctgggcgatagtgatcagattgagtgggttaacccgtatctccagcattactttggtgatacggatgtcttgaaccgctcactgacagctgttgatggtgagttagcgaagttaatcgcagacgcgccagcccagaagatgacaacggtcacttggcgcgattatcgctttacgttgtatgttcaaccggattttcatgccgtttatctctatgacatcacgcactatcagttgattcaggagcaatacgacaatgaaaaaattgcgattggccagattttcttggataactatgatgagatcacccagtcgatgacggatcaggacatttccaacctgcgaaattacgtgaccaatgagctgtcaacgtgggtccagcagtttgacatgtacctcaagcaattggatgatgaccattacttcattttggcttatgcgaagtcgttagccgcgattgaagcggataagttcaaaatcttggatacgattcgtgaaagcacctcgaagcaaaacttcccgttgaccttgagtatggggattgcgtatggtgatcctaatcttaacaagttggccgaccaggctcagagtaatctggacttagccttaggccggggtggtgaccaggtggtggtcaaagcagccgatcaagaagcccggtattacggtggtaagactaacccgatggagaaacggacgcgggtccgcgcacggatgatctcgcaggccttgcaagagttgatgaacgaatccgatcagatctttgttcaggggcattcacagccagatatggattcactgggtgcttgtctcggaattcggcggattgccaagatgaacaacaagacgtgctggattgtgttggataaggaaacggtgcactccgatgtgcaacgtttactggacaacctgaaacagtatccggacattgatgcgtcgattatttcaccagaaacagctttagagaaggcaaccgatcaaagcatgctcttaatggtggatcactctaaaccgtcgatttcaatttctgccgatctgtatcatcgattggaaaaccgcgtgatgattattgaccatcaccggcggggtgaagaattccctgagaacccgttgttggtttatatcgaaccgtatgcgagctcaacgtgtgagttgattacggaaatgtttgagtatcagtctcaagaaggcgaaccgatcaataaactggaagcaacggcgatgttaacggggatcttcgttgataccaagcacttctcattacggaccgggacacggacgtttgatgccgccagttacttacggtctgccggtgccgatgccgttgagatgcaacagtacatgaaagaaaacgttgatagttatttgcaacgtaaccacttgattgaaatggttgagttcgttaacgaagatatggcgttgattgtgggtgaagaagaccaaagctatgatcccgttacggcggctcaagcggcggatgatttgttgaatatgtcgggggtcgatgcttctttcgtggtgacccggcgagctgatggacgcgttggtatttcagcgcgatcattgggtgaaatcaacgtccagttaaccatggaagctatgggaggcggcggtcatttgtctaatgcggcaacccaaattgctgataagacggtggcggaagttcgccaacaattgctagatattttaacgcacagtgatgagccagaaacggcgacaacgtagttaattgcttctgcgtcagacttggcgtaggattaaacctagaatggaataagtgaggagtgaccgacgtgaaagtgatctttatgaaagatgttcgaggcaagggtaagcggggcgaaattaagaatgtcccagatggctacgcccaaaactttctcatcaagcggggcttggctaaggaagctaaccaatccgcaatgagtcaattgaatgcagaacggaaagctgaacagcgccgcgaagcagaagaattagctgaagctaaggacttacaaaagcgcctggaagatgataagacggtggtggaaattgtcgccaaagctggtgaagacagccgcttgttcgggtcaattccaagtaagcaaattgttcaagcactggataagcaatacaatctgaagctggacaaacgcaaggttgagttaccggaacccatccggtctctgggattcaccaatgtgccggttaaattgcatgctgacgtgaccgctaagattcgggtgcacgtggttgctaaacaacagtagtctgtgtttgaaaggtcgccgctgggtggcctttttcttttggggagatggcatttagggcgcacttaagcgtttgatggggtaaatggcattaatggattaaaggttatatagaaaacgtttttacaggtgcgactaattgtgatatacttaaccgcaaaagggagtgtatgcgatgttatttaagacaccaaagttttgggttagcttaattttcttgattaattttctagcacttttttccgatccggcccttagttttatctggtttatcaactttatcattggaattgccggtttagttttactcggttcagcagtccttgatgaaatcaccggtaagaacttgcggacgcaggaagccaccaatatgaatcggcgacggaattgttaaaataaccacagaaaaagcagattgtcaccatcgcatgttcggtgacaatctgctttttggtgttatgcaacgtggtagtgccaattaggttgcagtacgacttggtgtgcttgatagtatagaaaaccacttggtgcgtaaatctggttctgggaattctctttcggctggtaacaaaattaatacccacatggtgaaacacctcctgatgatgcatcaccagattacctgatcataaatgatcgtggggattttgttgccaaaacggttatttagattagctatcgaattgtttctcgtgtgatctaaactcggcggtctgacagaaaaatatgataaaacgccagaaactactcgattgctgacaacgacttggatggaaataccaggttaccgtgcgctggctgaccagtgcggactagcactgaatttgaagcatatattttacgaccccggtcctctcatggtaaaatagtcatttagaacagcgtttaaaaatgaaggggtaagtatggataatagcgtattaacagaccacacaccaccacagaacctcgaagctgaaaaggccgtcttaggggcgatctttttgagtaccgatgcgttggtggatgcgttggaatatctcaccccagaagacttctatcggcgggaacatcagattattttccaaagtatgatggacctaaatgaccgcgacgaagccattgacgtggtgaccattactgaccggttaacggctaagaatgaattagatgatgtcggcggcgtcacgtatattgccgaactggcaggggctgtgcccacggcggcgaacgccacgtactatgccaaaattgttcaagaaaaagcgattttgcggcggctgattcaaacggccacaaacattgccactcaggggtatcaacaagatggggatgtctcagaccttttagataacgctgagcgcgacatcatgggtgtggctgaaacccgcaatcaatccgggtttaagccgattcgtgaggtcctaaatagttcctttgaagagatcaaccaactgtcggaacagggcgataccatcacgggtctatcgacgggttacgcggagttggataagatgacgaccggcttgcatgatgatgaactcatgatcttagccgcccggccggccgtggggaagacggcgtttgcgttgaacattgcgcaaaacgttggcactaagacggataaaacggtggcaatttttagtttggaaatgagtgccgaatcattggttaaccggatgctgtgtgcggaaggctcaattgacgccaaccatttgcgaacggggcaactctccgaagatgagtggcaaaatttaattgtcgccatgggcagtttggcgaaggccagcatttatatcgacgatacggccggaaataagattaccgaaattcgggccaaatgtcggcgactggctaaggaacgcggcgacctcggattaattgtcattgattaccttcaattgattgaaggaagtaaccacgaaagtcggcaacaagaagtgtccgatatttcacggcaattgaagaaattggctaaagaacttcacgtgccagtgattgccttgtcgcagctatcacggggcgtggagcaacgacaagataaacgaccagtcttgtccgatatccgggaatccggatcaattgaacaagatgccgatattgtgtccttcctttaccgggatgattattacgaacgggaaggcgacgacagtgatggcggcggtgatccgcgagaagaagaggatcaagacgtgggagaagtcgaagtcatcattgaaaaaaaccggtcgggtcctcgaggaacggttaagttactcttcgtgaagtcgttcaataaattttcttcggtggcttacacgccggatcaggggtaatgatgaaaggtaatccgatcaaccaatgtaaatttggtgatcggatttatttttgggcaacgttgggttagatgataaccaaataaatcgccaaaatttgaaaaattcataagagtgtgccagaaagttcacaatttcatcatattttccgattagtatataaaacatagaagttaaccagtaaggtgcttctaccaaagattaacaatcttttttcatgtactcctcctcccctggaataatgaaaaaatagttaacgtcattcttatataatgacgttacccctactccgatgaccatcgctttccccgagcggtggtttttttttggcctaaaatagcggcaacttcagttctaatcataccgaagtcgccgctatttttatgtaatctagtaggcatcttgtagttttgcggccagcgcggcataactcgccgggagcgtcgttaattgccgaacatcatcgggaccgtcagccgtaatcacagttgcgccttgaaagtgcatatgaagccagtcgcaggaatactgtacggcttgcgtaatccccgtcgccttaatttggggctggtcagcgccaacgaccaaaaggtagaggcgtttaccggcaaaggggaaatcgtgggtatagctatcaaaccagcgatccataaagactttgagttggccggtcatcccgtaccaatagaccggcgtccccagcacaatgtcatcaaacgtcgcaaattgcgttatgagttgttcataatcatccgttaagtcttgctgcggccgcccagtttcgcgctggtcgtgttcgaagtgtaaagcataatcggttaagtgccacgtggtgtgaggcacctgatgtaagagtctttcgcccagtgcggccgtattacccgttttacggggactaccgttgataaataaaacagtcatgtcgccacctcctgctcaccagtttacggggaaacggcggtaaaaggcaattgaaatgactcggaggggtagtgttttgaagcgcgcctatgctagaatggaatctaattgaattttaactttaggaaaggtggggttcgatgcaagagattcggttgcgatggttactattgggggctttgtgtagcagtattgggatgagttttatttggccgttgacgaccatttacctccataaccgcttgggcgcatcactaacagtggtcggggtgatcttacttctatattcatcagccaacgtggttggtagtgttttgggtggccggttgtttgaccgctttaacccttattatctcacaatcggtggggtcgccttatcgctgataaccttggggggactaatgctgaaccatggctggccggcctttcccatcgccctgattttcttagggctagcttcgggttggacgcttacgatggtcaactcgctgggcaccacgattcatagtcgggacggtcgatatatttttaatatgctgtactttgcgcaaaacctaggagtggtgttgggaacggccctggtaggctttgtgtatagtaccagtgtcacgctcttatttgccattgcctttagtctcttcgtttgttttatggcggtggtggtgacgtgctatcgcgcaccagccgtgatgcaccgccatgtagtcgcacagacacaagagaaggtgaccattgcgcgacctaatcgccgtatcatggcagccttttttctttcgctagtaatcatttggattatgtatgagcaatgggtatccaatctttccgtgtatatgacggggatgggcattcctatgcgtgactacagtctgttgtggacacttaatgcggggttgatcgtggttttccaggcgatcattaattggttgagtaacttttttagcaatttatacttacaagtttatgccggcattttctttgtggccttgtcgtttttcacgctgatcttcgccaaagattacgcccactttgtggtagcgatggttatcttaacgctgggtgaggccaccgcattccccgcgattccagcgattgttaacagtttgaccccgcacgcggttaagggaaagtaccaggggatggccaatgcttgggccagtgttggcaaagcttttggtccgttatttggtggtctcgtgattgatcacgggtcttataccttgctgtttattctggcggcagtggctaatttaatgattttggggctaaatggcctcgtgattcaacggaaccaacaccgtgtggaaatttataagtaatttatttgggcgtttggtgtataatggcatcagaggaattgtcacgaacaatagggaaatcaggggaaagcatatgaaaaaacgaacgaggggcattactgggcttgcgctgggcctcgttgctgggggattgctcttcagccaggtgccgcaaaaccgctcaacggtgacggattcggttgttaagccggcttcagggcagacggccgttcaattgacggataccacgggtaaggggcacgtggcggtcaagacgcaaacgacgaccagtcaggccgggaaaacggttagccgggaaacgaccacgatgacggggcgccagccgcaagatgtgaataaataaaaagatttatcgtaaatctgagctattttttaagctatattcaagtggacgaccttacggcgacgtggggtcgtcttttttatacactgattttgggattatatacaattaaatgaatatttataaaacgattgacagctaaaatgaatgatgatagatttaatatcaatcaaaacgacgttgcccagaagagtaatggtggatcaactgtttagcgagtccgggaatgatggaagccgggtcagcaatcgccatgaagcgcatctggaagtcgtacgggtgaaatgagtagtccgtactgggtcgtgcccattaacgcacgcggtgttctcatgaataccataagagataaatcaaggtggtaccgcgaatcgttcgcccttgttgaccggagacggccaacgagacgaacgatttttttgtggcgaattgagaggggtaatggagaatgaataaggttatgggattgggtgtcgggttgctagccgtgatggcgttggccggctgtggggcccaagcgaagagtacgacggataaggcgttgaacgtaacaatgacgggaaatcccgcaacggctaatccggcgatttctggtgatacgaatagttccagcatgatttcacaaacgtcggagggcctgtataccctgaacagtcatggtaaggtaattgctggtgtggcagagaaagtggttaaacccactaagaacgggactgtttatacgtttaagctcaaaaagaatgccaaatggcaaaatggtgacgcggtgacggcccaggactttgtgacgtcgatggattggcaggttaacccgcaatctaaatcacaggtagccaataagcttaaatacgttaaaaattattcagcgattcaagcagggaaaaaggcggcgtccacactaggggtgaaggcgttgaatcaacggaccttacagatcacgctaacccagccgcaaccttggttacccgacattttagccacggcagtttacccgattaagactagcctgtttaagcaggttggtggcagtaaatatgggacgtcagcggcgaagaccatgtccgaaggagcctataagttagttgggtggaacggtgctgccgatagttggtcttacgtgaagaatccccattattggaatgctaagaacgtcaaaattaagcgggttaacgttcaagtagtcaaggatgcggggacttcttctaacttattcaagtcaggtaaggtgcaagagaccgtgttgaccggccaatatatcaagcagaatgccaataatccggaaatgactacgaccctgaatagctcgatgcgcttcttagaatttaatgacaaacggaccattacgcacaataccaaagttcgccaagcgttctcctacgtggttaatcgtcaggccctgaccgagaatgtcttgcaagatgggtccaaggccgccacgagtttaattccgtcgggggatggcacgaatcctaagacgggtaaagacttcaccaaagaagtggggaacttggtaagctataatccccaaaaggccactaaactttggcagcaagccaaacaggaattgggaatcaagaaggccagtctggagttactgacggctgatacggatgaacaaaagcacgcagcccaatacctgcagcaacaggcccaaaagtacttaccgggcttgacaattaccatcaagtcgatgccgttagcgcaacagattgccaagggtgccgccgggaactttgatattgatctggatggatggacgaccgattggcgtgacccagctgacttcttgcagatggcggatgggaccagttcggtaaacttcaccaagtggcagaacacccacttcacgaatctgatgaagaaggttgacgacacagcaacgtacaccacgatgcaacggtggaatctgatgaagcaagccgacacgtatgttaccaagcaagccggattagttcccttgtatcaacaggctaaggcgcacctggtttccaagacagttggtggcctaacctacacgatgaccacggatgctcagtataaatacgcttattggaaataacgaaaatgcctcgcgatgatctggtgatcaaagcggggcatttttattagtcgcattataatgggtggaaaaagtgttggtcgtcgctttttttggccagcttagtgtaaaatagctggtggagaataatgactgatcatttcaggggaatcagtgcgtaaccttacgcctggttataaatgctataggggaggagacggtgattgtgacttttcgcgagattttgtggcaacaggttcagcaaacgcttgatttgttgaagctctacctggggctgttgattccgattttcggtttaaaatgtgtgatggacctcattgcgacgggccagttattttggtgggattacggtcgattattaggagagtgtatcggtggttttattggcctctttttgttaattgacgtaatcggagccgcgtggcgctattatcggcgaacatagtatagtaagaaaaagcgttgaccaattggccaacgcttttcagtgtagcatcgcctcggtgtaaatagcatggtcagagacgtggtcaaaaagttcgttgccattattggtgtacgtatcgacgaacatgccttgaccgtcattgatgacgtagtaggtgccgtgggtgttcttagccagcatgacgatgatcgtctggtgttgcggcaagatttcactcgccgttaccgccatgtgggtggttccgccttgcgtgaaggttagtgtcgccccgacgttgcctttaaaggctttgtcgatggccaaggtttgggtggtgtaataattcttgggcgctttgtggtgattaacactcttggtaatgtgcccttcaacaatgatgggggcagattttttcagttgttcgacgccagtaataccgttgtcgtagtctttcaaatggtcaacggttaaggttgattgagcggctgtcgccagtgtcttagtcgtcgttgctgcggacgcatagatctgcttagccccgcgaatatcacaattacgaagggcgtaggttcgattagccggattcattgcgctaaccgaaccaccatcattgtgagcgagccctaacgcatggcccatctcatgaatggcaacattagtgcgttgctttttggtgtagtgatattttgtcaaaacagttcgattcaagtacatgccagcaccggtttgaacgccttggcggttgacggcgaggccgttgtaggtcatgccagtggcattagtccatatgccagagttgcggttgacagaagtggtaaatgaccgtgactttttattcttagtggttgaccatttgaacgtcttagatccattccaagccttgcgcgcgttagtccaaatcgatcgataataggtgctagttgacttgttgtagtagctagccttcttggtcatataacgaaacttattcgccggagtgattcgcagcattaacaggtaggtaactgagcaaaacgaagcaactcagggctatggacaaacgttttttcatgtgacgggggtcctctccaaattaagatcatacataaatgatggtacaatagcgtcacatttaagtttaaataggctgaccagatctgtctaggagtcaaaatacgaagaacgtgctaagggcgctcgacaaaaaatagaggggatgccgtcctttggttgatgcataaacataagcgaagcggatatttatacttgagggtacaaaaaaatcagcaaccacgaagtcgacttcgtgaaagctgattagtaagtgatgggcagtcaggggatcgaaccctggacccacggattaagagtccgttgctctgccagctgagctaactgcccatgtgattaagttgtatgtcttccatatcaacgagaactatcatatcatgtaggccagaggtgcgcaaccccttttttgaaaaaaactgatttttattcaattttttttgcattttacgatttagatgctgttgaaaacgtgccattagtcaagcgtgccagctttaaatggtcatcgggaaatagttgaactagatagcgagttaatggcctgaacaaccagtaacgtgtccgatacagtgttggatagacggtggtttgataaaagcgcttactaaaattcacaatcagtggcattcaaatcactgactaatggaagcatcatttcccgggaaatatccggttaaagaaaccttaaaagcttgactctctaggactgaaagaagtttcatgatgtgttataattcaggtagcgttgattttgccgacactggaacgttatcaggtcgggcaacgccttgaaacgggtgccctaattagtggggaccattattccttgactttaaacgatgaaagattaaaaactaacgtagtggccccattgtcggtggtaatgtgacacccgatggctggcctgccggtaatcctgcaattaccggattcatttgtatttcccttaaggaggaaatttttgctatgcctaagaaaattctcgttgttgatgatgaaaagccgatttctgatattatgaaatttaacctcgaaaaagaggggtatgaagtagcggttgcctacgatggtgaagcagcggtgcaagccgttgaagaagacgtccccgacttagtgatcctagatttgatgttgccaaagattgatggactagaagttgctcgtgagattcgtaagaagcatgacatgccgattatcatggtcacggctaaggattctgaattggataaggtcttgggactagaattgggtgccgacgattatgtgaccaagccattttctaatcgagaattagtggcgcgggttaaggctaacttacggcggcaaaacacggcagcccatgctcaacccgaagaaccagaaaaccaagatattgagattggcgatttgacgattcatccagaggcttactctgtttctaagcggggtgccaacatcgagttgacccaccgtgaatttgaattgctccattatctagcccaacatattgggcaagttatgacgcgagaacacttactacaaacggtgtggggttatgactactttggtgatgtgcgaacggtggacgtcacagtccggcggttacgggaaaagattgaagatagcccgagtcacccaacgtggttagtgacgcgtcgtggggtcggttactacttacgtaacccagattccgatcaagcttaacctagcgataacgctaaatctcgcattgaggagtatgtgacttcgtgaatagtaaaattagatggtttcagtcgattcattttaagattgcgttggtctttgcgctactcctcctgttaacgctggagatcgttggtgccgtctttgtccggcagttggaacggcaaaatttaaatacgtttaaggcccaacaggtcgtccaaacgcatattgtcaaccgcttgtcagatgagttgtcgatgagtggaatgaccaaaagtaataagcaaattaaatcgacgctgtcggaaatcaacaacactaataatgcgcagatccgcgtcattgataataaagggattatccgcggaactaacgaagtggataaccagggaattgttggtcaaaaaaccaccgacaataatattaagaatgccatttataataaccgagacgtggtgcggacaacctatagctctcagagcaatagccgttactataccaccattacgcgcttaattcgcacccagggcaataacagcgaattagtcggggttatttacatgcggtcgagtttagactccgtttaccaaaatattaaccagattactttgatctatgtctcggcgaccttcgtggccatcattttgggactggtcatggcgatcattatttcccgggcaattacccgaccgattgatgaaatgaagaagcaaacgctgcggatcgctcgcggcgactactcagggcacgtgcacgtttatggtaatgatgaattgggtcagttggctagtgcggttaataacctgtcagtccgggtggaagaagcccaggagtctacggaatctgagcggcgacggttggactccgttatggcccacatgacggacggcgtgattgcgaccgaccgccgggggaacgtgacgattattaatgaaacggctagcagctttttggatcatgagccggacgatgcagtgggcaagtccatcttggatttattggatattcgggatgactatacgctccgcgagctgttggaagatccagatgacttggtcttggacttttcaaccaaagaacacgatctgatcttgcaagcctacttctcgcttattcaacgggaatccggatttatttctgggttggtctgtgtgctacatgatgtcacggaacagcagaagatcgaccaagatcggcgtgagttcgtgtcaaacgtgtctcatgagttgcgaacgccattaaccagtgtgcggtcttacattgaagccttgtcagaaggtgcttggaaagaccctaaggtggcaccagacttcttaaaggtgacacaggaagaaacggaccggatgatccggatgatcaatgaccttttgaccttgtcacggatggattccggaacgcaaaaggttgatctggaaatggtcaacctaaacgagttgtttaactacgtgctggatcgctttgacatgatgttaaaacaagatgaccagccggaaaaaacgtataccatcaaacgagacttcacgaagcgcgatctctgggtggaaattgacaccgaccgcttcacacaagtcttggataacctaatgaataatgccattaagtattcgccagacggtggggtcgtgacggctcgcctactagagacccataacaacgtcattttaagtgtctctgaccaagggttggggattccacgggcagatattccgcggatctttgatcgattctaccgggttgataaggcccgttcacgggcacaaggaggaactggcttgggtcttgccatttcgcgagaagttgtgcaaatgttaggtggccgaatctgggtcgacagtcgtgaagggcgcggctcgacgttctatatttccttgccttataagccatatgatgaggaggatctctgggatgaagataactaaaacctttttgcctctgggattaacccttgctgtggcggtgagtgtggccttgtcagcgatgatttggacgaacccggcgcagtatgaacgtaaccgacaacgcagttcgaataccacgacgactgaattaagtgcgcgcccccaaaaggatgtgtacttaccgacgcaggtggtttatacgaacgccaatgggaatcaggaattgttgaataaccgtaaagtgagtttgaccacggagatcagagaagccttgtcgaaatgggaactgggacgtgtgcggacagttaacgtgtcatcaaaagcggcttacatgaagtttttgcaaaccaagagtagtgttttgctgtcctatgcggcgccaatcaacgtgaagatgtataacacggtctttggcagtcagcttaatcgtacggcgactaagttctcacggatcttggtaccgctgacggatacgggagatatttacctattaaatgatcaggatcaccgggtttaccgggtgacggtacgcaagagtcacacgcaggcgcttaaacagattttgcaggagaatttatttcggattaatgtgaaactggattggctgaaccaaacagttatgccatacgtcacaagtcaagtgaccgttccatcctatagttatttggttaaccagcagtcgaccgattactttaccacgcgtttgttaaatagtggagagtcgaccaacgtgtcagctaagaagaataaagatagcaccacgtatagtgatggggcatcgcggcaaatgaccgtctacaataagcgggggaccgcattgtttgaggattatagcgcgatgcaagcctcattgagctttagccaggcgttgacggctggttactcagcggtgaagtccattgggttgccgatggaaaacttacgttactatggctatgatacgggcaaatcaacggtgacttaccggagctttgtcgaagggttccccatctttaatcaaagtgattatggggcggctaggattcagatgctatcgcaaggcgttcggcggtataatttctcactgtatagtttacaagttccagtaccaacggataaaaagtccgcgacgttgccagggacccaacaggtcattgaccagctaacagcggcagggtatagtcaaaagaaaatcagcacgttgcagttagggtatcagtggaagacgtcgacgtcttctgacaaggtggttaatttaacgccaacctggtacgtgtactacgccggtagctggaagacgtatacccaaatgctaaagacacaggcataatagtaaaggagggcggtccggcatggattttcgccgcattgagtggttgtttctcgttgcgttcattgtcatcgatatattcttgtttgccgccttccagcgtgatacgtctggtgaaacggatacgtcatcgaaccgttttagtagtgataccaccattttaaaggaaatgcgggctgataatatctcctttaaggcgccttctaaaaagagtggcgaggggtactacatttcaacgagtaacgatagcagcatcaagagtagcctgactagtttgagtaatcaaacggtgcgttaccaaagtgatgggaccattacgtcaacatttaagacaccgattaccggcgtggatacacagcatccggataagaccttggataccgtggtcagcaacagtacgctgattcttaacgggacggactatacgtataataccaagctttctagtcataatacggtggtctatacgcaggaagtggcggatgggccgatctattcacggtacggtgagattcgctttagcctgaccaatgcgggcaccgtgaccggctatacgcaaggctacttggccaacgtctcaacgttgcgagaaaagacggaaaccatctcggaacgtaaagcgttgatctggttgtatcagtataatcagattcccaacaataccaaggtggtctggacgaagttggcctacacccgttatttcaatttaaagaatagtagcgtttatattccgacgtgggttattgcggttaggtccaatagtggtaataacgcgggtgtcttacaactgaagcacgtgaatgcctttaccggggccatcttatccaatgatagtaacgtaaagacggttagcggctcgacaacgacgagtgagtaacgaaaatgatgtgaagaggctgccgcggggtagccttttttcatgaactaaaagcgcgttaattgcgagataacgagattaatattagttacaaagcgactcagatgcggtatgattacggtattgaagtaaaggagcggtcaatttggatttgcggacgaaaacaacagtagccgatgacttacggatcagtgtgttatcgagtgggagcactggtaatgtttgctacgtggagagccctaacgagcgcattatgattgatgcgggcttgagtggtaaaaagattgagaagttaatgggtgatatcgaccgcaagatggcagacgtcaatgccttgttggtgacccacgaacatagcgatcaccgccaagccgttgggatcttagcccggcgttatgagcagttgaatgtttatgctaatgaagggacttgggacgccatgagttccaagattggcaaggtagatctggcacaaaagcacttatttgcgccggataccgtgcagacctttggcgatattgatgtggaaagcttttcagtttcccatgacgcggcagaaccgcagttctacgcgattcactaccacggcaagacgtttgtcattttgacggacaccgggtatgtttcggaacatgtggaaggtatcattagcgatgcggatgcgtacttgttggagtgtaatcatgacgtggaaatgttgcgaatgggggagtattcctggcccttgaagcaacgaatcctgggtgataagggtcatctgtccaatgaagaaggggccgatacgctgatggatgtgctgggtaatcgcaccaaaaagatttatctcggtcatcgcagtttacacaataatatgcagtccctgtgtcatttgacggtggcgtcaatgatggaaaatcgagattttggcgtgggccatgacttccaattgattgataccaatccagaagaggcaacgccactagtcgcgttataaattttatgaaactttaggacttcagcactaaatcatcaaaaaaaattcacacgcacccggtatgataggggtattaaaataacgaagcggttgaagaccggttggttcgaaccgctaaatgaggagggttcgcgcgcgagcgcaatgtgatggataacaataataatcaatttaataaccaacaacatgatcataatgaagaaaccacaccaactccggaaccacggaaacggcggggtggcctgacactgatgaaagtggcagtgacggcggcggtcgctggactcttaggcggcggggttgcgtacggcggtatcaactactttaataatagtgggatgaatgatacggcggtgccagccgggagtaactcgaccgggaacaccaagacctctaacgtcaacgtcaatgtttcgagtcaatcaaccaaggcctttaataaggttaagggggccatggtctcggtgattaatttacagaaggaaaatagtagtagcgggacgcttggccaattattcggctcaagctcgagctccaattcatcgaaatccaagtcagagctggaagaagcttccgaaggttctggggtgatttataagaaggacggtaacgtggcttacatcgtgacgaacaatcacgtggtttccggctcttcagccttacgagttgtgacgagttccggtaaacaactgcaagcgaagttggtaggtaaggattccgttaccgacttggccgtcttaaaggttaatggttcatcattgaagaccgtggcgtcatttgggaactcagataatatcaaggtgggtgaaacggccttggcaattggctcaccactgggcagccaatacgcaacgtcattgacgcaagggatcatctccgccaagaagcggacgattgagacgactaattcctcgggaacgcaaaccgggaatgcaacggttattcagacggatgcggcgattaaccctgggaactcagggggggctttgattaatgtcggtggccaagtagtcggcattacctcatcgaagatcgccagtgatgcggaaggcaccagcgttgaagggatgggctttgccattccatctaacgaagtggtcaatatcatcaatcagctggtcaagaacgggaaggtcgtgcggccagcgttagggattacctacgttgacttggcgaacgtttctagtgcgcaacagaaatcgatcctgaagttgccatctaatgtggaaaacggggtcgtggtgatgagtgcttcggcgggctcaccagcgaagaaggccggcttgagcaagtacgatgtgattacggcgctgggcggtcatcagatttcagaccaatccacgctgcgagatattttgtacaagtataagctgaacgataaggtctcgatcacttactatcacaatggtaagaagaagaccagcaccattaaattaacagaaacctcttctcaattaaagactagctcgacgacggcaacgtcagagagttaggcgctaaatgaaagcgaccgtgggaatttccctgcgggcgcttttttagtatgataaactgtttagtgaaaagccgaaacttacgatggtgttggccggaatgaaagcgccagcttggcggataaggccgaacgaatcggtataaattgggagcagtaattcaggcgataaaaaaagtagatacaaggctgtggataactcggggaataactttgaccataagatggacgaaaagttatgaacagggtgaaaccgggaatggaaccggtgcaaaagttatccacaggtattggggataactgtggataataaaagtattgatcgctattgtggatgaaaatactgtcaccgtagggtttgtaagcggacagaacgaacgcgcgttttgtctgtgtcttgtggataactaaaaaatcattgacattttaagaaaaaataaatgtagtgggtcgggccaatgaaaccactatatctaggaaaacggcttatccacctgtggataactttgtggataagctgtgcataggaggctaattatgaacattaaatttgtggttgtgggtaaactcaaggaaaagtatttcaaacaggggattgcggagtatgccaaacggctgtcgcgtttctgtaagttttcaatagtggaggtgccagatgaaaaggcgccggagaatttatcgcaagcggaaatggatcgggtaatggcagaggaaggggagcgaatactggcgaagatcaaggaccgcgagtacgtgtatgcgctggcgattttgggcaaggaacgctcgtcggaggcattcgccaaggaaattaaggatttaaccacgtatggacactcggatattacgttcgtgattggtggctcgctggggttgaccccagccgtcttgaaacgtgccgacacgcagatttcctttggtaagttcaccctgcctcaccagttaatgcggctggtgctgacggagcaggtgtatcgggcgtttatgattaatgaggggagtccgtatcataagtgatgcggtttttcaggtaagaatcactgtgtaaagtgttacgggaatctgtattacaaacataggtataggtatggttcttcaaaagtttagatttactggaggcgtaattatctttcgactaagaagtataaatacgatttttcaatataaagaattagaaaaacaaagtatatattttgcaccagcgaatgctgaagatgatatgtatgaaggtaaataccccatgtattttgagggggatgactccttgtggcaatgtctttttgctatgctatataagcatgtctcactcaatttagcaatttgtggtgaagaatatgataaatatataccagcgtttgttcctgtaaaaacagagttaaccagtagaaactacgattacgaaggtgaagagcttaaaggatatttgtcgttaggaacgataggttctctgataaaattattcgtagcctcgggaaaagtatatgagaaccagttacgtaagattattattcagtatgtactttttctaacaatttattacgaaaaacaatttagggctcatgtcgatggtcagatagaatctgaaaacaaagaaaaacaaatggtaaaaaaacttgacggtgtaaaaaagataatagatgtatttaaagaattgccggtcgataaaccaggccttacaaatattttggcacaagtcgctagagatcctttgcattatcaaaaagatttagatattgagggtcatcaatttactaattatcagatggccgaaaaattaatggatagttttttcgaggattacgagatattacgttggaaaattgttatattgcatcgtttacagataattgtatagatgctcgaatgtggcatgattatactaattatgaaggtattgcaatagagtataaagacgatgaatcaatgatgttaagaaacgccgaaggaagtactcgaaaacataaatttagaaaggtaaagtatcgaaaggctcgaggttttaatttctttaattctataggaaaactacctgttcctatgattacgggaatgtttgcaaaatatgattggaaaaactttcaattggttttcgtcgacttgattgtagcacagggcagtatgccctttttattttgttttgaaaaaaaggcgtcgatggattttatccatcaacaccaaatatcatagagccggaaatagcggcggttgccatgtggcaggccgcttttttatttgataaacaatttttttgagcaaaggacttgcgaaatcggtctagatcatttacaattggactataccattagagagggagactgaatgagatgaaacaattagctaatatgaatgttcaaatcgtcagtgataaaattgccggaggacaggccggctatcaggtctttgaaacggctttgcagcagggagctaaagtactaggtttggcaacggggagtacgccagtcacaatctatgatcggctggtggccagtgatttggattttagtcagttgacgtccgttaatttagacgaatacgtgggtttaagtgcagatcatccccaaagttaccattattttatgcaacagcacttatttgacgctaaaccgtttgcccactcctatgtaccggacgggactaacttagatgagcaggcggcaactacggcgtatgatgacattattgcagcgaatccaattgatttgcagctattagggttgggccaaaatggtcacatcggttttaatgagccgggaacaccagcggactctaccacccataaagtcgcattaacggcctccacgattgcggccaacgcgcgatttttcgataatgccgacgaggtgccacgttatgcttattcaatggggattggctcaattctaaaggctaaacaaatcttaattgtagcttatggtgaagcaaaggccgctgccgtggccgccatgattcaagggccagttacaccggatgtaccagccagctttttgcagactcatccgaatgttacggtgattttggatgaagcggcggctagtcgtttagattaaagctatgttacaacacgattttatcttaagtttttcttttgagaccccgtcaaactatggtattctttacctgaaagcgattttaagggggaaaccgataaaatggtgcgaataaaacgatggctactagcggcactggtgatgagtgccggtgtcagtggctttatgttaacgaaggggacgagtcatgcggcgacgacggacccacaaacctttatttcaacgctcaaaagtcccgtcacgactgttgccaatcagtataagctatacccgtctgtgatgatggcccaagcggcacttgaaagtgcctggggaaccagcacattgacaacgaccgcaaataattattttggcattaaagggagctacaatggtgcttccgtgacgatgaaaacggctgagtatgatagtaatggtcaattatattatacgaatgcgaactttcgtaaatatccaagtgctaaggcgtcaatgacggacaatgctaagcttttacgtaatgggaccagttataacaccagtatttacagtggtacttggcgggaaaatgcggcaacgtatgcagatgccgctaatgcgctgactggcacgtacgccacggcgcccacttatggaagtagcttgatttcaattattaagcagtatgggttgaacacgttgctggatgctagtgcttccgatagttcgagttccaattcaaattctggctcaacaccaaaacctaaaccagtggtctactctaaagcaacttattatggtgccagcgggacgcaaacggctcgattgagtgggcagtatgcgacttatcggttgtataaccacgtgaagggaacccgcgccaatatcactaaaacggcctggagcaaagttgctgctggaaagaatgtcttagtttacttggacatgcggggcgttaaaaaagatgcatcaaccgggaagaagacgacttggtatcgcattcggttcgccaaaaacacctcagctaaaaaatattgggtatataccaaggcgttgacgttgccaaccgtaaaatatacgagtggcacggctgcagtcaaagtgaataatacagttagtggtagctattatgatcatgtttttaactcaccttatttggcaaagtccatgggggccctaaataagctaacggcgaagtcctatgtggctgataaacaagcaatcaaaacacaggatggttataagtcaacgtggtaccggattaaggttggtaagcaagcctactggattgcggccaccgagacggctgcggcaccgcagtatgacgcggttacttattcagcagctagcggaaccaaaaagttaagtgctaagtacagtaaatatacgctctataatcacgttaaaaaaacccattttaatcagaaaacttacaaatggcctgcgggtagtaaaaagggcactaaggtaacggttaatttcaaaggtgtgaaaacggcttataagaccacgtggtaccggattcagtttaacggtagtcagacgaattactgggttgatgcccgggctttggcttaagttgttgcataactggaacaagtaaaagggtttctcggaattaagcagattctgagaagcccttttggtgttgtaataatgtcttgctcaacttaattagtcgctaactgttggggttgagcgggggtggcggcagccgtgcggggcttgtagccaattaaacgcatggcgttgaaaatgacgactaagatggaggcttcgtgcacgaacataccacttgccatgtagatatacccatagactaaaccgattaggagaaacgccaccgtgagaatggcaattgtaatgttttccttagtattggcagatgtttttttcgttaagcccaccgcgtgactgagtgcggtaaaactcgattgcatgaggaccacatcagccgtttcaatagcagcgtcggttccaccccccatagcaatcccgacattggctgttgctagggaagggctatcgttaatcccgtcacccacgaaggcaacattgcggcccatgtcttggaacttcttaacaaaggtaactttgtcggctgggagaagatctgcgtgaacttcgtcaattcccaatgattcagctacagcttgagcggtcgcttggttgtccccggttaacatgactaaatgcttgattccttggcgtttcattgcagctaaagcaccaggaacttcaggtcgaacggtgtcggctacgcccaaaatcatagcgagttgcccggcataaccgaccaacaccgtggattgcccggcatcttgcatcgcatgtaggtcgcttagctggtcctcggtgagggaaatctgatgatctttgagtaaggcggcattgccgacgtataatggtgcgtcgtgccattggccgatcattcctcgccccttgatggtctcggtagacatcgtaacgggagtatctggcgattgggcagttaagtgtgcaacaattgcttgggctaagggatgatcagaagtctgttcgatctgcgcaacacccgttagtaatgagtgatcggttgtatattgcttggttgaagcaacggtcattttaccggtcgttaaggtcccagtcttatcaaagacgatggtatcgactttggctaggctttcaacgacatcgcctcccttaatgaggataccgtgtttggcaccgttaccgatcccagcgacgttagaaacgggagcaccaatgaccaaagcgccagggcatcccagtacgagaacggtgatcgctaaacgtaaatcacgcgagaaaatataaactagaatcgcgatgactaggacagccggcgtatagtattgcgcgaatttatcaatgaatttttccgcgggtgatttagtgtcttgggcttcttcaaccaactcaataatcttggaaaaagtagtctcgtcaccgacttgggtggccgtaatcttcaaggtgccactttcgaccattgcccctgagtaaacgtgatcgccgtgttgcttattaatgggccgtgattcgccagtaattgaggcttcgttgacgtaaccagtaccatctgtgattgtgccgtcaacggggatttgaccaccagccttaactaaaaccaggttgccttcttctaagtcatcgacatcaacctcttcggtagtatcatcgtcattgactaatagtgcagttgtcggtgccatttcagttaaggattgaatggctccccgcgttttggctagtgttttttgctcgagataggaaccaaagagaaagagaaaagtcacaatggctgactcttcaaattcaccgatggcaaaggcgccaatgacggcaatcccgacgagaagttcaatactgaagaccctggctttaagggcgctgatggcgcgtaagacaatgggggctgctgcaattaccgaagcaataatccaagcagtatccgtgatataaggaacttttgtgaaccatttgttgagaaagccaagaatgatcagaccagctgaccaaaaagtgatgggattagtatgggaataaatataacgttgaattgtcataagtgaacgatcctttctttaaaagacaagcttaagtgttgggttccttgttgatgagtttattatgcctgctttttgcctagcttaacttgatgtgaatcaagttagcgagaatagttggtgaaatgagtaaaattaatagaactatggacgagctaaaatgcccctaaatggccaatcaaagatcatttaggggcattttactattattgataactagtggtctgtgcgtcacaagtgaacatgaccacacgatcgtttaaggttaggcaaatggtccaataaaagctgtctagtcgtcaatgcaaccggttacttcaatctaaccgcttttgtcagaaaaatgcaaccggtgggctaacaaaaaaacgacgccgcctcacaggacgtcgtcgctttttgatttaggggaattaattaatcatcgtcgtcttcatcctcatcatctaaaccggtacgagccaaattacctaaaacggcttgaagttcgcggataatgtgattgttggttccgcgaagggttaccaagaaggtggctagtgcaggccgactttctttttcagcgagcttaatggcccgatcaataaagagattgtgggtatccgcatcatgaatcaattcgttgagttgatctgtagcggcgtaatactttttgtcgccaccttcttgtagcatgttatagtcatgatactctttcgtggtggttgagacgatttcaccttcatctagtagcaattcacctagcgcatcaaattggttacggtaagtggtgatgtaggtagtgaggagttgacggacgctgagtgctaggggaccttttactgaccaacgaacctgatggaacttgacaatggaaatatgcaggttagctaagatgtggttggtcatggcaccagcggtgggaacgtggtgatcatgttcggtttgcgcttgttcagcagcgtaacggtcttcaatagttgtcgtcatgggcgagacatcctttctaatatgacaagattataggtctttaactttggcgcttttaacggtatagcctaaatcggtaacggccgcttctaaactttcagcactcactttgtcagtgttgaattcagctttgattttgctggcattaaagagaactttgacattttcaacgccgtcttttttactcagggcgccttcgattttagtcatgcaagacgggcaggtcagatcgtctaatttcatggttactttactcattgggaaaacctccttgaaagttgtttaacttgattacaagacctagtatacggagtcattgacgagattaacttgactcaaatcaagttgagaagattttcgaaaaatactttaatcgaccggaggagcagacggtactaaagaaaaagctaagctcaacgagattttttccacaaagcggaaatatttggtataatacaacagactaagctcaggcactgtgctgggtaatgcaggtagcgcaaattttgagttaggaagtttaattcatggataattcttataaaattaaagtacaacacgtgacaaaggaatacgatctttacaagagtcaggcggaaaagttgcggtcatttttctcactaagcaattctaaggtgccccatttttggtctttaatgggcatttcactagaagtgaaggctggagaaacgctgggcttgattggggttaacggatctggtaaatcaacgctctctaatattatttccggaattattccgcaaacgaccgggacggtggaggtgcgtggtgatacctcaattattgctattggtgcgggactacggggtaatctaaccggcttggaaaatattcgcttgaaggcacttatgcaggggttaaccaacccagagattgatgccttaatggatgatattgtttcttttgcggatattggtgacttcttgtaccaacccgttaagagctattcatcagggatgaaatcgcggttgggcttttcgattgcggtgcacgttaatccagatatcttgattattgatgaagctttatccgtcggggatgataccttctatcaaaagtgtgtggacaaaatttctgagttcaaagatgaagggaaaaccattgtctttgttagtcactcgttaaagcagattgagattttgtgtgatcgggttgcttggattcattacggcacgttaaaagaaattggtgctactgaaacggtggttaagcactaccgcgaatttaccaagtggttcaagggacaaagcaagaaggaaaagaaacacttccaacggcaaatgaaagccaaccagaaagcatttgatattgatgcttaccagcaacaggtgattgaggaacgacaggctaatgatccgagcgatcagaatgttgccgcagaagttaaaaaggacttctatggttcagttatcagcgaaaagatgagttggggtaatcggttcttgaccatcgcagtgggaatcgtgtttgtgttagcctgtctgatcaacgtttcagggcactcactgggagacgtgctacaaaatccagggaatatcgtgcacccagaaacagttctccacgataccaatgccacgtctggtgtcaaataatagaataatgagaaaaaaatagattcttatcatttaacgtggtatcgttaaattaccatttatttacctctttagctgatttcccaatgaattggttaaaggtttatctctcatttggtgaagactaaatggtgggggctggaagttatttccggccctttttgcgttgatgactaactgtcttagggtcaacgcggtgtttagcggaaatcatcaaaaatagaaacgtttttctgaaaaagtattgacagcgcttacaaataccggtatattatagcttgtaaggtattaataattaccttctaatcaattctctttctctcttatgccgaccactgccattccctggtagtggttttgttttgttcgtagaccggttataatagatttattgcgcggaggtgagagtgatgaagagtcatgaagtatttacgttgattgaagagataacgcgtttagatggcagtaagtatatggaaattagtaatatggtgcaaaatggccgggctgagttggcggttgaacggggactcattaaagaagttcggattttacaattaaacatcgcccatacgccacacgttcaggcatacgaggattatgttaatgagcactatgcgatgcctgaagaagactttactgagtttcaggaatgggccaagccagccgagattcaagaagaagtcatggcaatcttacatgaaaatcatattggataggtaacttaagtaacttacttaaaccgtaaccagggatcttgttggtagatccttggtttttttggtatggagcaatggggagagggacgttaatcgtttcgtctatcggtatataaaccaaatgtcagtttgaacggctacaaaattgtggtgctcaactaattttcgtgctacgatgaattcggattcataagttacatattttgttttgggagggtatttcttatgaaaaaatctttaactgttatgagtgcgttattaatgctggcgagtgcgggcgccggtatttcagtcaatcaagtggttggtaatccagcaaccgctcaagcggccagtttaaacgccgctaagctggcaaatggtcggtatagtgttcagtttaaggtttacaagactgggactaacaaaccgtctgaggccgctcgatacttagatagcacggcaaccgttagtgttaagaataaacaggctacagtgacaatcaaagcgactgctgctgggagcccttatattaaggcgctgactctgggaggcaagacgggcactgttaagcaggcaacgagtggtaacacctataccttcacgaaggtagatttaaccaagacacaaacgattggtttttcactggctgtgccaatgaatgggcaaaccatgaccatgcaagaagcagcaacgcttcagtttaagaccaacacgcttaaagcaaccagcaagaccaccaaaaaggcggttgccttgagtactaaacgggttaaagcggctgctaagaaagtatgtggtacaacgactaagggtgccaaagtaacggttaagcataaccagacaaccttgggcaggacgacaactaaaaagacggcttacacggttaaactgaaaaaggcagttaagaagagttggaaattaaaggtaaccgctactaaagccggttataagccagtaactaagacggtaacggttaagtaaaacaagccatggcaaccgtgacggtgacaacgagatcaagacgtctagtctggtctcgttgttttgtctagcatttaaaaagatgagaaacggggagtttatcaatgaaagttcgacagcaattctggcggtggctcggttgtttggtactgatttgggccatctttattggttggtcaggaacagcacatgcggcagcactgagtaatggggtgtatcaggttcccatgaagattattaaggctgatagcaatgcaacctcatcagcgaatccgttcttcacggattcggcagtagcgagagttcaagatcaacagacaacgcttttgataacatctaatggcgcgcaatatatcaagtcgatgaaaatcagtggtcaaccggtaactaaggtcaaggcggttaaccagcaaaccatttatcaggtgaatctaactggtcagacgagcccattgacaacaacctttagtttgacaacgccgttgggggcaatgaatgaaacggcccggctagcattagattgggaaaaagcgcaacgactcagcacaacaacggcaacgagtgaactattggatcaggcaatgacactggctgatacggcaaaaagtagcagtcaggcaagttctcaggacaagtcttcgcagcagacaaccccaacgataaccacaaagacgagtacggcccaaacggctaaagcaactgctaagactgagtactggcggtatcaagtgctgcagggaacaaaaatgaagaaatccgaagcagatcaatactatacggatcttgccaaggttaccccaactaatcaaggctatcgcgtgacactaacagtcaagtatgccaagtcattaaagttagggagtcgggcggttgtgcctgaatcaatcaatcgaatggcaccgcagcaggtgagctatggtcaaacggctaaggcatataccatgcagtatagttttaaggtcgctaatcgacaagacttagccagtcaattgatacccggaaagattcacgtgacagtaccagttatgtcgatcagcgaaacctttccgattcgcttccggtttgccagcagtggttcggcagatcagactcaggcggcaaccgttgctgcattaccgaaaaccactgaacagacaactgcagcaacagcgccatccactacgcaccacgccgcagctaaggcaacgttgcccaagacgggcgaacagcaatcttcatggtcgatgttgggctggttgggactcatcgcttgtggttatgtattaggggggaaacaacgtgaaacagcagattaagaattggctatgtgtcggattatttgcgctcttatttttgtggttaattccaaccccggcacacgcacaatcaatcgattatgcggcgttaaagtatggaaccaagcaaacgtcaatggcgagcggctactttgttcatccggcgacggtaacggtgagaaatcatgcttatgtggttacgatggatattaagacagctaaaaagctgactaattggccggtcaaggtattgtctgttgacggccagacaccaaccaacgtgcgcaaggaaaaggattcggcaggtaactcgcatttatattattcattcacgacgaccaatttaaaacgggcggttacggctaagctcgcgattaatgtaccagacgtttaccgcgctaagcatttgattacttttaaatttcaaacagcccatctgccggcactgacccaagcaaaaacggcagcaacggtgaaaaaagtaccagcagtcaaggcatcaaaaaaggcgaacacatcaactgccagttcaacgtcagcggtcaagccaaccaagtcggttcgccatcagccaaaggccaaggagcaaccgacaacgtcatcaagctcgtcaagtcatcagccaagtgcgaagacctcagttaaccagcagtccgccactaatgcggatcgcgttccccaacagagcacgcattggggccggttaattggtggtgtcgtagcgattttggtcgttgtcggtggcggtagctggtggtatgttggccgacattaggaggaaaagcaaatgcgaaatcctagaaaaattggcttagtaacactggctgtgctcgtactctgtggaataattggtggtggcctggcttggcgtcagcaatatcggcaacagaaccagccacgaattgtggccacaacctatgccatcgtgcaaattgcggccaaacttcatttaccattagtgggcgttccgacgacggctaatacgatgcccaaacagtatcagcatgtcactaaggtgggtagcccaatgaatcccagcgtagagaagattgcagcgctgaaaccgaccgtggtgtattcggtgaccacgttggatgatcagtttggggcagcctttaagacccaacacgttacgccgcactttttagatttgacgagtgttggtcatttgcagacaacgctgacgcagttgggacaacggtaccagcgccagtcggctgcagctaaacaaaatcggttgattaaccaggcaaaacagcgggtcaagcaacgagcgcaacgacaaaaagcaccacgggtattagtccttatgggcttgccgggtgccagttatatgattgctaccaatcggtcctatgtgggtgatttggtccgattagccggtggtcaaaatgtgtttacgagtcagcatcaagaataccagcaaccaaacgacgaagctattcaaaaggctaatccacaggtgattttacgtttggcccatgccatgccaactatggtgaccaagcaatttaaccaggaatttaagtctaaccggatgtggtcgaagatggcggcggttaaacaccaccgtgtctatgatctaacggaaccgacatttgatgcgacggccaatatgcaagttgtcgcagcgctaaatcaggtgagtcgctggctctatccccaggaggtgccagcatgaagcaacatgcaggttggtggtataccggaatcttaggcttactgctggtgacgattgtactagcgatgatggttggcaccacctggctaggcattgcgcagattttccgcgccgtgacacgaccggcaagttcagattttacgaccgtgtttacattacgggtgccacgaattctaagcagtctaatttgtggtggaagtttagcagtcgccggggccctgtttcaagcggtttttcgtaacccaattgccgatcccagtattttaggggtgagtgcggcagctaattttttcaaattagggggcgctctgttgttgcccgccatgtggggccgcaattggttcttcgctctggggggcggtttagtcgccttggccattttaaccagtgggcgcgcattagctgatccctaccgcttgattattgttggggtggctttggatgcaacctttgtgggcctgcaacagttactcagcagcggggcgacacaaatcagctccagtacgtttaatggtatgacgtggtcagagactaccgtgctcttgattttgggggttatcgggctgataggggccttgttgattgcaccttgggccaattacctaaagttgactgatacggcactgagccacgttggtgtgcccgtcagcgttattcgctggagtctgctgctattaggcatgtatttggcggttagtgttaccgcagtcgtgggcgcgattccctttgtcggcatcgtcgtccccaatattgcgcgacgcttagtcggacatgattatcagacggtcttgccgttttcaatgctggcgggcgcttggctgatgttagcagcagatacgttgggacgaacggttattagtcccagtgagatttcggcagcgacgatgatggcgattatcggtggaccgtttgtgattctgttactacaacgggggcgaggattttatggaatgtcgacacgttagttatcattatccacggcaaaaaggtggtctcactgcgttatctggcaacttgccgactggaaaaatcaccacgattattggcccgaatggagcaggaaagtcaacgctattacagctgttggcaagacaattgttgcctcaatccggggagattcgtttggccgatcaaccgctggctcattggaccaccaaacagctggcccaacgagtggcaatggtcacccaacatcatcagctatatgatgagttgatggttcaggaggttgttgccatgggacggttaccatatcatagcttatggcaaacggtgccgtttcatgaggtgcagccttatttggcgcaaacggggttacttgctttagccgatcagttcatgcaagatttgtcaggtggtcaacagcaacgtgcgtggctagccgcagctttggctcaggaaccggccgttttgctgctggacgaaccgaccacgtatttagatgtacactatcagcagaccctgatgacgcagttgcaatcgttggcggctaagggcatgacgattgttcaggtgctacatgacatcaatcaagcttttcgggtgagtgactggttgtggctattgaatgatggtcgtttggccgccagtggaactccgacccaattgcgtgatccacaactgctagagcgggtgtttaataccgctgtggaagtggtcacggtaccgcgatttggaccttatatcgtgcaattgcctaattagattatgtgaaatttaaaaaatgagtacccgcgaaatgaaaggtttcgtaggtgctcatttttagttggtcaatgactctccgccttgatttgattgattcgttcaaataaaataccatcgcgtaaaccggcgttggaaaaggtaattaactgtgaatcaagtaggcgcattagcagggcaaccgggactaagccaccgacgataatgtctgctcggtccttggaaagccctggcaccttttttcgttcagccaggttgagaccaagtagctgcgttaaggtgttatagacatcggtggcggttaatttgtaaccatggatatcttctacgtttaagaaatttttcttacggcgattaattttagccaatgttcgattggcaccgcctaaaccaataatcggtaagttggtcgcttcgcgtaaccaccaaacatcgttgaagacgttgttaacaaacgtcatggcggagaaaagcgagtcggctttaatccgatcattttctaaataagcttgagataacgtgacagatcctagggggattgataccacgtgtttcatctggcgattctgaaccaagatgagttcggaagacgcgcccccagtatcgaccaataagccgttgacgatcgggagtgtatgaataacgcccagatagtcgtagcgcgcctctgttgcgccagagatcaccttaaacgtcaatcccagctggtctttaacttgcttgagaaattgcttttggttcgtagcttggcgaacggctgccgtagccacagccacaatgcggggatgatcgagcttatcatagatggccttaaactcacttaacgccgctagtgtccgctcaatagccgcgggttgtaactgctgatcaacgcccatattttctgatagacggacgtaacgtttttcagccgctaaggtatggtgatcgccggtatcatcaaggttactgatggtcatccggacagaattggatccaagatcaatgacgactaaagtttccatattattcaggactccgatcaattggggattgtggttgattcttagggcttagcattggtttaaattgatgtgtgccagattgattagtggcggttggcttagctgctaaacgttgcttagttgcttctgccatgaacgtggcttgggcatcaagggcgtccagtccccgtcgatcaacacgagtgaaggtccggtcagcgagtaagacccgggtcttcacattatcttgccatagggtatcaaaaatggcaaagacccgctgacgtaaatcagcctgtagaatcgggaagagtaattctactcggcggttaaggttacgcgtcatgaggtccgcactagacaaatagacttggggatcaccggcattagcgaagacataaatgcggctatgttccaaatagcggccgacgatggagtggacttcaatgtggtcgctgactttaggaatctcgacgtttaaacagcaaatcccgcggacaattagtttgacatgaacgccagcatgcgatgcttcgtaaagcttcgcaatcatggctgagtctgatagggagttcatcttcatttcaatccaagcgggttgaccagccttagcgttagtaatttcctgattaattttagcagtgataaaatgccggataccatcaggagacatgtggagctggtgaaagtagggcggttccgaatagccggatagcatattaaagatatttgaggcgtcgatgcccatgtccgtattagttgtcatgagccccatatctgtgtagaaatgggccgtaacatcattgtaattaccagtgcccatgtgcatgtagcgacgaattccatcggcttcacgacggacgatgagggccaacttacagtgggtcttaaggccaatgaggccgtagataacgtggcatcccatcttttcaagttgctgggcccaatggacattattttcttcatcaaagcgggctttgacttccacgagaacggtgacttgcttgccgttttgagctgctcgcccaaggtatttaatgatcggtgagttagccgaaactcggtagagtgtcatcttaatggcgagcacatcatcatctgctgctgcctggcgaatcaattcggtaacggcgccaaacgtgtcgtagggatggtggaccaatacatcatgttggcgaatggttttaaatacatcatcgtcaggcgtgaaacccggcgtgcgattggcggtgaatggcgcgtaacgttcgttatcgtgatcgctaatctgcttggttagttggctcagaaaagtgagatcgatgggtccgctgatctcataaacggcatagtctgccacgttaagcgcgttgatgagtcgccgtcgcagcgctgggctgataccattttccacttcgagtcgaaccgcaccgccgtgttctcgtcgtttgagctgctgttcaacttcctttaggaggtccgaggtgtcttcttccgcaacatcgagatccatatcgcgaataacccggtaagttgaagcttccttaacttgatagccgataaagagattgccaataaaggttttaatcacatcctctaacatcatgaaatcgttaggggcaccaggtaaacgcaccgttcgggggaaaatatcgggtacttgaaccgttgcgaagcgtttatcttttttatccccattcttatagagacgcagggcaatattcagtgtgttattgccgataaacgggaatggtcgggagctgtcgacggccatcggggtcaaagcgggcgacagttcatcgttgaaatacttttcaataaaccgtgtttgttgtggtgttaagtcctggggtgtcaaaacgtgtacgtctaaattgccaagtgctggtaataacatgcgatttagcgtggaatactgtttgataacttggtcatgcgctttggcattgactgccagcaattgatccttagcggtcataccggaagcatcgggtttggggtaattgacagcggcaagcttggatagggatgccactcggaccataaagaattcatcaacgttgctttgggtgattcccaagaagcggacgcgttcgagtagaggattagttttatcccgggcttcttccaaaacccgatcgttaaagtctagccagcttaattcgcggttggtatagtactgcgggagtgtgaagtcgagtgtcatttgtgtaatctcctttgttttagtactggctgtaagccgaaaacatccgtaaagaatttagctttataagtaaaggcccaatgaatcagtgacagttcatcatcactgaaaaccgtgataatcacacgatcagctcgaacggacaccgaaattttttgaatcgtttgttggtgggcatcgtctaaagcatcagctaaccgtaagatagctgataatttggcgacgactaagcgtttatcactatctaattgttgaaaatgggccagatcctcaccaggggtccgggtgctgtggtaacgggagactgcagcgataatttgcgtctcttcttgtgataatccaagtaaatcggactgtttcaaaacataatctgagtgtaagtaatgctggtgggtatcaataaatccgccaatgtcgtgaacaatcgtcgccacttcaagtaataaacggtcacgtgtggttagatgatgtaaagcccgtagctgatcgaataaatgtagcgcaaagcggcgcaccaactccatatggtgcggttctacgcgatagcgttgcgctagatcttcagcggaagccaaaatttggttttcaaagtgggctgttttatgataacccgccataattgcttgattggtcgttaatccgtcaatgatgttgaggttaaccagttggattttctcagcgtgaacgacggttagcaattttttgattagcaaaacgacaggcaaaattagttcaacgttttcttcggtgagatgaagccgttccatcaggtattgatcggaagccccggcgacctcccgactgaactgattgaagtcgtcaagagtcaatggagcactgatagcaccctgcggaatgaagtatgcatttagcggttcggcaccaattaagataacctgattggaaacggtctgcaaatcggccggcaaaaagcgatagaagtcatccactttactattgatgtaatcatccaagacatcgactggatttggggccgttgtccgtaaatcttgcagaacttctttaatccgcactggtcctaacttcatattgtgagatgctacaagttgttcttgtgcgaaaaaggaaagcgtcgtgctgccagaatttaagccgataattgcggcatggtgtttgaccagatgatgataatggtcgaactttaaggctacggcttcattgcgcacgaaggattcctcgccccacgagagccattcgatgtgtagaccagtacgaacatagagctgatctcgaataaactcagcattaggtgctgaagataacgcctgtgagccccagagttgatagtgggtgacaccgtagtctttaatgatttgtaagaagccgcgtagtgcttcagcggcctcggcaaccgtttcaaaatcaatgtcttcgtgattgtaaatattttccccaatagcgacggttgatttgacgcgttccacttgggtaccagattttaagttaacaatggatagctcaatacttgagacgttgaccagcattgctccaaaatagtcatcagccatggtcattcaactactttctcttaaaatttagtcagtaaaaacttgattgtccataataacccgttccaaatgtttttcggtgcgctggttctctggtggtaaggccagatagtccccatacatcctagttaaaatcgtagcatagtttcggggaacctgaacctgcaagtgctcaaagggaacggtggttaggtcgcttagttccgcaaccgtgaagacttccttggcataggcgtattgggaggacaaatttttgacctgcggcagcgtgatttctgcttgatattgggtcatcacggcctgacgttctgccttaagggcgttaacactggttaattgttctgagctgagcggaccttgaagcttgcgaagcgggttatccaccagatgatagcgtagttggagcaagatccgcgtatttagcagctgaaacttggtcgactgcttttgttgagcgctagtgtcttggggaattcgatctaagggaaagatgtcaatgaaaatacctttacgggcgttgttgacattacgcttctcctcaatataggtgcggcgatctagcagtttagcgtagctcaggccgtagttttcatcactagtgggcgtttgtaaaaagtagggactatctgctagatgagtaggggccgcagcaaggagttggtcataatcggcgcgtaagagaccgacgtcaacatcatcatcccatggaatgaagccttgatggcggattgcgcccaataatgagccgcccatcaaaaagtaagggagaccaagctgatggcaaagctgatccagttgggcgagattaccgagttcaacttggtgaatacgttcaattaaagtgggcatgatagattcctttctagggttaagttaagggatagtggctttgatgaataatctggtggtgagtatccttgaatgtaacggtgatgggctggctagtcttaggctcaaaggtggctaaaccggtaacggttttaccaggtgccacatccatgactgtacgatttagtttgttattgtcttgcgtttgattagtagtaaaggccaagttgccagtttgcagttggtggccgctttgttgcgcactgactgcactttgccagatgtcgttggggatgatggacttggcctgatgattggtcaccgaatagtacaggacgaataagttgcgattagccgttgaactagcagtgactttactccccgttaggctgaaggtgacatctttaatcgtaaagcgttgttgcttaaaagtggccgttggtgcttgtgaggctgcttgcgatgaggttgtttgactggaacgcgacgtagcagtttgatggccgggttcctgttgactagatagctgtttttggccacaacccgtcaataaaaatagtgtccccaataaaattattttgcgagataacatgaaaattccccctaagcgaacttatgtctattttagcataaggttggtccagaccaccggtaaaagactggtatttgataagggtaaatgctaagataaaaaacgtatttttagaaatgtaggtggggtaatcatggttgagcaggaacaaccgttgctggacgcttttattgatgtctacatgagttcgttgaaatatttagatgaatttatttccgaaccagcgcaggcctttcacttgtcttttgaacagtatctgattctccgggaaattacgcagaacgatcaggtgacactgatggatattgccagtaaacggcaggtaacacgcagcgctatttcgcggcaaatcaaggtgttgttgaaagcaggctatttgcaacaacaaccagatgaaaacgatcggcgccggctgtacttgttggtgacgccgacgggtgctaaagcggagcgtgctattcgccaacgaatcaaccaacgctttcaagggtggctggatgtttatggtgatcaacgggctcacgagatcctcgactttatccgtgattttagccaagtgacgcaaatgaaaaaataacgctatgtcgcgtttaactactaggtgacgactggtggagagaaggagattgaagtcaatgagcaaaaagcgcatgagcgatgaagaagaaaagcgctggcgcaagattgtcttcatggatgatgcacatgctgacaagaccgtccgcaagacacggccatacgtatatggcgaagagccaatgaagcaatcgtggtgggagcgcttaacagcgcgcttcagtcggcgttaacgtaaaaagcagcaactcgctggtaggactagcgggttgttgcttttttagcgttaattaatggacaattggaggagctggcgagaattcctgaactaacttgacctgaacgttgtcactaccgctcatgagcttcgctacagggcaccggcgctcagccagatcaaccattgccttagctgtatccaggtcaacgccgggaagcttaatttctgcggtcacgtaaaactgtaggccccgtcggtcgcgagccatctcaacaattgtgtggacctgcgaggtgtgtgggagatcccgtcgctgttcaattgcttccaaggtggcatttaggcaagtgcttaaagccagcccaacgaattgctcaggattggcacccggttgatcgttggacggactgctagttaaaacatctaagccaccgggaatataggagtgactttctaagccatcatcgttaatggcaacggttcgatagagtggtggaaacttttcgcgatcaatagccaaaagaccaacttctttctgtatatttacccctagattacgccggttaagaaaaaaagacaattgttttacttataaatgtaagggtttgcgtaatagctacaccagtgacaattttagctggtaatgagtgggcgtgattaacgctatatcggacaacaaccggttgcgtgtgataactataccaattttaaaaattaacgttattggttttagagatattgacttgaaagcttgctctgtaggtaaatgggtttatgtagaaattttgtacttttttggccgatagggtagaccgctaccaaattaatgcttataatgtaagggacaagcagtagaagattggcgaattgagtttggggggagccaaatgttaaacgaaaagctgtcaaatgaacagaaacggttccaaatgattacttggcgggcaaagcaacacggcgcacaggttgtggagggcgatttgatgcgccaattcacggcaaccgtcgctgaacaaaaggcgttacttgctaatgtacatcaacaacggacaacatctgtgagctaacaccgcggataattaactaactagacctaaccctgattggcgagcatgactcatgataggcaactgtgcaattcattgaggaggtaaggctgatgaaacatccaatgagctattatggttactatgtggtcggtggtatctttgtgggcattatggcttttgcaatcgtccgcttggttgaattatggttggttgttagtaatatgtaagtcacttaagcaattgaacttaaatacgtgcggcacctgtaaaggataccgcgcgtattttttgaatgaaaataaaaaagctagttacgatggacgcaaccagcagaatagaggtatgtgtacggccccaacggtgttaataatggctaaatgtcaattaactcctccaacgattgaaagcccgtagcaggttctcacctgaatatgtgtcttcattataacgtgtggtggtagttctgtaaaccacaaatttaaggatatctttaaatgagttggcttaacagaataattaaggtgaccagtgcgggaaaaccttgaagccagaaaatttgtcgcttgaccgtcaaactaccataaagtgccacaataacgatgaatcccaatagaagggccgtcgttattaaactggtgggcatcggtaatagccattgagctagaatcaaaatgacagctagcatcccattataaatgccttgattggctagtgctttttgcgcaggaacctgacgaacgaaggttatgggcatcccaaaagcccgcgcttgttgttctgggcgtccccacatttccagtgtcatgatgcccaaatgctcgatagcaatgagataaattaaaattgttaaaatttccaacatgataattgccttcctttgtaagactgagtatagttatagtataacttaataatgatgtgggtttccactcgttaacatttaaaaacattatcgactttaaactattttttagtttggcgtgtagaataattaggtgaggatatttgtcaggggagcttgggttatttctggggagaacagtaacctattataaactttaagaaaacgaatggaggaaattcccatgagactccttgacttaactggacaacaattcggcagactgacggttatccgtcgtgacggcactgctaaaaatggtaatgcgacttggttgtgtaaatgtaactgtggtaatttggtgactgtcgataactatcgactgcgccatgggattacggtgagttgtgggtgttatcgccgtgacattagtaaagaacggttgaccaaggacccccgaacgcgtgaacagattggcaatgcgatgaatttaccattagttaatgggagcaacgttgccgcattgactaaactcagctcgcgtaatatctcgggtgtgatcggtgttagttttgataaacgatcgggtaaatgggctgctcgtctattttatcatggacgctacatcttaaaccagacttttacagactttgatgaagcggtagaagcgcggcgtcgagctgaagaacaattaactcaaaatgatgacgttcaattaaaagcctctgctgaaggctaagtaggcacaatcaacagaataatagaagccaaaaaagggtcgccattgggcgatcttttttggtggagaataatgtttgacggtagctgagcagctcggtatgctgagactagagaaaagagaggaagagatcgaatggcttatcgggaagaagcagatactttagggacggtgaaggtgccagccgaagctctgtggggcgcccaaacggaacgtagtcgccacaatttcacaacgggccccacgatgccgatggcggtgattcgagcacttctacatttgaagcgggcagcagcaatcgctaatcgtgatttaggtagtttacgcgaagctaaagcacaactgattgttcaggcgattgatcagttgttggcattgccggatgagaaattacaggccgatttcccgttacgagtctatcaaaccggttcgggaacccaaacaaatatgaatgtgaatgaagtgattgcccatcaagccaccaacttagcacccaccagtggtattttgccgaatgatgatgttaatcaaagtcaaagctctaatgatacctttccaacggcgatggcggtgactgcctatgatgcgattcaccagctagtgccagtcgtacagaggttgattgatgaattggcccaaaagcaagcagattactggcgagtcgttaagattggccggactcatctgcaagatgccacgcccctcacatttggtcaagaagtgagcggctgggtaagtatgttgacgcatgatctgcagtatattcaatctttgatgccaacactattggagctaccaattggtggtacggcggtcggcacgggattgaatgcggctccgggatttgctgtagctgtagcgacacaattacaacaggcgtatggctacccatttacggctaagaccaataagttttttgggttagcggctcattcggggttaaccgttgttcacggagcggtgaaaacgttagccggtgatttgttgaaaatcgctaatgacgtgcgttttttggcgagtgggcctcgagccggttatggggaactgaatattccggccaatgagccggggtcgtcgatcatgccaggcaaggtgaaccccacgcaggcagaagccctcacgatggcggcgacacgagtcatgggaaacgatgtcacgattagtctggcggcgtcgcagggtaattttgaaatgaatgtttataaaccagtaattattgcaacctttttggaatcaacgacgttgttaactgggacaattcaaggctttacggaccgattggttcacggattaacggttaaccaagaccggatgagaaatctggttgatgaatccctaatgacggtaacggcgttgtcgccacacattgggtatcacgccagtgcgcaaattgcccagatggccgagcagcagaatttgacgttacgtgcagcggctttgcagtcaggagaagtgacggcggcacaatttgacaaatgggtcgatccattggcaatgactaatgttgaccgaccggattagatgagatttaaccttaagccagctcgagcagaagctggctttttcaatcagtcaaaaaaatgtgacctttctgaaagttattcgttgactatgtggggaggagaaaagtatggatttggagcagtatgcggtagtaaatagccataaaatgaaaatttgattaaaaagtcttgactattttatcatcaaataataatcttataggcaagcagtggtcttaaatagatgataactaagatgattggtaactaaaatgtccttaacggagctgagtctgtggggacattttttaatacaactagtcgttgaggtgtggaggatgattaaatgacaatgactttgaaacaggctgttgagcaggcattggtcgcagatcacgatcgattggcagcatatctaaaactagaaacggtgtcagcccaacaccgagaaattgacgagactgtcgattttctagagcaagcctttaagtctgttgggacaacggtcacggtttggcgagatgtcgccggtagtcatccgtttgtttttgccacgttaccggcgggacccacgggtaatgcggataagacattcttgttttacaaccattacgatgtacagccgccggaaccgttggacgagtggcaaacagcgccgtttgatttaaccgaagttgatggcaaatatgtcgcgcgtggcgtatctgatgataagggggaactgatggcccgcctctcagcagtcaaggccctgcaagcaacgtcgggtctgccgtgtaatttgaaatttattgtggaaggtgaagaagaaattggcagtcctcgcatcgctccgatggtccagcaacatgccgctgaattggcggctgacgtaattgtttgggaaacgagtggcaaggatgctgatgaaaattttgatattacttgcggtgtgaagggaatcatgagctttgagttgcgcgttaagacggcagagaaagatttgcattcatcattagccgcttatgcggataacgcggcttggcggttaacgcgagcactggcgtcgttgcgtggcccggataatcgagttctggttgcgggattttatgatgatgtgcgtgcgttgacggcggaagagcaacgggcaaccgcggctttacccttcaacgaaaccacgactcgagaaaatttcggtctcaaacggccattggtgacaactgacccggtagccgcgttggttaatgcaaccacgatgactattaatgggttgtcgagcgggtatgaaggcgaaggagttaagacggtactgccgaaacaggccacggctaaattggattgtcggttggttccaaaccaggaaccgaagaaattggctcagttaatccaagctcagttagtgcgaaatggatttgaagacgttgaggtagtttatctgttaggtgaaaagccattccggtcgaagttaacagatccatttgtacagttggctgtgaagacagcggctaagatctatggggatcgggtaaaactagtaccgaatgcagccggaacgggtccgcaagtcttctttggggaaacattacaggcaccaatcgtggcttttggaacaacctgggctgggtccggtcctcatgcacctaacgagaacatccgaattgctgattatcaacaagatgcctggtacaccgcagaagtgttgcgagattttgggatggaataagagcgtaaatgtagtgatattaataaaacgctgactccatacttagaggaatcagcgttttattaaggaatcaagaatgttaacaaatcagaaatgaataagattgatacagttctgatggtctgattgataggcacgaatttgtttgagtatcgttagcaataatgtttataattagataaacaagaacagaatggagtaggttagaaatggcatattcgatgaaggacatcgctaaggaggccaatgtttcgttaacagctgtgtcattagtattgaataataaagaaacacgggtttcagcagccaaaaaagcagaaatcaaaagaattgcaaaacgtatgaattatcggcctaactctgcggctgtttcgttaagcaaaaatattagttacaatatcgcattgattgtgccagacatcacaaatcccttttttgcgcgaattgtccgtgagattacaacctttctgaataaaaaaggatatggaacactgctgattgacagtgaaaattcttataaaaatgaaaaagcggcgctacaaaatttgatttctcgaggcgttgatggcattttgctagtcccctctaatgagattttttcgaaaaatgaagcagaagtaacagatcttttacaaaacatagcgaaaccgttggtgttgctcaatgcctacacggatcgagatgtcagttatgttaattttgataataccaaaggtgcagaaatggccacacaagagttaatcaaatatgggcatcaacaaattgggtttattcggggggaagataattttataaatgctcttgaacgctataaagggtatgagaaagtactcaaaagaaatggtattcctttaaataaaaaacttgtatttaaaggggactatagtatggcgagcggctatcgattggcgcctaaaattatggaaaatactgaattaacggctattgtgagttcaaatgatcttatgctctttggtgtaattaaatggactaaagaacaccaaatcccaatatttaaacgattatcaatgattggttttgataatacgccctacacggaaatcttggaagttccactaacaactattgatcaagatattgagaaaatggcaactgaagctagtgatctgttgttaagaatgattcagactaagaaaaaaattgtgaaaagaattattattgctcctattttgattcgtcgacaatctgtctgggagcgtcactgttaatatgttttcacgaatatttgaagaagtgtaaaaattttttcttgagagaatcggccaagtctaacttgacttttaaaaacggcatgataagattggttcaaaatgatagcgcttgcaagcgttatttatttttttgctttgataaagcgctttaccattcgatttaaaccatctttaatttgtgcgcacaattaaagaatcaacactaattaaaatatcaggagtgattgaaatgtctaaaattcttttagctggtgaatcatggatttctacaacgaccgaatataaaggctacgactcttttaccagtacaaaattggaaattggctgtacgaaactgttagctgatttacaacaattgggacatctagtgacgcacttgttagctcatgatgtccctgagcattttccttggaccaaaacagaactggatcaatatgatgtgattattttatcagatattggctcgaattcacttgtgttggctaaccaggtctttgccgaaggagaatctacggttaaccgaatggccttactgaagcaatgggtgctagatggcggtgctttaatgatggctggcggatatttatcttttggtggttttgaaggaaaagcgcattatcataatacgccagtcgaggaagtgcttccggtccaaatttcggcctttgatgaccgaattgaggcgcctcagggactggttccacaagaggctctaaaaaatgcaattagtagtggattaggtgagtttcctggtatcttagggtatcaacaagtagtggctaagtccgatagtgagattctaatgacaatcgaaaaggacccgttattagtgatcgggcaagctggaaaaggccgcacgctagcttatatgacagatattgctcctcactgggcgtctacagattttatgtcgtgggaatattatggtgagtttttttctcggtgtataaattggctcactcaggggaataagtaagttttttgaatcttgctaagtgcgaattgaaaaggaatggagaggtatccattatgaatgagttgaaagcaaaaagtacaactgaaaaaacggtgattgtcccattacttctaattgcaacgatttttgccggtatgttgtcacctatgcagtctgccgttaatggtcaggttggtcagcaattgggggatggaaatgcttccgctgttatctcttttggttcgggtctggtggtcatggcaattgttattttagcgcggaaatctactcgccaacaattcagttcaattccgaaaaaggtagcgtcccgatcattaccatggtggaactggttggctggttgctgtggtgccatggtagttttttcagaaggtgcttcagcttctgtgcttggtgttgcaacgtttcagacaactttgatttcgggaatggtgatttcgggattggtttgtgatcgattaggaattggggtcgcaattaaacaaccatttaatttcccacgagttttgggagcattattggcgattgtcgcaactgtacttgtggttttacctagttggcaggcgcctaaggttattgttttagctattttgccatttctagcgggcttgttagcagggtggcaacctgctggtaattcagcggtagctcaggagactgggtccatgctcgtttcaatcacttggaattttattgttggttttagtattctaggcttagccttattgatacggattggaatggggcaagttacagtaagccttcctgaaacctggtggatgtatttgggtgggccactcggtctcttgtcaattgcattgatggctttactagtccgcggtttaggattattgcttctggggcttgcgtctaccgcaggtcaactgattggttcggtgttgattgattggttgattccatcattgggcaatcaagtgtacctggttactattctaggcgcggtagttgcgttagctggtgctggtattgcaatggttccttcagcaaataaacacgttaagttagatgagctagaaggaaagagttaataggagggatattatgtgtacaggaattggtttggtcagccaacagggacatccgttttggggaagaacacaggactttgaacaacactttgaatacgctggtgtcaagattccacggggatatgaatttacggcagcgcttacaccatttattgccgagcagaatgttatgggaattgcatgggccaaggatttgcatcaatcaccggttctcttagatggtattaatgattatggtatctgtggtggatctttttatttcgatcattttttcaagtatgcagcgactgaaatgatccaatcaacaggaaaattagtcattcgaggtgaagagttatgtacgtggattttaacgcattatcgtagtctcgatgaaattaaacaacgattaggtaaagatgttgggattactaacgagggtggaccaatgatgggaatgtcggtcccacaacactgtatttttcatgatgaaacgggacgcgcgcttgtggttgaaccctctcaaaagaatgggtttagaatatttgaaaatccagtggatatttttaccaatgcaccaacttttgattggcatctgaataatttaaaaacttggctggagcggacgactaaacggacgtatacttacgacaatacagaaggaatagtccaaatcggatttgatgagacttctagtgggttggtaggtatcccagctgattacaaaccagaatctcgttttttacgagcagcatttgcaaaactattatctattgatgttgacgatgacagggcaatgaatcaggtcttccagctgttaacgacggtgaatacgccaaaaggggcgctgagaatcgatcagtctgagacaccagttgcttggacacaatacacggcgggatatgatattcagaaaaagattttgtatgcattcacttatgataatcggaatcttcgctcgcttgaatatggtgatccggctacttggggttcagaattacattattttagctttatttctaagcagacgactacgccatttgtagaaaagaatcagtggatggcgggagaaaataccgtttagagaaataataaaagcatgctctcgcagttgcgaaggcatgcttttatgagtttgaataaattaaaaatcacaaattagataagggttatttctaagcatttaacgagtcattaaaggtcttctcgaactaatggcatactcatgcaacgaggaccgccacggccccgtgacaattcacttgataagacatcaatcacttttagaccatgcttacgtaataattcattagaaacgtaattccggctgtaagtaactacaacgccgggggcaatggccaaagtattggagccgtcattccattgttcacggccagcaatgattggatcgccgttacccgttggaatcaaatccaaatcgtcaaggttcaaagcatccttcaagaccttcttcaaatctgtttggtgatcaaggtttaattgaccatctttacctggcgtaatcgtccaagtatcgatatgaccaccttcacctaagatacctgggtgaaccgtgaattgatcggtgttaatcatcgtgaagaccgtgtccaaatgcatcatggcatggttatgtggaatcttaatggcaataaccttgtcaaaatgactcttggcaaacaggttacgggcaatgtcttcaatcgcatcagcagaggtccgttgagaaaccccaattgccaagacatgatcggataagactaattcgtccccaccttcgattcgtgtatcatggtttcggtcacgccaaacattgagacccttgttagcaaatcgatgatgatacttgatgattgtttccataaagagtgattcacgttgccgagcggcgaaggtcatatggttgatactcaacccatcaccgattgaagcggcaggatctcgcgtaaagtataagttaggcattggatccataaagaatggataatcgtcttcttcagccgcactgaccaaatcagctgggacaaagtcgagctcattcttccgtacaccacccataatcttgttgaccatggcttgggtatccaatgataataagtattctttcaaagcgtcatgcgttacaccagcaacgtagccactttcagcaagcatttgttccaggaagtttaacttaacctcttcgccaccgtcatcgagggcttcggcagagagttgttccaaatacaagacttccgtaccgttttgccgtaaagtttcagcaaagttatcatgttcttgttgcgcaattggtaaatatggaatgtcatcaaacagcaggcgttccatcatatcaggcgtgaagttttccacttcaacgtttggccgcttgagcattaccgtctttaacttaccaatttcggacattacgtgaatcggacttgtcatgtttatttcctcccatcacttaactctgagtttatcataccgtctatgggatgaaagtgcgaaacaaatacactttttgctattgcgggggataggagtagagtcataggttacctgtatttggtaaaattatgattgttatgaatatagtgttctaattaaagccggttataccgttttgtcattagcactgacatagttattaccatattgctgaacggtgattctgagggtgtaccaatacgtagtagggagtttttgagtggtgtgttagtgttactggttttttcttccctgtgtggactggtacattggtcttgtggtgctctgtgtggagtagtgacgggtctgagagcaaaataaaaaggccaccatgctgcgggtagtctctttgattggtgctattttgccaagaataatgctgcattattcatagtgcccgcattagtgttaattgtccacgggtagccctgcttgccggcagaaataccagtaccgccattaatgtaaatgcctaacttgtaaccctgtttaatcaagttggaaattttagcttgtgtataaccatttttgataagaattgaattaacggttttagcaacagccgcattggtagtagttacaggaaagtccaaagtatttaaaatagtttcgctgtaagtactaccgtatgacgtttttaaatcatggctaagagcagtcaagttaataacatgcttataattagaggttgtcattgccttggttattggtttgttatcgacaaactgaccggctcctcggcgagatagatctacactgacctttgcgttagggaaatatttaaggacagcccgggataacttttgggacttatcagtatttaagtatttaatatagctactatctgatttgaacgtactaattctcttagaaatagcaggggtaacatagccgtgccatacatatcctgatactttattaccggtaaccttgtaatacacttttccgttacgtttgaacgatttttgagcgtaccatgaagtatattgatagtttttgatattgtacaattttttgtgaagattttattccagatataaccatttttcttagtattcgtgtagtagagtggtgcagcgtcgtctttgggtgctgaccaagcgtatttaccagtttttccgtattcccacggggatgtgttggatgttttcgcgcttgctgtagtcgtccccgcagcaagttccattcctgcaactactcctagcagcatgagagcagcggcgtatttgtgtgttaactttttcatgtagttacccaaatatatatgtggtacacaagtagtgtaacgctgctgaacgtaaattaacaaccatccgctgaataagaaagatggttgttacttatgttgcgcgatctcgccgtggccggttactgtttccataatagccacctacagcaaaacagttacctttttactttccatttgtgatgaccacgattaatgaactaggatattggcgactactagtaccatgccaactgtaacggcaattctcaaatagagctgttggcgttcaatctttttctttagaactttattacgcatcacagcccctccttagaataactgcaatagcagcaaaactagcatgagagttacaccaacgctagtagcaatttttgtgcgctttttgtagactactttctctttactcatataaacgcacttcctgccaccatgatacagctaggtgaggtaacatgtaacccctgaaaagtcacctacctgcaatcgtgaacgtgcgtttgaaatacgcctcagagtggggatgatagagcataactagttaggacatccccgcagcaggtagtataattgacctttgccgataacattaaaacttaatagtaatgcgtctctgtattacacacaagcaaagctctgcccgacggttcgggtgggacttttgcagtttctagggcaaaataaaaactgccagctatttcagctaacagtttcatcgccctgccgagcgtgtgcttcccaaagtggttgttattggttgttattttgtaacaatcagtcaaaacctctaaaaatcagaatgcctttatatcaaccttttgagcacttattgtagtccttaatcacacatatatggagccggcggggtttgagccgtgttatttggaaccccttataaaaaaggcgtttaaggctatttttaccatttctaaaaccaaagtgaatgccattttgaatgccattacccctaaatttgcatgaaacgggcaaatttatcactcgcttgtttctgctgttttttagaaacatgagcataaacattcatcacggtagtggcatcagcatcccctaataacccctgaacttctttgattgtggccccagattcaaacatcaaagaagtaaaagtatgacgaaacttgtggatagtgatttgaggaaactcatccggcttatcatcaatgattgtgtgtagccattttcccggagtgttaagtgacttatagccattaactcggttagcaaagattaattggtccggtgccatggtattgtaccccatcatcagatataaacgttgttgagcatgccgccagtgtttaaggtggcctagtgtaacctcatcaatggggatggtgcgcttaccagcacttgttttaggcggctgtataatctgcttgccaccgtgtccttgtgtaactgtcttactgatagtcatagtagcttgcctgaagttaatatcttgccaagtaagagccagacactcgccacgacgaatgccagtataagccaacacacgaaacaacgtatacttttcggctgactctaccggatcaatatagctaaagaaatgaaccatttgagctttcgtccaaaacttgttcttatcgcgttgccagcttatatctggtttaggaacggttactagtgtggctgggttgctatcgatgtagccaacctttaaggcgtattggaagacttgtcgcgtgtagtaataccaacgcttatagttacgcttaacttcctttgaccagccatttacagcagattgtaaagcgttgagggtgatcgttcgaatgcgtttgttaccaaaagctggtaaaatatgactatcgaacatccccgtgacccgtacggtggtactttcctgaacggtattggcataaacctcgtaccattcatgatagaccgtttcaaacagaatattattgtcttgctgcaagctaccagtgctggcttctagttctaacctagaggcggcaagggtagcttctttttttgtcttaaatccccggcgagaagtctttttaggcttgcccgtttgtgggttagtcccaacgtagagctggaagctgtaacgtgtgtcgccatgtttatcagtgtattttttaatgcttgccatggttttaactcctccataacccagcggtggtaggtatgtaggcgcaataaaattctaattttagaatggcaataatggaagaaaagtgttcacattccaatcgttaaagacatctttaccagcgtcttcattcagactattaataacggatgctcccaattgcgcttcaaatgatgattcaacaactgaatagaaaggttgtagtttaagcgttgtccaatagtcttgaaattcattgtctttagagtttatttcaatatcaatattattttcgtcattaaatgcgtactcttctactccatgataggtctttgactcctctagattagccgatagctctataatctttgcatcttctccacgtcttttaaatttcgcaaacacatcggctttatattccataacagagaaatcccattcaagattctcgctgactgaatgcgaggtagatactgctgttggcacaatatcaaaagttaaactatagggggtatataagaagaattcacccgggtcaatatttaaatattgacaaagcttatcaattgtttcaaattgaatcattttactatcttctcctgttaaacttgcaagcgttgaacgcgctatcccagtatcactagatactcgtgtagcctttagttttcttgtcgcaagtaaaacagaaagtctattagaaatcatcatatcacctccactaaactgtagcatatacactacattttttcaacataaataagaattagtttgacatgtatgattaattgatttatatttagcttataattttgaagcgttaccgctacaaaaaggagtgaattcattggaaaataaattatcagctattttaggtgcgcgtttactaagcatttccaaagtacatgatgacacaggaatttctagatcaacacttactaatttgtattatcgtcgaatcgacaatgttggattagacactttacggaagctatgtgattatttacaaattccattgtcagagttaatcgagtacacaccgaaagaacttgttaaggaggcctagcatgaatgatctagttttcttatcatcccagcaggtagatgccgaaccatttactacgggggatgtgattgcggagtatgcgggaattgcccgcaagtcagttaatgaattgattcgacggtataaagatgatctggaagactttggggtacttccatttgaaatggctaaacctattaaggggagtttgggaggccatccccggagagtctggtaccttaacaaaaatcaagctaatctgttgatcacttatctggataacactaaaccggtgcgccagtttaaaaaagctttggttagacagtttgatgctatgcaacgtgaattaattgagcgccgtgcccagtttgagcttggtaagcagttctcaaagagtttacacgccacgatagctgatagtcaggttaaaatgcacggtcacgaatacagcacgtttaatcgtttgatttataagcaggcactaggtgtagacagcacgaagctgcgcaaggcacgggacattcccaagggtgaagcaatcaccacgtacctaagcagtgatgaggctgaagccgtgagactagttaagaatcgagtagaagtattgcttgatgtggggatggactaccagcagattaaacaggcccttcaaattaagggggtggtgtacaaagtcacgttgcaattgccagttaaaaactaataagagggtgtggccagtggatcaatcaccattccgggtggtgttatcgccagagtatgacgagcaattaaagaagcaggtaatggcaacaattaagcaagcagtggaggaagcacgccgccaaacgggcatagatagtccgtggttgagttctaagcatgccatagctaaatggctaaaggtgactgacacaacggtgacggtacttattaagagcggcatgccagttcatgaaatgccagaggtcaataagaccatgggatacaagcgagaaattatggaatgggttttgagtcagtaacacataaaacaaaaaccagcggtggtagaccatttcgtatagattctaagcaatcccactttaggaggtgagcgtatgaacttagttagtttactgttagttggcttcatggctagttactttctaggcattgcaaccggcatagttggtctaaaacgtaagtaagaacggagaatagtcatgaataagagcatacaaaaagacacatcccctaactttggcgagtacaggatgtgccagaaagaaccaatttgtatgcttttttcattgcctattttacgcaaaatacaggaaagaggcaatgattttatggatgaaaaagaattattgaagcaatctgaaacgttagcaaaagcgtgggagtcaatgaaagttagtgttgacagtctaagtctgattatcgcacttgcgagggatgacaagggttgggggaactattattttgagagtcgtttagcggataacttggaagataacctattaaacatctctgaaaccatgtttgctgtgtcaaacgctatttgcccggaggaagactgatgaacaatcaatcattgaagttaactcatatattgcatgaggccacagtggctttaaatgggacgctagttcagttggattacttacaggaactggtcagcaaaacaaagctaacaggtaagcaacgtcaggccgttaatcagcagatacaccgtcttaaagttaacaacacggatgtaaagaactcgctaaccatcattcttaatattgatcacgctgaatagaggtggagcggtatggatagaagacaatatgcactggcattggctaaacaggaatttaagctgtttccgttagtggctaataccaagttaccgttgaaagatacggatggttataagtccgcgacaagcgatttagaagccatttcaggttggtttacggcagacccagccattaatattggtttgcgcttagacacggctaatttgctagtggtggatgttgaccggcacaacagcagccataacggggtaatcagtctggctaagcttaagcaagctggttatgaattgcctatgaacacctatagtgagcagacaccgggggatggcctccacttgttctttaaatttgagggccaacatccccgtaaacgggtgaattggcgaccgggtatcgatatattaacggactttttggtgattgcgcctagtgtcattgatggtaaaagctatcatcccttatctggggcaacgatagcccaagctaagccagtaccggactggctagttcatgatttaaccaactcaaagctgaatgtaacacgtcagaccgttaaagtaacccataagacgtgggctggtcgttggttagatgatctagtgcaggggacggctaccggaaaccgcaatgtgtttctaacctcactagttggcaagatactcaacacgggttgtcaaagtgaaacagcttatgagttattgcagtatgccaacgcccggttagagacgcctttaccagataaagaggttaaccggatattcctatcaattctgaaacggtgaggaggttaaagcatgaacgatgaaatactgcaattggctaagaagcgagatgagcagatagttaaagcggatgactggacgagtgatttacggcgaaccactaatggcggtattaagttaagttcattgcacaatatcattgtgtatctaaagaatgatcctaacctaaaaggcttgctagcgttcgacgagttttctgaacaaatttcaatactccgagataatccagcaacacgacagaaagcgggtatgtggaaagatgatgataactcaactacccgggtatatttggatgagcgatataacgtgctttttagtacggataacttgcaagacgcaattgtcgctgtggctaaagaacactcatctaatccagttaaagagcgcatagagcaagttgagtgggatggtcagccacgggctgaaacctatttcattgattatctaggtgctgaggacaatcactatacccgaatggtcacgcgtaaatggttatccggggcggttgccagagtttatcatcccggatgtaagtttgaaattatccccattcttgaaggcaatcagggactaggcaagagcacagttgctgggctactggctcctgactatattaacagttcgctagacacgatggggaagactaaagatgatctacaaaagcttaccggtagctgggtggttgaaattgctgaactatcagctatgaagaaaacagacgtagaggcattgaaaaactttactagtattttatcagactattaccgcaatagttacggtcactttgctacgtttcatccccgtaagaacgtgtttattgggacaactaaccaacgtgattatctaaaggacgctacgggtgaaagacgtttctaccctatccgttgtggtgtgaataaggctactaagaacccatggcaaccaactaaggatgacataccacaaatattagcagaggttaaaacgtgggtagacgctggcgaaaaactgtattttgaccagcaaacaatggctgaggccaaagcttatcagcaagaagcccagacggttaatcccatgaaagaagcgattgaggagtatctaagtatgcccgtccctagtaattgggatgagttaacgaccagtgttaagcatagttattttgatcattatacggacggaaataagccaaatgaggattcctcagaatggttaagtagcaagcttagtaaggagaccggtaagctgacccaaacaagcattagggaaattcttgctgtagtttttgggaaacagccagatagtttcctatcaggacgcatcagtggagaggctaaaaagataaaactaatcatggataatgaagatggctggcaataccagagaattagaagtcaaggtcatcaagttagaggctatataaatatcttatagatattaagtgtcacaagtggttaagtgtcactaaccttgatataacaggattttgcgagaatgagaagcgtcacataagtgtcactagctgtcacttgataaaaagatatgtgacgcttaatgacagtaaaatgacacttaaaaatcgctataaacgttgatttaataatatttgtgacgctgtgacgcctgtgacacttaattaagttgagaaagaaaaaagtagaaaaggggttctgaaatgaaacaactatcaatgattgaacaaagcgttttgaatgcactaccacacgggtcagaaaacccaattagcaccacggatgtatgcaagctaactgacctaaaaatgcgtgtcgtcagagaaatcatcagcgtgttggtgaaccgctatggtgtacctatcgtggctttgcggtccggtgagtatagagggatgtttattgcgacaaacgaggctgagcgcaacctaggtattgccagctatgaaacccagattaatagcatgggaatccggttaaaggccatccaagaagccgacttagataattggcaaagccagttgaagtttaaagtggtctcagcaaatgagctaagtcatcagcagaaagcagagtgatcagatatgaaaattaagtatcctaagttagtagaagacgcgttcacggtagctaagcaacatggcaaaatcgcaccgggtaaagagaacgatgttaaggcccggatatatcaagttatggttgatagggggatgttgagtgagttaggtgagccaacccaattggctgtggataaaggcatagcagacggattagggccaaacacgcagtctgattcattagtggagtttaaacgacaattccccatatatggagaatttgacgacagccattttaagcgacttaatggcgagtggatggcagacacttacgttataaaggccatttgtcaggcaacgatagcagatcccaccagtgagccagaacaacggctgcaggctgaggaaatgctacagcagatagaagatagcaaaggttaatcagagggtcatacgtgagagcgtatggcctttttggtatgcggaaaagcttcatttgtgtttcttgtagtaatggtcacggaaaattatatagaacatatataataaaatgataaaagtaggtattatcgctatccatttagaaaattcaaataattgttgggctagtgtcaaagcgaaaatgcaaagataaagtttagttatggttgtcatatttttaactcctaggaaaatactgtgttgtgaatgcgaaattagtcttatacgaatagcaaggaaaactaaagataccccccgccctatcaatatacaggtagagcacacacattgccatgcgtttatgagatagaccaaatttgaaacttttagggtagggggggcatatataactaggccctgctattgaggtatctttggacgttccgatcactcgtttagtatccgttttagaaagtcaatgcagcttaaattatgctgttaagacggttagatgagggttacattaataaattgccgttggtagcaagaagtgcccaacaatcagactacttgaaaaaaatgtgtccaattttggacataatcccaagaaacctcaaaacggagtacagcaaaacctgtcaaaaccttacctcaaaacctgaaaaaaactgaactgcatttagactagtattcattgttgcttagttgacaaaacttgacattatatcaactcgcggctcaattttcagccgcgaaaacaattctaatctgtccttttatcaggttagatcaacgcaaaaaaatagtgtagcggataattccgctccagtggttctggtcgtatagcatactcactcggccggactttcggcttagctattttatacgtaacttttgatataatccggcaccatgcttaatcactaatgaaaatggttttaatgcctatcaagaaaacataagattttcgatgatttagggtaaaggacacaacgtggattcattgtggaaaacgcttgtcatccctgactttcggcatgttatatttaccgacaatgtacacaaagtaggtgcaccccttttcaaagatacacataaaaaatggtgcacccactcgccctagttttggggttggctccccaaaattgggggccgaaaattaggccacgaaaataacctgtcacgtcatcttaacgggtcagctaatgcaccaagttagtgcgttggggtcgtaacttgcgaccgcagatagcacagcggaaaactctgcttagtaactcggctgaaagttcgcgcagatatactacctaagtttaacttagtcaccaatttatagccaacgcactttgatagtctcactagatggagtttagagcaaccttcgcttgaatagaattgttttaaaaatactggaaaatactggaaatcaaacattagtttgaaattgtcattagggagaataatgcaaaaaacaggtctaagaactataccagtgttggaactaagaaattgttagaaaatgttggaatccaaacttctgaaaaagcggtagatgaaattgggtatgaacatcattactgcacagaaaaagcaagccaatcccctaagacgaatagggtcttgtactacttttatttgaataaaattattttaaaaatggtggaaaatggtggaaataaaaactgctagccagaaagctaacagttagtagactattagtgtatatttacaaacttagccctctttgatacgtttattaatctcgttaatctggtgacgagatatggcgacatttacaagccacataatgatatatattaagataaacgtaatcgtgaaagatattagataataaatattgagtggaaaccatcctgctagaattgctaacggtgtaaaacctaaataatagataaaaaagttgattattgttctttttagaagtgaccagttttcaacttcaaaaatgatagctcccaagctgaataataatcctatggtagcccatagaataattgaaacgagtacagcatttaggggatttgtgaagtgttctgagaattgaggagatgatgggtagtagtggcttgacccatataagtaattgaaaactagagatatgaataagcccagaacaatgccagtttgcataccgtaaatagaatttttgattgtttttttcatattcctaatttctcctttaaattttttatctttcgacgtgatatttgaacgcgttctttatttgtcataatcacatcgattttaccgttgtctaacagctcaagatgatcaattcttttgtagttgataatggttcctcgtgcggattcaataaattgtgatggtaattgctcaataagttgtgtaattcgagctttgcaatagtaaacactgtcagccgtcctaacttcaatttgattgccaaccgtttgtaaaacaaggatgtttttgtaatcaattggctcaatctctttatcgtgatagcaccataatatttcttgttcctgattcaactgagaagttacattggatatgcgatcggtcattttacgtaaccaaaagtcagcgtgttcatcttttaaattggggtcgatgtgaaagttgattttcatttagtagagcctccttatgtattgatactactacgccaatttacttgaatatggtaaatagagattaatggtcattttttgtgatcaagtggtcacggatgatggctcaatggttgctatgaaaaataaacgaaataaaaaactgctagcttgaaaaagctaacagttcaatccctaccaccgctatttacttttgaacctaaagtgaatgccattttagaaactgaatgccaaattgaatgccattgaatgacgttttatgggctcctatgaaaaactaaaaaaataaaaacgttgatttattaggcttatgggcgcctatgaagccctacgaaaaaccatatatggagccggcggggatcgaacccgcgtcctagcatattgccaccccaacgtctacactcatattcagactacttaaggtttcactgcccaacttgccgcctgtcagggcccacatgaacagctaacctgatttttctcttctaacgtacttcaggtgggagtcgttagcgtaagtccgttaaatttaggacccagatctagaccacggacaagcctaggaggatctacgttaagcgcctattaagcagctaaagcgtaagaattgttattattttttgcagttataattaaactggaccttttaacgtagatgccgctacggagtgcagttggggcgcaacctataccagtcgaatccagaacggccccgtgacaattactttactagtttagcatattccacgacgtctgcaaaatatttcgcccataacgcttaatttaaggaaaaatcttgactttcagtatagtataataggtaactaagtcagcaacaccactgggctaatttatggcagacaaaaagttacagaatcttcatagttctatcatcgtcatttctgataaacctggtagtttcagggtactatggctaacgaactttttgctaatgcccggggtgtgcaacctttggaggtagcaatgaagttattaatgattgaagacaaccattccgtatcacaaatgatgtcgatgttttttaaaaaagagcaatgggacgccgaatttgcctacgatggtaacgaagcagtggagatgttttcagctaaccccaacatttgggatatggtaacgctggatttgaacttgcctggtatggatggcatgcaggtcagtgctgaaattcgtaaactttcgccgaccgttccaattattatgctaacggcccgggactccgaaagtgatcaagtattgggactggaaatgggggctgatgattatgtcaccaagccatttagtccgattaccttgattgcgcggatcaaggccttgcatcgccgggctgaattggggcccaccgctaagccgaccgaagctgaaccattgaacgagactgaggcctttgatgttgtcacggagaactttaagttaaataccaagacgcgagaggcctacttgaatggtcatcagattcaggatctcacgcctaaggaatttgatctactaaaaaccctggcccaaaagccacgacaggtattctcacgtgaacaattgctacagttagtttgggattatgagtactatggcgatgagcggacggttgatgcccatattaaaaagttacggcagaagattgaaaaggttggcccacagatcattcagaccgtgtggggcgttggttataaatttgatgatagtggagcagatcagcaatgaaactcatgtaccagcaaatgctaggtttctttgcggcgattacgatcattttggtgctaatgggggtatcctattcacaaatgacccgtcacatggtatatagcaacacgtggaattcgctagaaaaatattcaaacagcttgattgagcaatcgctgcggatcagttcgcaaagcccaaagacggttaactttgatacgacggccttagagaatagtgaacaactgttacaaaatcaggcgatcagtaccacgatttacagttcgtcaaatcgcattgtgtttccggctaatatctatcagcaagcgatcaatcagaccgactggaaaaaattgaaaaataatcagattattcataaagtcgttgaccgccgggttcgcaacaagaatgggcgtgttagtccggcagtgactgaagtgatgaagccttatttctacaatcataaactagttgctgtagtggttatgggggctttcgtttcagacattaatactaacgttaaccagattaaccgtaatttgattcgctcactcctagtttcctgtttagttgcgatcgttgcgagctacattttagcgcgatactatacgtcgcggattaatcgattgcgaaaggcgactaaccaagtggccaaagggaactatgatgttcaaatggctagtcgtaatcgagatgaaattgatgatttgatcaatgattttaatgggatgacccactctttgaaagcatcacaagaagagatacagcgtcaagaggaacggcggcgtgagttcatggccaatgcgtcacacgaaatgcgaacccctctgacaacaatcaacgggttgctggaggggttggcgtatgacgccattcccgaggaaagcaaagaagaaagcattgagttaatgcgtagtgaaacaagtcgtctgattcgtctagttaatgagaacttggattatgaaaaaattcggtctaatcagattacgttgaacttacatgaatttaatgcagttgatgcgttgcataacattgtggaacagctgaaacaaaaggcggatgactccggcaatgttctggaattgcaggctcccaaagaaattgaggtttacgcggactatgaccgctttgttcaggtcatgtttaatatcacgcaaaatgctattcagtttacgcagaatggcacgattaccttgtcggcgcaacgtggatatgaagaaacaattgttaaggttgctgatacggggatgggcatgtctgacgaacaattgaaaaatatttgggaacggtactataaggcggacccatcacgcaagaataccaagtatggtgaatccggcttgggcttgtcgattgtccaccaattagtccaacttcatcatgggaaaattagtgtgacgagtaaagagggtgtggggacaacctttacggttattttcccagatcagcatcagacccattcacaacgtgcgaaaactaatgaatagcgttagggcctagcgtccaaccgtgatacaatgagaggaaccattaaggaggaaacttttgaaacgagtacaaattaccgggaagtcggtccgtaagtttgaggacggctatcctatcgtatctttaactgacttagaagatcgtcaagattttgaagacggcgcttgggtccaactagaaaatcacggccattttgtggcgaccgcctactttgccaaacaacatcgggggatcgggtatgtattgagcctgcgagaaaacgaagcgattgatgaacgtttctttgccagcaaattccgagcggctgtagccaagcggtcggcctttaccgatgtatccgcctaccggttgtttaacggtagtggtgataatctcgggggactagtggtcgatgtgtacaatggtcaatttgtctttcggtggcaaaatcaagccctgaaacggcaggctaaattaatttatgctgggtttgaacgcgttttaggtaaagggcaaaccattttagcggctacctccgggcaagagaagatgcaactggttagtgggcaattccctaaatcggtgacgtctgtgctagaaaatggcgtaacctatccggtcgacctaactattagccgccagcaacttgctctggaatttcgggaggttcgtgattgggttaagcagactagtcagcaaaagcggcttctgaatttattcagtgcggaaactggggtcgtaactgctgccatgttaggtggtgccgttgaagccattacggttgatccgactaatcgggcaaccaccacgattcaggctcagttagcggctaacaatcttgatcaagcagcagttgaaatgcggacgatggatgtgcctaattacttggactatgccatcaagcatggtctcacatttgatacgattacaatcaatccacccgcttttattcgaggcaaaaaacgtgcctttacactagaacaggatttacccgctttagtggcacaagctttgcaagtggctcaaagtggtagtcagattttggtgactacgacgacaccgacctattctatgaagcgattaaagcaggctgtgagtgacgccacgcaaaattataccggtcatgtaactgcttccacagaatttcatgcaccagccgattttttgcagaacgatgctgaccgtcatagtgaagcacttcggggattgctgttaatcgtcgaataatgaaagcacgtgaaaattgctaaaaaaggccgttttgagtggttagaccactcgcctaacggcctttttttgagcaataatggtttacatttagaatagaaacctttaaactaactattgcaaattaaaaagcgcttacagagaagattgacataaatgaaacgagaattgaggcttacaaaatgtatattcttttagctttgatccccaccgtttgttggggaagtattggattaatcagtggacgtttgggcggaacttcttaccagcaaaccctgggtatgacggcaggggccgttttattcgggttgttttccctagtctattttcacgaaccgattacccgaatgtcgatgttagtcggtgttgcttctgggttatgctgggcagttggtcagtttgaacaattccaatcgatgaagtttattgggatttcacggaccgtaccgatttcaactggtttacaattagtcggtaccgccttggctggcgtgttgctctttcatgaatggaagacgactaagatggtgacgatgggcacaatcgctgtgattgtcttaattgctggcgcagcgatgacatctttacgcgacaagcgtgccgctgctgggaccagtgaaccggtggaagctggtcgagggacgattgccattattatttcaacaattggctacgtgctctacacggtaattgttaccggatctggcttagattctaagacagttttgttcccacaatctttgggtatgattctgggtgcgattattttcgtgctattctctcggcaacaggtttggcataaagcaacggcaaagaatatcatgactgggctagtttgggggattgggaacttctttatgttcatggcaattcctaaggtcggactggccattagctactcattagcacaatgtgggattgttatttcaactttcggaagcatttggttattgggtgaaaagaaaacaaaacgtgaaatggtctacatcactattggctcaattctagtggtcattggtggggtgactcttggtgtcatgaaagggtaataaaaaggctgataacgtgggttatcagcctttttatattttgaaaaaatgtggactagaccatttactttttgagtaaatgcgttataatggactagtcaataataataaaagtgaggttatctaaatatggcacatatcgcctttgatcgttccaaactgacaccgtttattcatgacaatgaactgggagaaatgcaagcaatggttaatgccgctgatgcacaattgcgtcaaggcactggcgccggaagtgacttccgtgactggctgactttaccaaaagattatgataaagccgaatttgcccgcattaaggcagctgctaagaagattcgctcggattccgaagtctttatcgtcattggtatcgggggatcttatctgggtgctaagatggccgtggactttttgcacgataccttctttaacacgctaccagccgaaaagcggcaaggtccgcaagtcttctttgctgggaattcaatcagcccagactatctgcatgacttgattaacctaattggtgaccgcgacttctctgttaatgttatttcgaagtctgggaccacgacggaaccttcaattgctttccgcattttcaaggacatgcttattaagaagtatggtgaagaaggcgccaagagccgaatctatgcaactacggataagcaacgtggggccttgaagacggaagctgatgctgcgggttacgagacattcgttattcctgatggcgtcggtggtcgttattccgtattgacggcggttggtttattgccaattgctgcatccggagcagatatcgaccaattgatgcaaggggcagctgatgcccaagaaacttacacagaccctgatctgaccaagaacgaagcttatcaatatgccgctacgcgtaatattttgtatcgtaaaggctacacgactgagctattggaaaactatgaaccacggttacaatactttgctgaatggtggaagcaactgaccggtgaatctgaaggtaaagatcaaaaagggatttacccatcttctgctaacttcagtacggatttgcactccttaggccaatatatccaagaaggtttacgtaacttgatggaaacggtcgttgtggttgataagccgcaaaatgacgttactgtgccaagtgctgaagatgacctggatgggttgaagtatttggaaggcaagccgatgagctttgttaaccagaaggcatacgaaggcgttgtgctggcgcatacagatggcggtgtaccgaatatgagtgtgcacattccagatcaaacaccatataccttgggctatttgatttacttctttgaagtagccgttgcagtttctggttacttaaatgggattaacccattcaaccaacccggtgtggaagcttacaagacaaatatgtttgccttgttgggcaaaccaggatttgaagacttgggcaaagaattaaacgcacgactttaattttagaagaatccttaagaaaaaatggttcaaggcatttgccttgggccatttttgttgggataactaatggactgactaagcagaaagctacggtcggttagttgaacatgctaaaatgtatccgtgatatgattttttgacgacattcaggtaacgggaattaaaatttggattacagtttggctagttgacttgtatgataaaacaataacttttatcatagttaatggcgtcctcaggggaaggggacaactaatgttacatatgattaaggggagaagattttgaaagcaacgaaacggcaatatgcctactacacggggatgtttatgatcttagtagtggcactttatggtatttttttgttaacggggaagtcctttatctgggaaggagacggtttagcgcaacactacccaatcttagaaaagttttatacgtggcttcaccaaggaagcttaaccggttggtcgtgggatctagggctgggtgctgataagctgacgacattttcttattatgttttgggcgatcccttcagttatttgattgctttttttccgaaaggacgcttggaattaggctataatttgttaattttgctaagactttacgcgagtggattagcctttctattctttgcacggcagcggtcattcaagcccgcgagtcaattggtaggaacgttagcctatacgtttaccggatatagcttatacgttagtatccggcatccgttctttctgctaccaatgattctgtttccacttttagcttatggaatcgaccatgttttaagtggaaaatcatggataccattggctatttttacaggcttagctttgattagtaatttttactttgcgtatattctagcgctaggaagtttagtttatgctgttttacggtacttagccattagacaaacagtgtccctgcctcactggcgcgtactgtggcaattggttggggctggcttgacgggtttcttactagcgggcgtcttatttatcccctcgcttttaggtgttctcagctcgacacgggcgaccgctaactttgcgaatgggtactggttatatcccttgaattattatttacggtttcccaatgcgattattacgacggggaatccgctacagttttgggtgaatttaggcctgagcggactcacctttttggccttggtgtttgttttgcgccatttccgccggtacctgtggttgaatatcagtctgattttgttgatggttggggtgctattgccggccgttgcggccgtaatgaatggcggaacaacgccatcgcaacgttggctcttgttgggatgtttagcctttagtttggccgtgatgaccttcgtcgatgagttgccacaacttactcgcggtgatatcgcaacgcttatttggagcgttttaggcctattaatcattgtctgggctgctaacggctttatctataataaccatcgacatgattttacgatgtatggtctgcttttattaacgctgggagttgtgattgttgggcccctttaccagtggaccccacgtttatggcaaatggctctgctcagtttattaggcttaaacattgtagctaatggttatggctatttcagtcctaattctggtggggcaagtcagcagctattggcacgcagcgtcgcaacgaaatttcaaaagaattattacgatggcgctcagcgattcgttaaggcacagggtggctttcatcgttcagcaatcagtcgatactattattacgcaactgatgcgaaaaccaatatggggatgaacttgggaacgcatgatattatgagctacttctcgattcaaaatggcgctattggtgattttagtcaggcaatggataactctcagttcaagatgaataaacccatcaatcaagctgatgggcggaccacgttaaataacctgttgggtgtgcgaaccatttttgctcgtagcaatcagttgggcattcaagcctttccagacggctatcgaccagttaaacgccaaggtaagcgcgtcacattccgcgatcagccggtgcatgatcttggcaataattacaataccgttttgcttcagtctaaatacgctctcccattggcctatttgcaaacgcaccaattaaatgcagctcagttttggcaattaaatggtgttgaacgtgagcaggcattaaccactggggcactggttgcgggtggcgcccacggggtacccacgcgaacgtatcataagcagggccgcccaatcgcttatcgtgtcgttcaggacgatacgactgtgttagatagtttgaagaaagtggtcacgtaccggcaacagggtaaccaaaatgatgctcagttggctcaggtcacaaagtcttcattgcggaagaaaaataaggaccggtctgttaatattcggacaggtcaagcccgcctaaagcaattgacccggcagaatcgacaaatcttacggcagaatgctaaaaagaatcaacatggtttacggcaaatgaccagtgataatcagaataatcccgtaacgtatcgcttgaaagtggatcgaccgcaacgaaccgcgcatacggaactgtatctggagttggatggcattcaggcacagcgcctgagtgtggctgataattatcacggggccaagacgaccagcgcgttcagcaatactgcctatacgggtattcagcgattgaacgttcttcgaaacgccttgtggcgaatgagcgatggtgcctactcaatgacagttagctcgttccacaatgtggctagctttaatcagttgggacaaactaatttatcagactatcaggtgaaacatcgagtactgcttaatctaggctactcagccaagccgcgccggacgattaagctgactcttaagggtggtgtgaagcgcctgaactttaagtcagtgaagttagtagccgtaccgtttggcaaagggtatcagcaacggttgatgcaattgaaacgtcaaggactacgacagctgacggtgcgtgataaccgggtgactggaaccacacaagcatcgcaagctagtgtgctaacgacatcaattccttattcatctggctggcggttgacagttgatggtcaagcgcaggcaaccaaacgggttaacgttggttttattggggcacgtcttgctccaggaaatcatcggattgttttaacttatcacacgccaggactacgaattgggctattcctgagcggagtcgggttgttgattttgttggtagttggtggcagcacctggtggtatcgtcgtaaataaaatgagtcagtaggtggtggacacaggtttaaagtgcccgccatttttttagcatatagcgtggtgctccttcaattggcaggttgatctgattaacacctaatttaataccggtgtatgaacttgattgctgaattccattgtgctaacattaacgatgtgccataaatagggagcacgtttacattttttatctccttcagggtgctgttcaatcatttgacagcaccttttcctaaaataatgaggttttgaaaatagtttgtgctataatgaacttatttggttcccactaaaacttatttatcagttacacaaaaaaactctagccaatttatgactagagtttttttgcgaggtgacggttagtttaagatggcgacaccaatggttaaataagaagcaaaaacaatccaaatcagataggggaccagcaataatgaagctaatttagaagttttataaaactgtccaatacagagtaagactagtaggtctaagacaatgatgacaaggaacccgatccagtaggcattgtagttgaaaaatagaatgctccatgcaaaattgataaataattgaagtaaaaagagggtgtagttggtcgcgcgattagctttagtggtatgcagaaagatcaaatagccagagaaaccaattaaggcgtagagaatcggccaaacaatcccaaataaataatccggtggtgacaagacaggcagtgttaatgaattgtagtgttgttggatattgccagcgaagagtgccgacaagctaccaatcccttcaacgacgatgataaataccagcaaatagagccaattgaattttcggtaatgaagattcaccggccatccctccttaagttgatttagacacagtttaacatataggtgaggggtgtttgaacttaaaggcattaatgagaatgggagttatttacttaacaggaagtatcatttggcaatgctgattaaggtttaccatcattttctaggtatgtggataaagtacggttcagcgcgaatcatttaggaaatacaaaaaaggtgataaaacgttattaaaaccacgttctatcacctttcagcatatcagtatcacccgcacggggctcgaacccgtaactccgccttgagagggcgacgtcttaaaccagtttgaccagcgggcaatgtcatttactagcagtatctaatttacgctatccaacgaagaatgtcaattgttctttgcataaaattacacacaagtgggaattcatacaaaatactggttttttcaggaaaactggttgacacctaaagcggaacaagttactattaaatagttgtttcaagcatcacagcttattgggtattcgccaaattggtaaggcagcggactctgaatccgtaatttactggttcgagcccagtatacccaattcctacttatcagccgttgtcatagggtgtcaaaacccttatgacagcggctttttctatgcctaggtgtttcattgattgtcattcattatcaataaaagttagccaaatggtaagccaagtaagccacgtttattcttgctgtgatagtcttttgaagagtgggtcgcgtaaaaaagtaagctagaaaatgactaattcgtttttaccctgtacctgaaacttttcgttttaacgtggtacacgtggtacacccggacaatcgttgatataacaacgtttaaaagtgtcctaacgtggttcattacccggtgcaacgtggtacactagaaattaaggtaacttgctagtttttgggtggcttcgttcttttgttttgcagtgactgccgtgtaaatatctaaagtcgttcgatagcttgaatgtcctagctgatcctgaaccgatttaaccgaagcaccagcttcaaatgccaaggtggcataggtatgccgaaatgcgtggacggttacgtgttttagatcatatttcgtcagggtatgttcaagccattttcgcggcttagatggctgaaacatctcattattttcattggcaaaaacataattgttgctatgatttacgttaaaaccaaaacggataagatatttcttctgttccaattgccaccgttgcaaaatttgcactgttttagggtctatgaagacagttcgattacttctggcagtcttgggtgtctgcaccagtaaacgagccatatcgcctcgagactgtgttttattgacgcttatggtgtgatgaacaaaatcaatatctgaccattccaaacacaacatttctgactttcgcataccgctaaatgctgccaaacggaagaacacactagcttgtggcgtattgtcgtcatcattcagacactcaaagaagtgttgcaattctgacttatcaaaataattctctaagtttttgcgcgaacgatcattcttattcaccggaacaataacccgttttgcagggttctcactgattaagtcaatattgatggcataatcgagaaccttagcaacgtagttcataagcgtatgatacttggctaatccctcgttaaaccattggttgattgctttctgacaatctttaatggttatttgagctatgcggtactcgccaaatacgggcaaaatgtgtaggcgaaacattcgtttggtagttgcccaagtgctttctttaacggtatgctggtattgtgtaaaccagagttgatagatgtcactaaaaatagaattatcattctttgcgggaagtccatggttgtaaacatcaagctcaagtcttgatagtacaatctgggcttctttttttgtcttgaatccacgacgacgggtagtttttttcttaccagttagtggatcagtgcctaaatatatttgaaattgataacgggtattcccgtccttgtcctgatacttcttgattgctgccatatataatttcctccataacgtaccgtgcgggggcagtgttatgtaagaaaacaattattaaaagtatatgtgcaaaaaatgggactcgctggtgtttgaataattaaaagagaaagtaccttgtgttgaaaattcagaattaataaacgcgttgaagtcgcaaaatatatcattatttttatcaaaagagctcatttcgtaatgacagttaataatcaattcatttaatatgcttctcaaagttcgctgttgatttcccaaaatcaaaccgccgattgctaaatttggatctttttccactgatattattattttgttcagattttggttttttatattctgaaaaaaatctattttaaacgtggaattggtaatcagatcaaaattgattggaacaatataggaaaagactatgctgcttatctcgttacgaaccttctttttttcagaagttgggggaagaatggaatagttagtaacggcaggcgctaataaagtggagacaggacactctatagaattagcgattagttttagtgtggaaagtctggtattatcaggaatttcatcgttttttatgagcctggcaattgtagctttagataattgtgtatcattttgcaaatccgtaaatgacatatgaagttcaagcatgcgtgaccttatggggttcaatttgaatgccttctttcagttttttataagaaacctatctgaataaatggtatcacatacttgacttcaaatgaacaactatgtatcataagttcagttaaagaaaccaaatatagttcttggtttctttaataaaaccgtaggaggtggcaaagatgaataacgaaaaaaatcagtggctaacttatcatcaagtaatggaagaactaaatattggcagcatgaatacagtctacaagatgattaatgacggattaaaggtaactagcattggtagactaaagcgtattgaacgtaaagagctggataagtatttagcttcaaaaacaatttaaattgcaccgtgcgggggcagaataaacttaaggaggtgatcctatgaacttagtcagtttactgttggtcggtttccttgccagttattttcttggcattgctacggcgttagttggaatgaagaaagcataaagatacgaggcaagaaaaatgggaaaacatacaaaaaaagacctacttagctttggtcggcagtaggtcaggcagattgcaatgtatgtttccccttaattctaacacgaaaacacgttttggataaaggagaaatttaaatgcgagaaattaaagatattgatgaactgacagaagaagcaggagacatttgcaatgccttacgtggtctaaagaaatatattgattttatcctgtgtgaagcgtcaaaagatgattctggagaggttagtggcttggtcgcaacgatcgtttgtcttgctaacgctcactatacggatatggataatttcaatgtttttggtggtgaagagcaatgaaagaatctgctgcgctatatacggcaattgaattggctgaaagcgggtatgatatttatcccttatcagctaacactaagacaccacctaagggccaccacggatatttagaagccactaaagaccagaacactattgtggactggtttcaaagtaacccggattacaacctaggcttgcggttagacacgtcccatttattggtggttgatgttgatattcacgattctactaagaatggaaaagatagtctgatgaagttacagcgtcaaggcaagacactttcaccagatacgtacattgaaaagacagccggcggtggtctccactatttctttaagtataccggagacaaggtgcgcaaggtcgataattggcccggtattgatctgctaactgactttactgtcattgcaccaagtgagattggtggcatggcttatgcacccttatctggtcgaacactggctgatattaagccggcacctaattggctagttgatgaattaagcaccaatggtttgaacggtgcgccagaacacgcctatacaacgcggttaaagaaatatacggggcgtttgcttgatgagatggtgcaaggggtcagtacaggtgatagaaatgtttggcttactaaaatggcaggtcgaatgtttagtgtaggtgctgatccgaaaactgtttataacatgttatcggtgataaatgattcttttgtagacccgtcgctatccagcaaagagataaatgttattttccagtctattttaaaacgagagagtaagggggtacgttaatgggaaaagcaatggatttaccagcagaggttcaggaaacagccaacaatgttataagaatgcaacgtgatgctgattggcagaatgattttaaaaagaattcagacgatgttatcaaaactaagtccctatataatatccgtttaattatggagcatgacgaaatgttaaaaggactagttgtctttgacgagttctcggagcaaataattaagaatccacaaactgataactctttgttcaaaaaaggcttctggaatgacagtgatgacacattattaagaagctatcttgaagatcattacaacctattatttagcaaagagaacatcacggacgccgtggtgaccgaatctcatcgaaagaaaattaatcccgttaaagaccgtattgaaaaagttgtttgggacggaaagccacgtgctgaacgttacttcattgattacttgggtgccgaagacaaccactatacgcgatctattactaaaacgtggttgacgggtctcattgcaagagtatatgtacctggagttaaatttgaaattgttcctattcttgagggaagtcagggattaggcaaaagtacagccagtcgtaacctatacccggataagtttaatgacacgctaaaaggaatggggaagcaaaaagacgattaccagcaattgcaaggcagttgggtggttgaggttgctgaactttccgcgatgaagaaaacggatattgagggaattaaaaatttcatcagtgctcaagctgacacttatcggaacagttatggtcgctatgctttaccgcaccctcgtaaatgtgtatttattgggacaaccaatcaatccgattacttgaaagatgccactggtgagcggcgtttttacccaattaaatgtggtgttaataaggccaagttagatgtatggcacccggacgagaactttattcttcaagttttggcagaaggtaagtattggtttgataatggcgaacttttgtatctggataaggcgactatgaaagaagctaaagcctaccaaatggaggctgaaagtgttgatcctatgaaagatgctgttgaagaatttctatccatgaaagtacctgtcgattgggaaaacatgagtaccagcttgaagcaaagttatgttaatgactacggtcatcaatctaaatggttgcttaatcagatcagcaaagaacggaaactactgaatcaaacaacaactcgcgaaattatggaagttgttttccataaaacagttgatcgttatttaactggtcgaacaaactcagaagcaaagcgaattaaattgttaatggataatatggacggttggaaagcacaacgaattagaatgaatggaaagtttccacatggctatgttcgcgtacaatgatcgaaaatgctaagtgtaccacgttgcaccgggtaatgaaccacgttagggcacttttaaacgttgttatatcaacgattgtccgggtgtaccacgtgtaccacgttaaaacgaaaagtttcaggtacaggagggaaaggaaaaaaatgaaagtaatttatccaagtttggttgaacaatcttttgatctttatgtcaaacgatatggaacggttccttcaaacaaagtaaacaagttgaaatcacatatttatagtgtcttggtgcgagatggtgttttgaagcaaaatggtgagccaactcaaaaagcaaaagatgatggactggttgaaagcttcacgccgaatgaacagggggagtatgagccagaatctgtaagagatttaaaacttatgtatccaatgtatgcgcaattcagtgacaatcacttcatgaaatcgggccaagggtggttagctgacgcttatgttattcgaagtgtggcaaatcaaatattgaatgattctagtagtgatgaagaacaacggcagagtgcgtaccaaatgttggcacaattagacaaatagttttaaggagagaaatagttatgaaaatcagattaattgatgttgatgggaaaattgatcaagctgacttgttcgttttacgggagccaaaggagggcgagcacttgtattcacgtaatggtcgagatattttgattgtggatatttaccaatttgttagaaacacgaaagaaaatcaacgtgaagagcctgactttgtggcaatggttgaatatcaagaaaacggaaatccagttttaacagattcatacagtgaggcagaacgaaaagtggttgattggcttagtctaggtgatgacgatgaagacctatgatgtatcgtgtatgaagcaccgctgccaattcggggtatatggtgatagtgatgagattaacccgaatacgggtgttcccattcagcagttcgttccgcaattctcactatggttcggtgagtatagccagaccatcaaccagcagattactctaaccggagacaacctgacagatacgaagatgattgtggtacggcataatgagcaggtcaatcagcaacaactggttaagatcggtgacaccctttatcgggtcaacaacgtagccggtgatgatgaggttaactcattcgatgtcatcacattggttcgctaccagaagcacgggtaataaacgagaggtcgtcttcacggacggccttttgtgtatacaaggagatattattatatggcaaaacctatgaagcaatgcaaccatgccgggtgccgtcagttggtgccctatgatgtccgttactgtggtaagcaccaacacaaggctaacgccgaaacttaccacaagcgcatgtatggcgagcatgagggacgctatcaacaattctataagtcatctcaatggcgtaagttgtcccggcgattcctagagaataaccctatctgcgtgcaatgctaccaagatggtgtgatacgtaaggctgatgtggtcgatcatattgtagagttgcgtgatgattggtcccggcgactagacgaaagcaacttgcaaccattatgctaccgacaccacaatcaaaagactaagcaggctagggaagcacggtcaaaataggtcagcattaagaatggtggtaaggcgtgatgtgtctgcgatagttggtgatagatgatggttgcgattatatagagtattcgcaagtgaatatggttaggtagagcggaattttccgctgaattaaaaatggctggctaagttaaacttaggtaatatctgcgcaatgatgtcccggattttcgggagatctactaagcgaagttttccgctggccgaacaagtgtagtgctgactacacttgttaagctgagttactgaggtcgcaagttacgaccccaacgcactaacttggtgtattagctgacccgttaagattacgtgacaggttgccttcgcggctcaattttgagcccccaattttggggagccaagccgaaaactaggccgagttggatttggtagccgacaattcgaccgcgagcattctaaagtgattgtaaaacttggtatatcaatgatatggggggctatgaatgaaccgataagagcgggcacactcctttctgtgcgtaaatttccctttaaaagtttgattttttgccaatattgacagaaatcagaaaatgtctactactttattcaaaatttgcataaataaaaagtcaaggggtgaaacataactatatggagtatgctaaccaataacagcatactatatattgcacttttccctcgaaagtgttacgatttatgtataataaacgaattccgaatatatgtgcatttgagctacctcagccatgctgtggtggcttttttgcatataaatttagcgaaaggagcccgaaaatgggtcaaaaaattaagcaactatcaactctaaagaaacatctaacgaacgaagaacgcgaccagcgtaaggacgccgagacggccttgtttgattacccgtcactcgatttaacgccccctgattggttgcatgaccgtgctttgactgaatggcaacgtgtttccccatatttgaaagctaacacgcccatcagtgaacttgatcgggcccttctagcaagctactgccgggcttatgccaccattcagacttgcgagaatgatattcgtaagaatggactagttcaaacgaatcaggaaactggttcccgtaagccgaacccgtacgtggctttgcagtcacaagccatgaaagacctaaagtccctagctaatgatttaggcatgtcgctatctagccgggcgcgtatggaattgaataaacagaaagatgacgcgccagaagattcttttgaggcgatgttgtcatgattgaatacgttgatcaggtcttgtccgggaaagtattggctggtcaaaagattaagtgggcatgtgagcgatttaaacgcgatttaagccgttctaaagaagctagcttcccattctactatgatgaggaagcggcggcaaaagcggttaaatttatcgaattaatgcctaagactgacggtagccaactcaccatgcagccctttcaagaatggatcatcagtgagttatatggctggcgggagaaagcaactggcaaccggcgttatgatcgggcgtttattagtatggcccggaagaacggtaaaacctatctggcttctggtatggccgctaatggtcttttaagagaacgtcagcccgcccgtaaccgacaagtattattcgtcagcaacgcccttaaacaagctaaattaggctacgacatgctttcaagtgggctacggcaagtccgcaagcaatcgaagtacatgcggcaacggattaaggtacagaagcaagccattactgacctagaaactgattcgcaagccctagcccttgctagtgataccagtacgcttgatgggtatgccggcaccacggttattttagatgaatggcatgaggccaaagaccgtaaggtatacaacgtcttaaagtccggtcaagcgcaagaagataattcattgctagcggtgatttccacttcggggcttaacctcaacgtccccatgcacgccgaatatgagatgttgacggacgttttaaaggggaagattgaagctgatcgctactttgtggcaatttgggaactagacgaccgcgaagaagtttacgatcaagccaattggatcaaggcaaacccgttgttcagtgaaccacatgttaagcaacgcatgacggagaaaattcaggccgatgttgaccttgccattaagcaaaataacctcattccggtgctggttaagaacttcaatatgtggttgcaagctagtgaggatagttatatttccgcggacgattgggccgctggtaaattggcaaaggtgcccgacttacataatcgtgacgcctatatcggcattgatttatccaaaagtaatgacttgaccgcggttagttggttgataccaattggcaacggtcagttttattgtgatagtcattcgtttgtgggcactaagtacggccttgattctaagattaaacgtgatgggattgattaccggtcaatggagcgcgctggtgagtgtagtattactcgccttgatagtggtgtgattgattatgatgagctatttgactatgtacagcaattagtcgggcaatataactggaaagtgaaagccgtggcctatgatccatacaatgctcaaaccttaatcactaagttcgaaaaattgaattatcctttatttgaagtgcgtcaagggacgttgactttgaatattcccacccgaaatttccgtgatcagctgtacgcgggccacattaaacacaatggtaatcagattctcgcttatgcggtcaataacgccatcttgaaagtgttaaataatggctggcaactggataaagcccgcaatagcaaccggattgatccgatagcggcgttaattaatgcttatgtggccggtatggaatattaccaagaaagcgaggcgaaccaacatgcgaacgaatattatgcgactgcgacggatctgttctaattacctatctgcaatcctgctgattatggggctgattctgctagtcgttggtgtcggcggttggttagggtggtatgcagccatcatgctggccggagttagcctgatcgttttggcactactgattaattatgaagaaaaggaggtgaacccatgagcatttttgttaaagcaagcaccactagtggcactcatgatccagtggctgacgccttggttagtctgtctagcaatgacccctatacgtttgtgagtgcggcggtgctacggaatagcgatatttatgcggccattaatattatcgccagtgatattgccagcaacccgatcgtttgtgatacggccatttttaataccatgattaatcagaacccgaatagcaatatggacggttaccattttaaatatgccttggcggccaacttgcttctcaatggcaatagcttcgcggagattttgcctaatcacaccctgaaactgattcccaacaatcaattggtggttgagcaagacgatgtgagcggcaagttgacctatacttatacgccaaccagtggaacgtgtcgtcagatcgcgcctaacaacatcttgcatttcaaatatttcaccaaagacggggtatcggggatcagcccactatatgccttgaaagatgaacgccagattcagtcggccggcaacaaattgctaaccggcttttttactgccggcgtgcacggcaccaccatcgttaaattgcaccaaacggacttaggcaaagaagccaaagaaaacgtccgaaaacagtttgatgaaacgaccaccggagaaaatgcggttaatacgattgtcactgatgatggtatggatattagtaatctgcccttaaataccgatgtgttaaaacttgtgaactcgaatgattggacgacccggcaaattgctaaagcctttggcttgccaccagagcgcttaggagtagaaaacaatcactctaaccaagagcaaagtggcgtgcagtatctacaagggacgttgcagcattacttcgatagcttcaccagcgaactatcattcaagcttggccatgacttcacgttcaatacggacaaattattgagccttgatccgcagacccagcaagcccaagcggtggctggatttacgggcggcattatgagccgcaatgaagcccgggccaagattggcctgccaccaactgatgatggtgatattttcttaaatctacaaaagaatggagtgaataattcatgaaacaagatcgacggttaacaattgacgccgaattacgggcgcaaacgccacaaccagaaaaaccggaagatgaatctgcagacaatgtaactgatcctaaaacccaagacggccaatcagccaaggggaaaacgattagtggttatgccattgtgtggaactcaccaagtaaagatttaggtggttttaccgagattgtaacccccaaggcgcttgatggtgtcgatttatcaaacgttcttatgctcaacaaccacgactacactcaagtgttagccagcgtcaaggcgggcacgctgacgctagaaacagacgacaaggggctacatttcatcgcccagttaccgaatacgtcgtttgctaatgatgtctatgaagaagttcaaagcgggaacgttgattcctgctcgtttggctttgatagtgatgatgataccgacgaatggactaaagatgacgatggcaatatcacccgaaccattaaccaagtcaaaagcctattcgatgtgtcagtagtggctgttcctgcttacgacgatacgaatgtacaagttgatacgcgtagttacgaaaaatttatcaatcaagaaaaggagcctgataatatggcaaagcaaacaattattgatccaaacacgaatgaagatgacaacaagaccggtgttcctgcctttgaagcttatgtacgaagccacggtgaaacccgagacggtttgaatacgagtggtgccagtgctgttattcccaaggaactaattacccccgttttccaattaaagcaatccacctacaatctcgcccaatatgcgacggttaagcaagtttctagtggttctgggacttatcctatctcgactagtcgacaatcagctgtactggctactaaggaagaactcgctgatattgcggacgttaacgcgaatatgtttacggaagtgccatttgatgtaaaaacccgggcgggtaagattgccttatctaacgaagttgtagaagatgccgaagtggatattgtgagtgaagttaaggctcaattacaacaactcgttgataatacggacaacacgcagatcatgggactgttaacgggtagtagctttgctaaagcaacggccaccagtattgatgatctcaagaagattttcaatgtgaccttagaccctgctttgagcaagatgtggttagttaaccaatccgggttcaattatcttgataccttgaaagatagcgaaggccgttacctattgcaacctaatccaacggcgccaagcggctttaccttgttaggggctccggtcgtcatgatcagtgataagttattggccaacaatgctgacggcacattcccaatggtcgcgggtgatttgtcacaagcggtggcggtcttccggcgcaaccaagtaaccgcccaatgggataagttcgatcagttcagccaagggttatcagtgatcgtgcggaacgattatgaagtgattgataagactgccgcggtcaatgtgtcattaggaaccgcaaccagcggtaaatagaagaacataagggggagccattttggacaccccctatatacataagttaaaactaagggggaacgaatcgttacccccacaaaggaagtgatgatatggctgtgacggttgatgatattaaaaccagcttacgcttggacttgaccgaagatgataccttaattcagggctacttagatgccgctaaggaatatattcagaccgctgttagcactacggctggtttaacccaatataagcaatatgattttgcggtgtcattgctaacacaattctggtatcaaaaccgggtggtggatatgaagcagactccttaccaagtggttagcatgatccagcaactccgtgggctgacaagcgaataaaaagtgttgatgaatgaatttcatttaaaaataaaataggtgaaattaattgaacgaaatgttataatataggtgtccttagtaattcatttaattcattgttagtaagggagccgcagattgcgactccctctccttatacatatatttggaatcagaaagcgtggttccaatgcgtcaagatattaagaagatccgtaatttattaaaagagtatgccaaactaaaacaggaaattcggacgtttaatcaggtatctagtccagttttaagtgtggctcctagtcacagttgcggcaatggcgttgaaactagcctcattaactatgttgacctatcctatcagctaaaagaggttgatgacgcgctaaatgcgatccacaatccgcagtatcaatttatcctgcatgattatatcattgagaaacgtttcacccgaagcgaggcttgcgaacgattgtccgttagtgttagcaagtttaactacatgaagaattgtgcgcttgaattatttagggttgcatacatcgaattaaagtgttaaagttagttaaattgacatgttcggaagttataagtatcattcatctttgctatctattattttcttagatgttaattcaatttggttactttggtttgattcctaggaggatatatatatgcaaaatggtactgtaaaatggtttaatgctgataagggctttgggtttatcactggttcagatgataaagatgtattcgtacacttttcagcaattcaaactgacggttttaagagtcttgacgatgggcaaaaagttagttacgatgttgaacaaggcgatcgaggacctcaagcgactaatgttgttccacaataatttgtctaatattatgaagaactgcttttgatggagcagttcttttttattaaaggcatacaggaaagcaatgtgataatatggattttatagatgtttatggcattaatcacgaaaattgtacgcttgttacaccaactagagagtacagtcgaatcaacatattcatggattcagttgggcgaagatttgtagctatgagtcctgatcctgtacctagtaaatatggctcagtaaatagtcattggaaacgtggccggccatctgaagcaccgaaagattatttttatattgataaataaaaaaactgttaaccgatgaagttaacagtcactgccccgcgcaagtatgaagccaccggaaacggtggtttttttgtaaagtaagccaaatggtaagccaaccattatttactaagcgttaaaaccattgctatcattggtgtgtaggcatttataaagaagtgggggtcattcccagtatacccaattcctacttatcagccgttgtcatagggtgtcaaaacccttatgacagcggcttttttagtaccttagtgttttatagatggtggcagggtttagttcacattttgacagaagaacagagtatttgaaagttttaaaatgaggatgaaaagtgatgatattttttcaacaactaatatataatgggattagttgaaaggggataggggaatatgctaagaaaattggggttgtctttaattgttatcggcggggttttgactatagggacaaaaaatgtgaatgcggcctcttttgcttcaggggactctatagtttctatgactactcgcaataattatattcatgattcaaaataccgatacctagtcacaaagaagaatgcaattgcttataaagcaattggtaaggcacctgattatactgctagtgtgtctatcagtaaaaatgtgccattaacagtgcggcagacggttgagggaggacatattgttacggaaccgcaaagcacggataaattatttttaagtaacgataagcaatttgtatattccagtgatgtaaaatcattaagtaaaaagcaaattaaagtgctggctaaggattctaaaaagtggtcctcaaaaatcgggaaaaagagtgtacaggcggtcggttattatactggcgatggttatgaaaaaattaacgggtatttgagaaatggtaaaggtcagaaaaaagttgtcaaaaaagcgcaactggtccaaaaggggatttctaaattcaagctacgttacaatacgacagtttatcgtggtatatctaacaaaggcttaaagctctcactaaataaccgggggttaagcgttggatcaatctatcaagacaaggccttctcttctactagtctctctaagcaagtcgccttaggattcagtagtcagtgtcttttgagaatcaatattccagccgggtcccatggggcctatattgatccaatctcaaagaataaaggtgagaaggagtatttgctgaaagagggacaaaaattaattgttactaagattcaaaatgtaagttatacggaagcgacaaaaatgtacctgattaaaaataaagggtcaaaggtagtccaacacacaactaataacgttaagggaaactacaaactaattacgctaaatttgttgaattaaaaactgctaaccaaggtggttaacagtcactgacttgtgtaagtatgaagcgatgtttctagtgaatctaaatagaaggtgagtcgttaactgcggttatgcgttgttgacggcttttttgtggccagcagaaacaaactagcgtatccaatagtagccaattgttcccagaacaactagcagtcctagattcacgagggtaaagaccttaaagaactcccggacggtaggccgattggttaggaaaagaagttgtttgagggccaatagattggcaagggaggccactaaggtgcctagcccccccaagttaacgccccaatacagagcagttaggtgattggtaaagttcgctaacaacacggtggccggaacgttactgattacctgactgatggtcaaaccggtgaggtaacttgcgactggggtatgggtgacgtgggcaatcaaggttgttaatgtagcattatgactgaatgaactgactaaaatgaagaaacagataaaggtcagcagaaggccataatccacttgcttgatggcggcgcgatttagtagccaaccgctaatgataacaatcacggttatccaacccaaaggaaatatttgaaagattcccaatagggttaagccaaacagaagaatggttaaggcaatctttccgggatgctgaggaaagagccgtgtaggggcagccttagtcgatcgaggcgcgataccataagtgagtccagctaagctgaataatccgataagcattaatggcgttgataattttagaaaggccaggccgtcaatgtggtagtgagccactaagaagagattttgtggattaccaaatggtgtaaaggcacttcccaggttggccgctagcacaattagggtagtggggaaggcaattggcaagtgctgttgatgtgctagtcggatatacatggggaataaggttaagatggcaacatcattggttaaaaacatagcgcctacaaaggctaatagaacagtgtattgcacaatttgtcgttgattatgggaatgtgttagtaattgttgactaagttggtctaaaacgtggtagctgttaagcagctggacacaaaccatcaacgctagcagtgaccagatggtggtccagttaatatcatggatttgtgggcggccgacaaataaactaagcccagcagccaccgcggcaatccatagaaccttgtcgtgtaagatacgggtggtcacagctttcattgcaaaaattcccctctttcaagccaaaataaaaacaagacaccgttgcccgatagtcttgtttcatcattataatttaaataagtggggtttgccatagaaccacccttgtcgaagatcaatctgtaggcgattagccatatcatgttcagcctgattttcgactccttccagaattaagcggagtttgtattcctccgcaatctttttccagaattttaagttatccgggatttcatcggcgcaatcttcttggcgaaagttttgcatggcaaatttgatttcactggcgtaagacaacacgggctccaagtgatcataggtgttgaccccggtgcccacatcatccaggctcaactgaatgccatgctcatcaaagtagtgaacctgatcaatcagttgttgagttgaaatggctttatccgtaatttcttcagtaacctctaagacaagggtaatgggataaatttgttgttgggcgtcgataatagcttgtgcaatcgttggatcaatgaattgactgcggttaacgttatatgaaactgagccaatctttaaaattagcttctgcgccgttcgctgaatgaggtcggcctgaacgtcgatcggaattgaggcaaaatcgtgtggcaagacccatttatcatcaatctgttgccgaattagcatttcgtagccgattagtgaattgtttaaaacatcaatctgcggctgcaaaaaataacgatacatgatgtggccatcctccttaaaaaatatctacatccatcatacgttattttaacgggaattaaaatggggtatgtgctaaaaaaacgtaagcccttaatatattatctttgataaaaatatatggttttattatataaaatagcagaatgtagatgttatcagttgtttttcacggtatactgataaggaaagtttagagataaacctaattaatttccaaggagaatgatgtaatgtaatggacaatgtggctagttcccccaattatcacgagtattttctttgtacttggggtaattaccctttattggtcaattttcacttgggcgacgactaaagccgaatcacaaagtaagccagttaacgtgcagaaggttcaaattgtagttggaacgatttgtgcgattatctcggtatttgcactgcaattgttggttcgagatagccatctaggatggacatttgttaattttcaattgctcctacttttgtttgttgcttatttcctacaacttaaaattccatattggttagtttttgtagtcgctattgggttcatgttaatgaatggaaatgtaactgccccattatcctgggtattcacgttggtttttgtaggcttttacgtggtcgcttatcaacacagcattcacttatggcgttggccatatccccgctatattctagtggcacttagttttggaatggttctctggcttttagtcaagatgcgctttcacttgccttgggtcacctattggattaaaatggcagattatgcctttttagcaactttgatgtacgggtactttaagattcaggataaggatcggcgcattaaagatcgactatttcagtctgctaattgggatgcgttaacccatgtacaaaattacgcggcgtatgatcgtgctattgactatcattttagtcgaagtctcatccgacacaacaatctaacaatggcaatgtttgatatcgatcactttaaatgcgtgaatgatacgtacggccatttagctggcgatgaagtgttgaagcaagtttccagtacggttgttgatgtattaaaagcaaaagatgagcagattgtgttgtaccgaaccggtggcgaagagtttaacgtgatttttccaggctacactgtggcccaagcgcaaccgttggtgcaggagttctttgatcgggtgaaagccttgcgaattccgtataatgatgtggaacttaacgttaccatttcagtaggcgtttcgagtttgcatcgtacggatcacaaccccttggatttctataaacgggttgactctcatttgtatcgttcgaaaaagatgggacgccaacaaattactttggagtaacggcaggtgcgtttttaataaaaatgcggtagaatagctgctaatcaaatagactggtttaacggggggcattcatccgtgattttattacttttactactattactgttatttccacttttacgattggtttttggcctggccggttggctattaggcctagtggggacgttaatcatcggtgcgattgtcttagtggcctttgcggcaatctttcgttttttgattgttgcggttttggttgtcggcgggggtctttggatctcgcgaggattgttcagttaagttgaataaaaaaatccatacaaaaaaggctcatgtccgaagacacaagccacaattattatttaattgataataacattcatcaagagcaccatgagtaacccaactacagaaatcacggtttccaaggctgtccacacttggaaagtttgcttaacgcttaaatcaaagtattctgagaacatccagaaaccagcatcgttaacgtgagacgccgctaaggacccggcaccgatagccagagcgatcataactggatcggctcccattgaatgcatgagtggtaagactaaaccagaagccgtcatcccagaaaccgttgcagatcccaaagaaatccgtaagataaccgtaattaaccaggctaagacgattggtgagaacttggagtgcatcattaattcctgcacagccttaccaacaccgccatcgatcaggacttgtttgaaggctgaacccccagcaataaccatcaaaagcatagccgtagacttaacagattcttccagcgtggcactgatttgcttcatgctccgttgacgatgataccccatagaccagatggcaaagagtaacgcaatcaccatggccaccacagggttgcccaacatcgaaacaaccgcatttagcccttgcggatttgtcggcgttttcccaccttcaaccgtcagttcatagatggttgctaggatcatgaagatcacggggaataatgacgttaagatcgataagccaaatccaggagtttcttcaagcttgaactgcttgatttcaccaaaggctggcaaagacttcttaacaacaaacaggtctggattgaatttgcgaaccactcgcgtccagattggaccagccacaatcacacaaggaatcgctacaataatcccaacaatcagcatttcaccaatattagcacctaaggccgttgccacagcagttggtgatggttgtggcggtaaaaatccttgcgttgcggatagggctgccgccatagagatcccgagatacaggaacggcacgtcggcttccaatgcaaccgcaaacacgattggcgtcactaagaccaggcccacttcaaacagtagggaaatcccaatcagaaatgaggcaatcacaacagcgacttgtaatcgctttttaccaaagacgttaatcaatgtccgggcaattcggtaagccccaccagcatcggacactaaccgcccaatcatggctccgaatccaaagacaatgaccaactcgcccattgaactgccgatcccattcttaattgcatccgcaatgttagcagggttcatacccaagcctaaggcgactaggattgacgtcacaatgagggaaacaaacgtatttaactttactcgaatgattaagaagagtaacagtaaaatacctaataatagaactacgaactgcattttttctctcttttcctatgctcgattctgatggattaacctaccgcagctaattcgaccacttcgcataagaactattgtatgaaaaatattttcaagtttcaaggggcaaattgaatgttattttcaaatcagtgtcgttaatcggcgtgaaaccgctatctcacaatcattacagagattggagaatattttgccatataggccgcctggctcccaaaatatttccgcacaccggatttggacaacgaaccaaccactaataaatccggtttgacctcaggaataatcttttttacgattgtttcccccggatcgccttcgccaatgatcactttcacgcgttgaatgccaaaacgttcggccagttgctgatagctctgcaagtgttgttgcaaatcactccgttgaccatggacgtaatctttacttaaagcttggtagatattcatgttgtcggactccaaaacggaacaaatcaccagttctgcctgatccgttttggcccgattcatcgcataccggaaagctaattgtgcatcaggtgaatcatcaaccccgaccaaaattcgcttaacctgtttcggattcattgatttcatattatccatccaaaacgcctcctcactcatttgttactttcattataaatgatatttagccattaggggtaaccatccatcttaactagttgcgccgatggaataagccgatcacaaatgtgatgtaataaaacagtgcggcaactatcccgattcccacaaaaatatcttgcataaccccaactaagccactggtatgtaacgcattgaaataccaaaagtaacctgccagcacggtccaaaatacaccccgtaataatcgttttgtttgcatccttctttgaaacccctttcaaacgttgtttttaaaaaagtcatcatgttcatcgtgatgaccacttaactgtccccacccgggctcgaaccgggatcattcgcttaggaggcgagtgccctatccagttgtgctatggggacatgatgacccgtcatcaattctgacacggatcattttaattgtaaagcgttacttctgcgtatcacggtcccgccactttttacgcatccctttatttttggaatgtcgatttttatgcttcttctttttcgttggcgttggtacaggaacggcgttgctccccgtccgtgactgccgttgctgtggtttggctactggcgtttctgttggcgcttgcgccgttgtccgattggccaccggcgttgctacagacgttgcttttgcggccaccggtcgttccgtacttaaggcacgcccattaaaatacaacggcactagctcataatcggtttctttcaataactttttcaaatcccgcagatcgtgatcgtcacctaaactgatcacttgccctggttcacccattcgtccggttcgcccgacacgatgaacatactcgttcacctgcgttggtaaatcataattgataaccgctggcaatttaggaatatccaacccccgagctgccacatctgttgttagcaacaagcgaatccgcccctggcgaaaatcctgaagtgccttctcacgttgaacctgtcgcaaatcactcgtcagactagccgctgagacgtgttcatggtagaacttcgtcgcggtatgccgcaaagtgctagcttgtttgaagaagactaatgcccgaaagttaggcaatgccaacaatcgtttcagcatttgatcacgcttacccatgcccacttgcagcaagccatgacggacaacgccctgcgtttggtcctgctcccgaacgtcaattcgttcgacggtttgcccaaaccattggtcaagttcgtgcaaaatcggcgtatccgttgccgagaagaagcctaattggacatctgctggcgcggcctgcgcaatcgaacgcaccgtattcaacgtttcaccggttaacaagtcatcagcctcatccacgatcaataaggataccaagtgtagtttaagcttgcgatctgtcaccaagttcaaaacacgacctggcgtccccacgatgacttccggccgttttttcaggcgttccgtttgtcgtttgacattggccccaccagttaaggccaagacttgtagatccaataatttcgcccagtctcgcatcacacggctcgtctgaatcgccaattcctgtgatggttcaagcacaatcaattgtgtcccatcgcctggcagtaaattagccaaggctggtaacgtaaaggccaccgtcttaccagaacccgtgggggctaagcccaagacattgtggtcactggctaacggctcgtatacggccgtttgaatggctgtaggttcccggtagcccagtgttttaaaatgggtctcaaattgttttaacattaaaaatccttcctaatcgttatcatcagctggaaagcgtaaattagcacttacacgcaattgataaagcacccggttggccgttaagctccatgccatccatcggtgataatcggcttgattttgcgcatcatcaggtgcagtcaatacgcgcgcaaagtcaacaacttctggtaacattggattagccaaatccggctgacttaaattttgtacggtccccgtctcgtcgtactgttctacatgagttaattctccggcactatccaatgtgatcgtttcttttaggccgtaaatttcggaaatcgcataggagttactggtttttccaaaggaaacggaaacgtcaaaatctccatatcgtaagactgctaagcccttcccatcggctccagtagcaatcaatgtcggataataagccacatctgtcggctcaccaaacagtgcaattgccaggtaaatcggataaacgcctaagtcctgcaatgcaccgccagaaaactctggcgtaaagacattcggtgtcccaccggctaaaacatcatcataccgtgaagaatacttcatgtaagtcaaagccgcaccttggaccgttgtcaaaccagcaagtgccttttcaatcgcatgaaagttcggcgtgtgtacgtgacgcgcggcctcaaaaaatttgacttgcgggtgttgagctaatgccgcctgtaccgcgatcatttcttgtcggttactaaaagccggcttctcaacaattaccgaaatatcgtgggcgattgcttgcatagcttgttcaaagtgaacactgtttggcgatgctagatagacgacatccaaatcagcttgttgcaacatgtcgcgatagtctgtgtaactagcttgtgcgtgatttttagcggcgaatgccgttgccgtatcttcatgccgagaataaacagcggctagttcataacgtttactcaacgctaacgcctcaaccaattgctgtgtaatccaattcgtcccaactgttccgatgcgaatcatacaaatccctccagtatttatgactattcctattttaacagtcaccgcggctaggcgatagcattagaattaaatttcccaaaatcaaggggaattgttggagcattctcccccaaaaatgttatatttaaggagtacttaaatgcaagggagggattaccggtgaaagggcgcgaaatcgcattatttggtgtttcactggtggccggactaacaggtggcttctcattacgtaaaaagaaacaagagcagcctagcgaatcgccattgttttacgtgggatcatggcaatttgttgacccccacaaccaacgacgacaccggttagaaattagtcctaatcttgacgtgcaaatcgatgaccaccagttgcaagtccgtgtacaagatctcaacgaacagcacctgacttttcaggataaatttggctatcatctaacggttcacgccaatgaacagcaaccaatttcgttttttgatgaagccgatgactgtacttatcaaatcaagccccttaatgattgaatcatcacggtcaactaaagggaacctaattaagagagctgaccgacgatctaatcgttggtcagctctcttttagtgaataaaattttgccaagtgcgtcgatcaccattaaagaccgcccgttcaacggcatgactttgcgcgttttgtgtcattgttccattcgcatcatactcgataaacttcacctgcgccccttggcccgttaaccgaccgtcagccacccagtagtgtaatgctggtaaaacgggatggacaaactgatccagcacctgatgcgtcgccaagatgatgaccccttgcgaatagtgctgagttaatttttggacgagcattttaagcttctgcccttgcatggccatctggtgattatcgttgttgtacttgccgtaataagcaacggcgaccataatgggtagcgttcctgagtcttccttcacggtcgctcgaaaatggcgatactgttgttcagccgaactggtaaaactaaaggtgtgcacgacccccacggcaatgtctgctccttgagaccgcgaaaagttatcgccataggcatcatcagtgtaagtggcacctgacgtagcctgcaagtaaacaaacttttcacgattggctaactgctgaaagtccaagtacccactgtcttggttaatcatcacaccctgaataggataattcgagagctgctgccgttgataagcttgccactgccaccagctcaggccaccgacaattacacagatcagaaatagacccacgacccaccaaaagtgacgtcgttgtcgctgataggtattgtcatagattggttgataatcccgtcgtttcgccattccgccccagttctccttttagcccaataaagttgttacttattataccatggctttaagaatcatgacgggtctgttcaatcacatcgtggaccttagtcatcacgttcccagttcgtgaagaaacgcgcaaaacagtcatcataaaaagcgtgtccaagatcgccaattgtgaaatcagggaatacatcccctctgaacgataattaacttcgtccgtcaacgataaaaaggttacatcggcagcctgtgccaacggtgaaccactgtagctcgttattgcaataattgaaacgtcgttgcgttgcagttcttccaccacttgtagggtctccgagttacgtcccgaatgggaaatcaccaccgcacagtcctgatcgcttagccgcgctgcctgcattaattgaatatcaaaatcgggatagtaagtcaccgataaagcagtgcgtaaaaacttatgatagccatcaagggctgcaattgaagagccccccagcccgaagaaggtcaccttctccgcattaatgagcttcaaaactgcacgagctaagtccttctcgctcaatgcctcatttgttgcctctaacgagctaatggtgtaatggaaagttttattggcaatggttgccaatgaatcaccctcagctagctctgggaaagaactttggtgctcgccaccatcttcaattgctaagtgcgccaacgccatagtgaattcccgataattggcataatccattcgtttcacaaagcgtgaaatggtcgccgttgataccccggttgcgctggctagttccttaattgtcatctcgctgacgactgcgggcgtgtttaaggccatctgggcaacctttttttccgttcgtgacagttggtcatatgttccccgaatctttccaattgttgagcgggtcacatgccccacctctctttccaataaatgaagcgtacaaacacatttttgtaaacattttacaacaaaagccttgaaaagtgaaacttttttacatataatagcgatgttgtcaaaatcgcgcgtttttaaagcgcttcattcattatgttgaattcacccgttcgatcaccaacgatcgagcgggtttacaaactctagcgacacgaaaggaagagcactatggactacatgattggggtcgatattggaaccaccagtgtcaagactgtcttatatgacaccgatggcaagatgcaggggtattcaaataacctataccccctctaccaagatgaaccagatatggccgaagaagatccagaagaaattttctccgcgatcattgatggattaaccactgttttacgcaaggcagacttgaagaatggcacccttcacggtgtttcattctccgcagccatgcacagcttaatcttgttagacgaagatcaccaacccctaacgcgagcaattacttgggccgataatcgtgccgttaagtatgccgatgaactccgggaaaatggtgtgggtaagcaactttacgaaaagacgggaacgccaattcacccaatgacaccactcagcaagctaatttggttgcgcaatgaccaacccgacctgttcaaacaagctcgttggttcgtcggcatcaaagaatacgttatttataaattattcggcgttttacaggaagattattccattgctaacgccaccggtttatttaacatcttcaacatggattgggacgaccaagcccttgaagttgccggaattacccgtgatcaactgcctaagttggttgacacaactgatcaaattaccggtatgcaggctgattacgctggcgtgattggcatggacccacaaacaccatttatcatgggcgcgtctgatggtccattggctaacctgggcgtcaacgcgatcaagccaggtgtggttgcggttaccattggaacatctggtgccgttcgggttgtcaccgataagcctaagattgatcctaagggtcgggtcttctgttactacctgtccaaagatcattgggttgtcggcggtcccgttaacaacggggggatcgtcttccgttgggttcgtgaccaactctttgccccagaaaagatcaccgctgaacagatgcaagtggattcttatgacctcttgactgaaatcgctgctaaggttccagccggttccgatggtttaatcttccacccattcttaggtggtgaacgggcccctatctgggatgctaacgctcgggggtctttcttcggcttaacgcggacccattcacgagctcacatggtccgcgcagctctagaaggtatcgtctacaacctctacaccgttatgttggcgttggaagaagttgttggcaaaccttccagtattcaagcaactggtggctttgcgcgttcagaactttggcgtcaaatgctcgctgatattttcgaacaagatgtcaccattccagaaagtcctgaaggaactgccttgggtgccgctactttagggatgtacgctttagggatgattgatgacttgtctgccgtcaagaactttatcggggttgctaacgtgcaccatccaaatccagaaacttatgacgcttaccgggcacttgtcccaatttatattcgtctaagtcgtcaattacaatcagaatataagaacatcgccgaataccaacggacgcacgttcaccatattaacaagtaaaacgacttcgtttggttgtttcagaaaactaaacgaataaattaaacttttttgaaacaaattgtgtacaaaccaaaaactttcaagtacaatatgtgtacttcttattggagagccaacgttctcacgttggcttttcaaaattcatcatatgaaagggcttacttcttatggaacttattgctttattaattggggtcatcttcctcttggtcctcattattcgattcaaaatcaatacctttgtctccctgattttaacatctgtcttaacggcgatgctattggggatgaacctcactaagattgcggctacgatcgaagccggaattgggagtcaacttggcgagctgtccctagtctttggtttcggggctatgttaggtcggttagtcgccgacgccggcggggcctatgtcattgccacaacgttaattgacaagttcgggaaaaagcggctccaattagctattatgcttgcttcctttattcttgggatcgcgctattcttcgaagttgggatggttctgttaatccccatcgtcttcgccattgcggttgaagctgaagtcccaattctgtaccttggaatctctatggcagcagcattgtccgttactcatgggttcttaccccctcacccggcacctgttgccatcgcccaagttctgggcgccaatgacggtaaagttttactgttcgggttagtggttgcaattccatcagctattgtggctggaccgctttttaccaagatggcccagaagtttgcgcccagcgcctttcaacaaaaaggtaacttatcttctctaggaacaattaagacgtttaagccttctgaggcccctagctttggcctctccgttttaacgtcactcttcccagttatcctaatggccattacgaccatttacaaaatgacggtcgatggtggcgccacaccaactaagaatgccacgatgttagatcaaatcgtagccttgatcggtgacccggccattgctatgttaatttccctgttagttgccatgttcacgatgggttggggccggaaacgtaaaacctctgctatcatggaaacgctggaaaatgccgtcaaatccattgccatgcttctcttagttattggtggtggtggtgccttcaagcaagtcttaattgacggtagtgttggtaaagaagttgctaagctctttatcaactccaacatgtcacccctcatcttgggttggttagttgctgttgttctacgggttgccttgggttctgccacggtgtctgcattaaccgctgccgggattgtcgcaccattgatggctcaatccggtgttgatccagcgttaatggttctggctatcggtgctggttccctagcagcctctcacgtcaacgatgctggattctggatgttccgcgaatacttcgatttaacggttaaacaaactctaagtatttggaccgttttggaaaccattatttcggtagtcggtctgttgatcgtcttattattaaatgttgctttccactaagctacaaagatcaggttgttcgccatgacgcggacaaccttttttcttggaaaaaaactctctacgtcaccgttcattcgtaattttccgtgctataatgattaaattagtctttacatgtagagaggagccaagcttttggcaaaagaattacgccgcgaaatcggcacgtttacggccctggctaccgttatgggaacggttatcggtggtggggtcttcttcaaaacggcaagcgtggtcgccgctaatcactccgcaaacatgacattagcggcttggattttaggggggattttaaccatctgcgctggactgactagtgccgagttggcagcagcaatcccccgcaccggtggcgccatgcgttacttagaatacgcttatggcaagccggtgggttttttgatgggatgggcacaaattttggtctactaccccgctaacatcgcggcattatctattatctttgggacacaatgggtggccctctttcatttaagtgccgcgtggcaattgccaatcgccattatgtgcggtttaagcattaccggattgaattttctcggcgctaaggtcggtggatcagttcagtcgattgccttaatttttaagctaatcccaatcgctgtaatcgttatttttggcctcttagcgccaactcatacggtcattcatctgtggccgatcaccactgggaaccatctaaactgggggagcgcctttagctccagtttactggcaactatgtttgcctatgacggctggattagcattgggaatattgccggggaaatgaaacatcctgaacgagacctgccacgcgcaatcatcattggtttagcactcatcaccgttgtctataccttaattaatctcgtttttttaaaaacattgccaattgatctaatcgcgggtaatcaaaatgctgcagcagatgcttcaatgaagctttttggacagttcggtggcaaattggtcaccattgggattcttatttccgtttacggtgcgatcaatgggtataccttaacgggaatgcgcgtcccctttgccatggctgaagaagacagtctccccttttcacaccatttccgccggttgtccccgcacacctttgtcccgtactttgctgggagcgtgcagttcgtgattgcctttattatgatgttaatgggtagtttcgatctcttaaccgacatgctggtctttgttatgtgggtcttcaactgcctcatcttcttggcagtctttcgtctacgtaaaactgaaccaaagctagcacggccttatcgcgtgcctggctaccccatcattcccctgattgccttagttggcggtctcttcattattgtgacgacgctactaactgaaactggtttggcgattaccggattgggtctcacactaatcgggttaccgatttacttctggcaccaacgacatcgtcaggcttaactacctaaaaaaaggctcagaccataaataaatggtttgagcctttttattaatgttcttgaacttcgttagggtgagccttctcaaaacgatgttcgaagaagaagtaccctgtaattaaagcgtagcagagcgttgggacaacgaatgagaactgcattgaaccggtcgcatcagaaaccaggccttgaatggctggaatgactgcaccaccgatcagggccatcacgataattgccccagccgtttcagtgtatttcttctccgtaacggcatccaatgtgtgcgcataaatcgttggccattctggaccaaagaagaaactcgttaagatggctgcgtagaccgcaatcatattcggaaccgtaaaggtcacaactaatgctaatgtccctaataaggagtaccacgtcagcaccttcgtaattgagaagcgactcataaaggtattggcaaccagcttaccaacgaaccacgccacataactataaatcataaaggttgatgcgccgctgtcggtaatctgatgattcagattcaagactaaacgaatcgtaaaggaccagacggttgtttgcagacccgcatagaagaactgggtcaccacccctttgatatagtgcttgttatgcgccaaatactttagggtttcgccaagactcggccgttcctcttgttgttgccccgcaatttcttttgtcgccttagcccgtggcatcggcgttatagcgaaaatgatcagcatcacgagtaacacgattaagatatatttgtaaggccgtaacgtcaattgtaacatctgctcgccgtaagcaatgcgtgctgcaccgtgcatatggctcatcttttcagataaattacctacagaaccaaagattaagtacttccctaaaacaattcccatgatgtcgcctaacggaattaatgtctgggaaaagtttaagcgcatcgtggcgtgttgcttcggtcccagcattgaactatacgtatcacatgatgtttccaagaagctcagaccaatggcaatggcaaaaatggccaccaggaacatactgtaagttgcgagatgtgaggccgggaaaaacagcccacacccgatgatataaaagatcaacccggtcatgatggcaaatttataactgttcttcttaataatcaaggatgccggaatggcaattaagaaatacccaccatagaaggcactttgaacaaaggccgtcgcggcatcgttaagttgaaagactgtcttgaactgcgtaatcaaaatatcatttaaacttgccgcagttccccacagtggaaaaatcaatgaaactaaaataaattgaaataatggcgttttgctgaggtagccgtccgctaattgggtccagccgtgcttggtttcagttgcttgcatatcaaactctcctttatgtctaattcaaatcgtaaaacgttttacatcgcctaaaaagtcacgccagattctaggataatattcgaaaatggggtcatttcgccagtccggacaaaggcatgcgtttttgccaaatcctgcttcaattggctatgtgggacaaaagcaacttcgacatctggaagtaatgcctgaatggccgccaattgctctgggttctgagtcttaatttcttcggctaaataaatcttttgaaccgccaattcacttaaaacattcttcaaaacatcctgaaaactaggcaattgcttagttagagccaaatcaatcttttgggtacccattgggactggcataccagcatcaccaatacttaaccaatccatgtgtcccataccggcaataaccgtggataactctgaattaataaccgtcgtctttttcatctcaatcttctcctttatctttctttgatcactaacgagcgtgtaatctctttcaataaacactactaaacaagtagatactttatcctaagcatcactcgaaaatgcgtaaatcgatttacttactgtaatacaacccttaaatcaggatcatttcaacaacagaaattactttatcacaaaattaaagggcttacaatgtttttttgaggtttgtgaaaatgatcgtttaaatgtccctctgaatgactgacacgacttgctttcatcttatttttcaatttaagccaaaaaaagtgaacccgttaaggttcacctttcatctctaacacggtcacacgataaccccctggtcaccacttggtaagtcaggaaataactcatgaagacgttgattgggatcaccaacttgcatatcccgctcttgcaacacttgggttaccccagcaaaagtaaacatcagcaggtcggcgccatcttcatccctaacctggtaaaatcgtacaccggcttgtaatgctgccatgacaaaccgctgagttgccgcggtgacttgagttaaccggggcaataaggttggcgcgctaatccgctcatgataccattggcgcgctaccgcctgaccgaacttcataagactcccctcatgcatcttggccactagcttggctgctggcgttaattccggatgcatcaaaacttcctctaagtcatcaatattttcccactgttccgtatgagcattgagttgctttgccatctcacgcatcgctgcaaagatttgctcaccctcagcttgatactgggttgcctgcagcggatcttctaacgcgaccgtttggtttttaagccgggccgttgccaacgccgttgcgatattctctggcaaaggctgtgttaacaggtagatcatgaagaatttcaagaaatacaatgcatgacgactcacaccattcggggtaaacggcgtgttatcaaaatcacgcagttccagataacgaatgccccccgttagaaaattctgagccgagttctggccctttagtcgaactggaccataaaattcgtgggcggaaaagtacgttcccgcatcaatcatcgcttggagttgtgccaaatgtcccggcaatgactcataccccacctgttcttgtggcaaattaacgaagccaaatcgactatttcgaatactacggacgggatgttgtaactccgctggtaccggatcgaagaaccccgcctcagcaataggacttgcgccaaacaaataggtcaataaccactgataacgcacaaagttttgggccagtcgaaaatataaagcattcttaaatgcgactaatgttggaaattcttgtgtgtaatggctgtaaagccgattaatcacgggatctggtaaactataatttacgtgaacgccagtcatacacccatgcttgagtccatatttatgaatcaaatgttcccgatagggcttgattgccggtcgttcaaaatgattccgaacaaattgcaaatctgtctcatctaatttaggcggcatgctcagtggccagattcgatcatccccagccaacgagcgataagccactgtttgtaatgtgtctaattgatctaatgtccccccgatattggggttgggatcagtaatcacctctaactggctttctgtaaagtccgtttgtaagtacggatgaatcgtccgtgatcccaattggcgcgggtgcgggcgttgactcaagcgcccatgctgatcaatgcgatgctcctctatttctaaccccacaaggctgtgatacagttgctctgctaaatgttcctcacgaatgaccgttaacaagtgatccaacatagccatgacctccccggaactttactgcacctatttttactttaaagtgtaaacaaaattaccgtaattgtcactgatattgtccgcctttttttacgatggggaaataccaaaaggcatgccggacttttacagtctgggcatgccctcattgaaacattaccgaatcgtttcgtgaattaacgtaaatggttccgccgtgtcacgcacttcaatattgtcatagagtcgttgtttaatatcagcaacatcctcacgattactgtagatggtcaacagagattcgcccgccttaaccgggtcgccaaccttcttgttcatcatgataccaactgcgtaatccaattggtcatcagctttttgccgaccaccaccgagcaacatgctagcaattcccatttcatcagcctcaaccttgctaacgacaccactcgtcttcgctggcagctcaatcttgaatttcgcttgtggcatgatttcaggatgatcgatcacgttccgatcaccgccctgtgctgcgaccatatcaccaaacttctgtaaggcagaaccgtcagtgatggtcttttcacacatcgcacgggccgtctccaagtcatcagccttgccggacatgacaaccatgtgggcacctaaggtcatgaccaattcagtgatatcagcaggggcttggcccttcagtaagtcaatggattctttaatttccagagcattgccaatcgcgttacctagtggttggttcatatcggagatgatggccatgcaatccattccaacgcccttaccaatccccactaacgctttagctaacttccgtgaatcgtccagcgtcttcatgaacgcaccggcaccagtcttcacatcaatcactaacgcatcggtacctgaggcaatcttcttactcataattgaactggcaatcaatggaattgaatcaacggtgtccgtcacatcccgtaaggcataaatcttcttatcagcgggggcaatatttccggttgccccaacgattgccaaaccttgatcgcgaacttgttttaagaagtcactctcactgatttcaacttgatagcctggaatcgcttccaatttgtccaacgttccaccagtatgccccaagccccgaccagagatcatcggcactggaattcctaaggccgcaacgattggtgctaatggaatactggttttgtctccgacaccaccggttgaatgcttatcaactttcaatccgggaatgctcgataaatctaaatgatcgcccgacttcatcattgccatggtcaactcggagcgttcagcatccgtcatgtctttaaaatacgtggccattaagaacgcactcgtttggtaatctggaatttctcctgaaacgacgccatccacaaacgtctgaatttcttcttgggttagctcgccaccattacgtttcttatcaataatatcaaccattctcatcgttagatcgctccatttcttaaaccgctctattgcctattggtctggcgttgtgagctttagtagttgtgccgctgcatgttgatcgataatgagacaattagggtaaccgccaagcaacgctgctctaacagccggcactttggcatcaccagccgccactaaaatcgaatgttccttttgctttagactatccaggtcaatgccaatcgtccgttcgttcaattctggattaacaatttggccctgctcgtcaatatagcgagaaaagatatctccgacagcctgctgttgcaacgcttctttttctgcttcctgtaaataccccaactgaaaaaccagtgcattactgcggaccgttcccacagagtaaatcgcaatgttggctttctcgccaagtgctagcaaatactgaatatgtcgttccgcttccaccaattccttagtttgttggtggtcaaagatcacgggtaacggcaaatactgtggcactgcatgaaaggcattggcaaaggcgtcaatgctttcatacgcataggtctgttccgtcgagtagctcacactacccttcagttggatgacttctaccccggttaacgtatctggttgtaggctcgaaccaatcgcatagattgttttcccccaaccgataccaatcacatcatgctcatgaacaatctgttccaagtagtgtgcggcgtattcacccaccgtcgttagtacatcattgacgggcgtcaattgcgtcgccacaacatgaacctcaacatcataggcccgcgtcaatgcccgctccaaggtttgaacgtcttgtacgggatcaacaatttggatacgaaccaatccttgttctcgggcaaactgtagtaaccgagagaccgttggccgtgaaattcccatttgttgggcaatctggctttggctttggtcagcctgatagtacatctttgccacggtcagggcttgtcccaaccgttcagccgtggtctccgccattatcatctctccttaaacatctcattaaaaaacgcggtcgcggggtccccgttcccgcgttttcattacgctttagcagccgtatctaaggcaaccctaatcatatcgttaaatgacttttctcgttcttctggcgttgttgattcgcctgtcatcaggtgattactaattgtcaacaccgataatgcccgaacatggtacttcgctgctaacataaagagggctgttgattccatttctgtcgcaataaccccgtaatcgaccagcttttgacgatccatttcatcgttatagaaccggtcttcggccagcacattcccaactcgaactgaaatcttcagatcctgtgcaacatgataggctgtatctaacaaaccaaaatcactaatagctgcgtagtagataccaccaccgaacgtgttatgaataattgaggagtcggttgaggctgcttgcgctagaacaacgtcacgaacatgaacatcgggactcatcccaccggaggttcccacccggaataaggtcttaacaccatattcactaatcaactcattggtataaattgaaatcgatggaatccccatcccggttccttgaaccgagattcgtttgcccttgtacgttccggtatacccaaaggcatttcgaactgtgttgtagcaaactggattttctaagaaggtttctgcaatatacttagcccgcagtggatcacctggcagtaagaccgtgtctgcaatatcgcccattttggcttccaaatgattactcataatttgttcctcctaaagtggttgtctcgactacttcaattctgctaagaaactgtgtccttcatggttaccggcaacaccgaaattatccaaaacggtcgcaccaaagtcagcaaatggcgaacgaacacctaagctaccaccttgcttgaagcttggtgagtacactaataatggcacttgttctctggtgtgatccgtccccgtataagttggatcgttcccgtgatcggcagtaatcattaacaagtcatcatcatgcatgttcgccaataccgttcccaagcgttggtcaaagtccatcaatgcttgaccaaacccatcgggattccgccggtgaccatacatcgcatcaaagtcaactaagttaatgaaacaaaaaccggtaaagtcttcagtcatgacgtgatcaacgtgatccataccatccatgttactttcattgtggtaagcttcatcaatcccatgaccagagaagatgtcgttggtcttaccaacagcaactacccgaacaccggctgcttgtaaccgatccaaatcagtctcaccagttggttccaacgtgaaatcacgccggtttgctgttcgcgtaaagtggtctgcatctggcccaacgtatggccgagcaatgatccggccaaccaagtattccggtccattgactaatgaacgcgcatattcacagatcttatagagttccgccaatggaatcacgtcttcgtgtgccgcaatctgtaacacagaatcaccggacgtgtaaacaatcaagtcgccggtcttcatctgttgttcgcctagctcagcaatgattttggtccctgattctggtcggttaccgatcactttacgtccagaaaacgtttccaattttgtaatgatgtcagcggggaagccgttagggaatgtactcaatgccttacgaacaggtaaccccatcatttcccagtgaccatccattgaatccttaccagctgaaatctcccgcatcttgccataataggcatgaggatcatcagccaccggtacaccctcgattggtgtttcccgcaagttagataaaccgattttggctagattaggtaacgccagttttccagcaaaatggtgaccaacgtgccctaaagtatcagcaccctcatcgccaaacttatttgcatccggtgctgctcctgcaccaactgaatccataactaaaccaaaaacacgcttgaacttcatatccgtattccccgctttcacaaattagattctagtaaccagctttagcatgactgtcgtcacccgttaagatggctacggttgcactgacacccatccgactggcaccagcatcgatcatagctaaggcttcttcacgactgtggataccaccggaagccttgacgcctaagcgatcgccaactgtttcacgcatcaacttaacgtcttcaaccttagcacctgatgttgagaacccagtggacgtcttaacaaagtcagcacctgctttttcgctcaactgacaagcccggacaatttcatccttcgttaacaacgcattttccaagataacttttagaattttacccttagcgtggactgcatcagctagaccctgaatgtctgccaagaccttctcatcattaccgccttttaattcacctacgttcaagaccatatcgatttcttcggccccttgatcgatggctgtcgtggcttcaaagatttcactttccgttgccatggcccctagtggaaaaccaacgacagcgattggattaacatcagttccctttaattgctcagttacaaacggaatccaataggagtttacgcagaccgaagccgtgttaaatttcttagcttcgtcacaagtttgcttgatatctgcttcagttgcatctgcctttaaattagtgtgatcaatgtacttcgctaattgttctgtggttaatgtcataatatgaaacccctttcatttatcaacatcagcataccgaatcttcgcacaaatgtaaagcgttattatgaatttttgttcaactgattgttttttcacaagcaaatatccgtaagtccccggtcatctttccctaaaactattcattcttttcccgtcaataacggtttagttcaacgccggtttaatgtctattgccaatgattaacccgataatttttattttattcacaaaaaaagatatgagtcgatccccatatcttccgtaatttaccgaagtcccaccgttttcttgcgataaatcgttgccactaatcaattagcctgttgccgcaaagaacgaataaattcgtttttattaccaaaaaaaaggtaatctttcgggatttgataaagctgcgatagtcgctcgatggttttaatgcccacattcgaactgtctcgctcccaagcagccagcgtctggtagtggattcccagatgtgcagcagcctgtttctgtgagtagcccgcattatgacgtgcggcccccagtgtaatttgcaccttatccatcacaaacgcctccttgcaaacacttttatatcataaacgagtttattcgttttgtcaatgatttactgtacatctaatttgcttgtctgactgtgattcgttataatgacggtattgagtttttacactatttcaagaaaaaggagtgaaccattgtgccccgccatgaattatcagcatttgaaaaacatatccgccgcatcatcgctcagaatttaaaatccgcaagttggggcatgacacaagctgagttaggggccaaatcaggaattccaacctccaccatttcggggtattttgcgcaacgttcaacaccaagcccgggaaacgtccaacgcctagccgacgctttgaacatgcccaagtccgcgattgatcctcgatttgatgatcatctgtttgaaaaacagcctggcattgaggatttatacaaacagttatcccctaaccgacaacagattgtcttacacgtggcgcaagaacaattaaccgaacaacgacgacagtcttaacgtctctcattttaaacgcaatcggttctgcccgttaaggtgttgggtttgaacatcaagttgccaattgataaatatcgatcctgcttaaaccatttataaggaatatcgtttcggtctgtcgaaaaagaagcgacacacagtcaatcatgacaatgtgtcgcttctttttcatttaagctaagtaccagtgccgtaatttttgttcatctgtcgcagttaacttaagcgtatcacgtaaataggcggtcataccgccgtattcataatcgattaagcccatagcttgctggtaataatccagttggacactcgccaaatcacgaaccgattgctgaaaattctgttgtcgtggacccggtgctaccgccgcaactcgttgggcgatatgcgccgttgacgctgaatttgtcaataaataatcagccataactcgttgcggtggcacacccagtgctcgtagaattagcatcgctgccatcccggtacgatctttgcctgccgaacaatgaaagataacccccgtctttccctgagtcgccagtaacaaggcaaatagctcgtgataagtctgctgggcttgtggtgccgtcactaagcgacgatagacgcgcagcatgcgatgatacccccccaacggatcacgcgcaaataagcgctgaatttgcgccgttgaagcggcactctccgtctcatcatcatcaaatacaggcagatgaattcgtcgcatttggggtcccaattggtcgggaaattgctgggcctcggcggtcgatcgtaaatcaaccactagcttaaaaccaagatcttccagttgctggcaatcagcggccgttaagtttgccaagtgcgctgcccgcattaagcgatgccattttaccgttgtctgctgggcactcggatacccacctaagtcccgaaaattaaaaccaccatctaattgtaaaacttttctaggcacgtgggttcctccttctgtcaaaggtagtgaaacaattgctaggtgatccccacctcagccgccgtaatttcgcgcgtagtcttcaaccgttcgggttgccgaaagaagagtggccagtgtggatcaatcattaatggtcgcccaatcgcgactaattttgctaccgccgcaactgtttggacgtctgaagcggtccgaatacggccggccaccatgagtggtaacgttgtctcagccgcaataagatcaaccaccgtttgcgttgacttaatcgtaactggttgctgatcgtaacgccgcagcgatagacttaaatagctcagtggtaagtgactcaatagatgggttaataccagactgtccactaaactgagccccccagattccacctcttccggtgagaaacggtagcccacgacaaagggcttcgatgcttgcttagccacctgtaaaacgcgtttaaccaccatcaaaggcactcgcaaccggttttctagggtaccaccaaacgcatccgttcgccggttggataagggcgataaaaactgttgtagcagaaatccattagccccatgtagctcaacaccatcaaatcccgccaaaatagcccgttgcgttgctgcgccaaattgatccacaatggtgtcaatcgcttgagtagtgagcgtttcgggaagccccccgaccccatgtgtggcttgaatagtgctgggcgcaacaacggcggtgccttgagttatgactggattagtcattcgtccagcgtgcactaactgcagaatggctttggcccctgttcgctgaatcgtcgttgcgagctgccgcaatcccggaatcttttgatcatcagccacactaattgagcccattgccgtggatccattaacggcaacgtaggctgaccccacaatatcaagccccacgtacttggcgtgttgctgatggaaataacaatcgtttcggctaacttcaccattaaacagcgctgtttgcgtcgacaatggtgctaagcaatagccatttcgcagagttaattgctgccccaattggaccggatggtcataatcttgttgtctatgcatcgtttcacttcctaaatttacgtccgcgttatttcaggaacatcaaagtttaatagaccatgcaaagtctcaaccacgtcgtgcaaggccgcttctacctctgacacctcaccaaccacgacgacggatccactaaaccgatcaataaatcccagcttaacgttacttgatttagttgccacatcaccagcaataatcgccgcctcactaggcgtaatggttaaaattcccaacgcgtttttaggcgtctgaattcccaatttctcgtaaatatccgccgtggggttggcaacgatatgggctaacgtcacctgtttccccggcacgtattcttgaatcgttcgatcaatttgtctcgtcatctggcgcgcctccttctttcatgcttctttaagtaaggccataacatcgcgagcaatcacaatttcctcatcagttggaataacggccactttgacccgactgtctgccgcctcaatgcttaatgcgttagctgcattcttttctgggtccaatttgattcccaaataccccagtcgctcacagaccatctgacgaaccaatgcagaatgttcaccgatacccgctgtgaagaccagtgtgtccagtccctctagatcagtcgtgtaggccccaatatactgttgaatctgatgagcatatacatcaagggccagttgcgcgcgttgattcccctgtttggccgcctcatctaggtcccgaatgtcatttgaaataccggaaagtccttgtaaaccagagtcatggtttaacatttcccgaacggcatgggaatccatctggaattcttcttcaataaatggaataatttccggatcaatatctccagagcgggttcccatcacaataccagccagtggtgtaaagcccatggaactgttcactgactgaccatcgagaatcgccgttaaactaccaccattgcctaaatgacacgaaatcaatcgatgggtttgctgcttaccaaacaattcagccgccttttcggcaatatactcatgagatggcccatgaaatccataacgccgaataccatgatctttataatagctgtacggcaaggcatacatatacgctttcgcaggaatggtatggtgaaatgaggtatcaaataccgccacttctgtagcgtccggcaacagcttttcaaaggccttaatccccaatagatttaccggattatgcaatggcgacaaaacggctagttcatcaattttggctttaacatcctcatcgacgataactggcttggtgtaataccgtccaccatgcgagattcggtgaccaacgccaataatctcatgcttactctcaattacatgactcgctaacaacgtctcaatgaccgtctgaatagctgtctcataatctttcatcggttgtgcaagcttacttttctttcccgcaatcgtgtaggaaaattcacttgaaggctgaccaatccgttcgatttgaccactaaccagtaccgtctcagctggcataatatatagcttaaacttcagggatgaacttccggaattgatggctagaattttctctgacataaggtcctattcctctctaaactgacgtatttgacgacgaatcagtcgtctatcacccaccgttacaccaagcgggcagccacaatacccaaagtacctggcattgtaactccccgattgatgacggttcttatttaaacgtttaagttaggttgtcctacttaatcacgtgttggtaaatttcagctaaatcatcatcagatggcacaactggattaccagggaaggtggcatcctttttggcattagccacaatcacatcgaccttagctgcagcgtctttgacatcaatgccaaaggcttgcagggtccgaggacaatccatctgtaacatcatttgccgaatgcaactgattaagcgtcgaaccgcaactcggtcacccataccttgagaggccaatccagctttacgggcggcctgtgcgtacttagcacaagcgaccttagacttgctagcattgtagctcaccacgtatggcaagagcatcgcattagctaatccatgaggcacatggaagtttgccccaagttggtgagcaatcgaatgacagatacctaggccggcattactgaaagaaattccggcggcacaagaaatctcgtgcacgcgcttacgagctgcctcatcatcaccatgccggtaacaagttaccaaatcatgcgttataacatcgacacccttttcggccaagccatccgtaatcgtgttggcatcaaccgcaactagtgattccagcgaatgtgtcaacacatccaagccagagtatgccgtcacactcttaggcgccgtcatcaccaattgtggatctaacaatgcttcgtctggccgcaaaaagtcttccataatggggtacttttgttggtgttccggatccgacagcacacagtgttgcgtaatttctgatccagttccactcgtcgttggaatggcaataaacttgtggatgtcttgtttcaacaacttttcaccaaagaagcgaattcccttggcggtatcaatagctgagccgccaccaatcccaatcacaatagttggcttgagtgggacaaattgtttgaccccttcaatgatgttagccaatggtggatcaggcttcacatcagagaagatggtcacttgattagtatcaccaatttctgacaagatccgtttcaacgtgggcgtatccggcaaaaatgcatcgcataccataaaaatagtttctttttttagcaaccgtaaccgttctaggctatcattacccgaatagatggttgttgcgagtgaaaatttttccatactctaagcctcccaagtccgtaatgagaacccttctggcgagttaagccggcgccggcgcgtgtaagtcttagacgttgccgttccttcacccgttggtgtggcaatcgttaaggctgaagccccactatgcgcaccattcgtcgcaacaccagtcccacaataagttgggccgttaaccacgaagattgacgtattcaaccggtgcgctgccttattgatgtgtggtaaattctcggaatgaatggaagccgtgtggtgtaacccaccttcaacttctgtagccgttgctaaaacgctatcaaagtcagggcagcaaacgactggcaaaattggcatcaacatttctgtcgttactaacggatgattcttagctgcttcaagaataatcagtgttggtgttccagtgtaagaaatccctgcttgatccagaatgtaagtggcatccttaccaacaaatttccggtcaggatcacccttaggcccaatggtcatttgcgctaacttttcaatatcagcagagtcggtaactaagaaggccccttcttgttgcatccgcatgatgagctcatccttgacagcggcttcaacgacaacttctttttcggccgtgcagagaatgttattatcaaaggctgctgaatcaacaatgttgtgggctgctaaagcaatattggcagtcgcatccaccattgcaggcgggttaccagcaccggcaccgaccgccttcttaccactgataagcgcttggtggacaacagcaggtcctccagtgattgacagcatggcaacgtcaggatgttgcataacttcttgcacggattcaattgaaggcgtttccagtgaaacgactaagttatgtaacccagttgcatcagccaccaattcgtttaatttttcgatcgtccaacgggtaatgttcttagcacctggatgggcaccaaagaacaacgtattcccaccagccaacatcatgatggcattggcaatcaccgtttcagaggggttggtactaggaccaacggcaccaatgacaccaaatggcgcgtattcatacataaccagtccaccgtcaccggtttcggcttctggctgcagaatttctggaccgggtgtgttataaagggcgttattgagtttggcaattttcgcgctaaccgttcccatgccagtttcatcatgaatccgcttagccatatcctcaatgtatggccggaaaccctcacggatcgcatcaatcactttgttccgaactgagattggttggtcggcgtagttttcttgcgccgcttttgtggccgcaatggcttcattgaccgtcttaaagatcccatttttgccgggaacggtcgcattggtggccgttgatgactgaggattgctaagttcttcactcaaaattttacgaatggcttgttcaatgttttctgtgttcatgcctatttactctcctttaaaaaggcggcgacggctgcctcacaaattgattgatcctcttcgatcagaccaccgctgaccccaatagcaccaatggccgtgccattgatgactaatggaataccaccagggaatgagaccaacttaccatctaacatggtttccatttggtacaatggcgcacctggttggatgtctttgctaatttctttagttggttccttcatagcgattgccgaccaagccttcttaggggctagtgtggagctgaccaagtttgcatttggcatgtgatataacatctgtggtaccgttgcctggtccatgatgcaaatcgtgaccccaacctttaattcatcagcacgggctaccgcagcatcaattaccttttccatcatatgacgatcaaataagttcatcgttgtgcctccttgtttggcaattacatcgcgaataatctgactcaattgttcttcattcattttttatcgccccactgcttgagcataccgtttcatcacctgatcagttagctcattgacttgatactcatagtcctctgaacgggccatgatgtaaaagaaatcggataaacggttcacgtagcgctcaaggacgggacgaacctcaacatccgtcgaaaatcggacaaacatccgctccgctcgtcgacaaaccgttcggcaaatatgcaactgtgctccagccaaactggcacccggtaaaataaaactggtgactttaggtaattcagccgtgtagcggtcaatcacctgttctaacatagtcacatcatcatcggtaatcacccgactgttggcattaaatttaccagcagtctgtgtggcaatttcaccttgaagaaagaacatcttgtactcaatcttctgtagaatggctttattctcggctttcacacagaacttatctgccaggctaacattggcattgagctcatcaaacgtcccgtaagtgtcaactcgtaaggagtcttttctcacccgtgtaccgtcatataaactcgttgaacctttgtctccgccttttgtgtaaattggcatcttgctatctcccctctacttatcaaagcgatcaatgatcccaacgatcgaacaatcattgacatcacgcgtcgcctcttcgttgcgattagcacgacgggcaccagcgccacgaacgagtaacacgtactcgccaaccccagcaccaacagaatcagctgcaacttcctgatgacgaacggcttgcccatcggaattaacgggttggacaatcatcagcttccggcctactaaggacggatccttttgcgtcgacacgacgctaccaattacttttgccatatacattcttcatcagtcctcatttgtagtttcatctgcttcaccgcacgtacagtactggcctcatccgttaatcgctgttgcggcgtaaccaccacaatcgttttatccggtaaagctgccaacactgaacgggaaatcaagcgcggatacaccgccttaatcggttgtgcctggggagttacaaaaagtaacggccagtctaacaacatgcttcggggaataaagttaatggctaactcgttgatagtgaattgaaaatccacctgataatcaatcccttgtaacacccaggcaacccattgattatcaacgttcatgccatacagcgcatgaatcagttcaatcgagacattggccaccgtaacggttgcgttgtccaaaaagacttgtgttgagggcgctgccgccgtgcgatcataggtacagtggtacgtctgctgctcgcgtcgcttaagtttatttaggacttgcgccactaacggttccacttcgatcaccaacttcatctaaaatttcgcttaacgccttacgctttcacaattttaccgaacgtgttgccatcaacattagcggcattcgcttcgtccgtatcaatgtgcatttccaacacaaaatcttctcgtggccgacaaataacgtcattgtagatagtccgccgatcttgtgactgaacttcaacggaaaccgtatcgcccaacttaacaccgaaacgtttagcatcttcattactcatgtggatatgccgcttggcaatgataacgccttgaaccgtgacctcaccatctggtgtcaccagcttaaccgatggcgccccatccaaatgaccagatagacggattggggctggtacaccaatgttcagagcttctgaacgggcaatttcaacttgtgagtgtgcccgacaaggtcctaagacccgcacatgtttaatcgttcccttgggtccgacaatatccaccgtttgctttgacgcaaattccttaggctgtttcaacggcttcaaaaccgtcatttcttgattgggaaacagcgtattaaaatccgcctctgtcaagtgaatgtggtggttggaaacaccgattggaatacgatcaggatccaattcttctttgataatacgttgaactaacgctcgtaaagctgtttcatccatagttagtgccacccttattcattaaaaattattttgcagctggtttgctcgtcttaggtaagatgttttcaacttctgcgtgtggacgaggaataacgaatgagctttggacttccccaatgttttcagcggcagcaaccccagcatcaacggcggctttgacggcaccaacatcaccacgaaccatgaccgttaccaaaccactaccgatcttttcttgacccatcatttcaacgtttgctgctttaaccatggcatctgccgcttcgattgaggcaactaaacccttggtttcgatcatacctaatgcgttattcataataatttcctcctaatagttagctctgtttatttttgccaaatagttcttgataatgcaggcatttcttccgtggctcgcctaacttccgtggacacttaggatctccacataagttacaagtggcctcagcttcatccttggttaccgtgggctctgctggcgcctcaggggcgacgtcagtgacctgcggttgttgcggtgtttcttcatttgtggacgtttctggtactggcgcgaagatcggattttggcttaaatcgctaatttccggtgctgggttagctaagacagttgaactgacataatccgttccaaccgtttgcttccccgtttctatcgccaccgaaacggccgctacatcaccactgatgatgactgttacccagccaccacccttggtgttttctaaccctactaggttaaccgctgccgtcttgagcatcttatccgccacaacaatggcacctggcaacccggtagtttctagatatccaattgcgtccatcttttctaaccacctaatctaatgtcttaaagggcacgcccttcaccaagcgagctgcattagcacctaaccggcgcaggcggtccgccgaatcacgggtcaccgtgaataacggctgctcggcatgcaggttcttgtagtgaacaaccacatgctgatcgtcaaaaccaatgcccacggacaaccgtgaagccaaagccgcctgataagcgcgcatggtgacatcgtcttctgcaatcaccttggtctgtaccggaatggcttcttcttcaatcccgttaagtaacggtttcaaagtcaccggtaaatcggacgccgctgtcggcacggcaataaaaattgccggcttatccattgtgttggtcataggcgtcccttctctcccgggcataagacaggatcaatcccgtagcaaccgcatttcgcggtccttcaacggcccgaatatttccccgtccggcaacaaggttatagtgagacaactcatccgtgaccaattgtgggatttcaaagtccagcgccgatcccccaacgatcacgacaaacggaatgtcacggatattaccagtgggactcacgtgttgtaaggcccgccgtgcattttccacaaacacccgcttcttagcggtctggcgaatctgcttaaccttttcaatgttcatattccctggcaatgggacgtaaccgtccggcttaatgaccactgtgcgggcaaaaatgtctgctggcagtgggtcttcaaaaaactgaaccgtgccatcttcatgccgaatttggaatagattttcaactcgggccagcggatatttcttaatatcctcggccaagtacacatcgtctaggcctaactcagaattgataatcatggtgaccatgtccccggcaccagccaagtgaatcgccacaatatcatcctgctgattgataatcgaggcatctgttgaaccggcacccaagtcaagaatcgcaatgggcttggttgttcctggtgtcgtcaaagctcccaagattgcggcctcagcttcagctccgccaatctcaacggaaatgtgaagctcgtcttgaatcaaatcagcaatctgttgcatctggaggtggtcagattttaccattgcggcaatcccaacggcttgttcggttgagaactcgccagccagtccaccttgtaccttgactggaaccgccgtgttgacggctaacagatcttgaatagcgatatcccggttctgtttattggtgaggtccgccatcgtctgccgaaccttttccaacatcccaccaacattggttcccgcttcacctgtaatatcttgaatccggtcaaactgattgaccttcttcataattgcttcagcaccagcggccacgttaaccttatcagaatctcgatcaccttcgatttggatgctcccggccggaataacccgggccttcacatcccccttaggcgtcttgatgaccaccgcagaccggttgccaattaacgcccgagaaaccggcacgatgtttttggtttcgtcggctgtcaaatcaaagagtgtggcgatcccatacggattagataactgcgaaataacttgccctttaccagcaacctcaacgccagccatcatccccatgggaaccttatcaatccgcgccacttcatctacaatcggaattttgtgttccagccggttatcaattaacaccccatcatcattttgcaagatggccgcatttatttgataaccactttgctggtacagattgatcagcttagccgcatcttcgaaatcaacttcagccggtaccagaacaatatacggacgtgtcttatcggtttcttgaagcagttgtagcaaactcaccgtatagccagaaccaataccgacgccacctggtgtgttcgggttgtgcccaatcatcgtagattcagtaatcactgtttccgtgatggtttccatcgccacatccccaataaccggtgttgcttcgttaatccgaatcaggtcaatatcactcaaggctaaatgacttttatttaacacctgcgtaatggcttttttgatcccaatgaggttttgcttagttcctttgatccccgtggtctctgcaatgtcagaattgataaaatcaaccgcaccttgatctgaaatatcagccaaagcaacttccgttgaggaattaccaatatctacacctatcaccttttgcatacgaagactcctaactagttatcacccttcagcttcttacgggattcgtagtagtcggccgcttccgcaaaccatccggcgttcactggggcatgatatttatcctttaactcggctgaaatcgctaataattccgctttagtagaccggtatggtcgtaaggcgttgtacatttccagtaaccgatcatccggaatagaggtcaattctgacgcccgctggaagttacgttgaaccgcatcccgaccagcatcgttggccacttcaccttgcatccgtaaggtatccggcgtaattcgtaaatcattggccttaatatcatcgttgagaacattatccaaagtgatatcgttcaaagctttcccagacggtgaatgtacgagctctgggtgcttagagtacagtggataatcttgtttcgataatgctgcatgctgcgtctgcgtcgccgttgacgtaggcgtggcagtcgtctgatcagcggcctcagtgccaccaatttgttggacgatttttgctactaagtcatcaatttcactcatgacccattcctcctagttaaagttgacttcgatttgttcagcgggtttccccataacgacctgcttcgtttccttgatatgcatcaaggcagacaaggcctggtattgaacccgagccatttggtcattaaccgttggaacggggcttggtgacattcctttagcgtattcggctgcattcttgccgatagcccggtaggtatcaccatccaagacaggtgcttgtgggaataattccaagttggacaatggttcttggtccttttggtgaatgatcgtcgtccccttggattgaatggcaatggcgatgccagaacctgataaatgatccccttcggcaccacagaaggaaacgtcagaagtccggtagactttcacaattcgggccttcagtccttcttcttcaataccagcaaccatctgtcgtaaaatttctttatgactgattccggtcaagttatggtccatcacttctgcaaaggctggtgccacagcaatcacgacttcatcacgtgaatagccgggcttggcaaccccaacgtgtttgaaccagtcaactggtttttccggttctgggccgtcaccattaactggtgcagccgttgccgtcgtagctgatgacgctgctggtgcatcagctttaaatgagattggcgtgtcccccgtttgggtttccgcaatcacatcacggataatattccgcaataagttttcatcaatttcttgagccacagtgttaacccccttttcgactaaagctgcatgttttgtggatcaatggcaaacggtaagttcttgatgcgttcccattcttccgtatcttcttccaaccggtaacccgtaccaggaccttgatagtcattggcatcgttgacggcggaaatgacatgccacttgctgtcgaaaatagcggatgtctgtaagaagtccccacaaaccttttgcttttgcaaatctaaaacggcttgggcaacatccttaaatccgtggttgaacaaggctttaacaatatcgaccccggtaatgccgcgatccatcagatcttgggcggccttcatatcttcaaccatgttccgttctggcatatccttagaggtgttggcgtaagttgccgcttccacttcttcatcggtaatcttaggcaaacctagatcttcaaagacaccttgaagggcccgtgcagccttgttgcgggctttgatgattgtttgttcatcaactgggtgaatcccaccgttgatggccaagtcgcgttccataacgtagtaatcatcgtagtccaagccatcggtgtttgaccccgcaaacgtgttgtcatagttaggtgttgaggagtaaccagaagaaatgtaatcggttccggcaatgaattggcctaataaccgttctgtccgccgcatatcagaatgggagaacgcttggtcattagcagacgcacattcaaggtcaagcatcatgcacaataggttttcacccaagacggagcgaatcccagaaggaacagaccctggaatcccaatacaactaaccccaccgttttggaggccttgaacaccggacgctttggtaatgaagatacaacgtgattcgaggtataacatggacttaccttcggtataacccatcataacttcggaaccagaaccagacgtaaaccgcatcttcaacccccgcgaagcatagcaggaagctaagaagcctttggaccatggtgtatcatcaccatcagtgaagaccttatcggtaccgtaaacagaaatggtttcggcgtagccagtgaagccccgcatccctaaactcaattcttctgcttcttcaaccgagcattgggtgataacaccaggacgaccggtttgcgcccccaccatcagcgagatggcattcaatggggcgtaccgggcaacggccgtcgtggtttcttgttccgggaaaccccgtaaggcagcatcggcagcgtcagcagcaatttgaacgggattatcccgaatattggtaacgtgacattgcgttgctggtgtccgccgtggccgcattttttgcgttgccataatcatttcggcaaagttcaatttgctgataacttcttcagctttggccggcgtcatcgccgttgtaatctcaatgatgtctttacgtggcacattggggtcacagagcatattggcgatcttagtggaatccatcgccattactttctcagcattttcaagcttaatgccatattttgcgatgtagagatcaatcagatcgaagtcagcagctggtttactatccatttcagtaaccttgccgttttcaatcttgatgcttggctttgggtcattaggccccatcatggcaacgaagccttcttcaggccattccttaacgaaaccgtctaaatggatcgggcgtttctctaattcttcaaatcgtttttgacgtttcaattaaaaatccccctttaacgaatgtaggatggaaaatcattaactggattttcacctaattgcgctaacagtttcagaccaacttcacgaccggcaatcacggcttgacgaacggcaccggaatctccactgatgtggacaatgccttcgttagagaagctggttccatgacctggagaagcaaaggtcaagacgttgacgccggctgtcttaatagcggtatcagccatcacaaccccaattcctgaaggtgccccacagattaaaccgtaagctttaccctctggagcaccaaaggccatgtggcaagcaccggcagcccgggccgtgaattgcagttccaaatgcccggcggcggaattatacacatcgccgaaggtacgacttaagttatctagggccacttgaatggctgaccgcacatcagatggatcatacccaccaactaagattaaaacgccgtgaccagcaccacctttagtatcccgtggcatttcaatatcaataacctcggtattggtggccttaacggcttcatccatcgccataatttgaggaccagcacccgtgcgggaactaagaatgccaatcactgtaaagcgtttttgcacatgcaaatgatcgagcaataaagcatcaacactaggaatacacataccaatcgtgtcgccaatttcactcgctccgacaaattctggaacggtgctcgttgaatttaagaagttatccattatttttcctcccgatgactgcgaggccggtttaaccgtgaccccgtgacgcagaagttcttccatgatttgattcattaactgctgattggtcatcatttatttacacatctaagatgctatttcttttgaggtaaaatcttttcaacatcggtgtgtggacgtggaataacgtagctagatagaacttcaccaatgttttcagcgccagcaacaccagcatcaacagcggccttcacagcaccaacgtcaccacgaaccattgtcgttaccaaaccatgaccgatcttttcttgtcccactaaatcaacgttagcggccttgaccattgcatcggcggcttcaattgcagcaactaaaccctttgtttcgattaatccgagtgcttcttgttccatgataaaacctccatttattggctgggcaacccacgctgcccttcttctaaaacgctttcattatatttgaatggtttagcactatttcaaccgaaatagcacatttaattacaaaataatcaaaattaccgaattcagctactaaaagctcaatattttacaagcagttagacaaattgcgcttgatatagtaatctgtttaacttacaattaattcgtgataccggattcattactattttgtcagtgaatcccataaaaagtcatttaattatctaattcaaattccactcaatctgggggctgttactatgaccacttattcaccaagtcaagaaaattaccgtgagttggcacatcttttagcacgatttaccagtctgacacagatcaagaccatcttttacgattttacgggaatcctcttaaaggatgactttgtttacattaatcactcagctattgaagataaccttgcccaattaactttctcggattatgctatttttccggttagtcgcaacatccagatgtggggcgccgttctttgcgaaagcgtgaatgtttctaagaagcggctatttttgtcccgctcttatctagagaatttgatgacgcaaatttttgatgaagatacgttgggtaaggtgagtgtctgggaacccctcacctctgatcaggtagggcaaatcaataatctccatgcacttttccatccgactggtgatactgatccactacaagctgtcttggcgcccaatgccgtcattgctggtcacacgattgataacgatgaggcgttccgcagtatctcactggcgattgactatatccaaaagaacatccaacgaccgatttcgcttaacgaagtggctcagcgcgcttacttatcaccgtcttacctcagtcgtttattcaaaaaataccttcacgtcaacttcatcgagtacgtgaataaccaaaagattgccttggcccaagaaaaactatccttaaccctgacccccatcaatcaaatctcgaatcaaattggctttacacaaaccagttacttcacgaaaatttttaaaaagaaaacggggatcaccccatccgaatttcgccagcgcaatcatacaattcaaaaaatctataccattccacgtgaactcaattgggacacgaatgactcggtcattgatgtcaccaagaattacttcaagtctcatcacattacctatcacaccgattcagaagaaggtgcgacgtacgttaatagtatcggcgaattaaacgatgctaagggaaaccgcggttggatttacaccgttgatggccaacagccaacgcaatctgctgatgaaatcgccacacatgataaatcagtcattcagtgggtctataccgactactccaattaaaaaagagcgatagccagaatttatccggttatcgctctttaattttgatcaattatttcactaaaacctgtaagccagcagccaaaatgccaccgacaatcgggccacacattggcacccaagcatagctccattcactagaacccttgtggggaattggcattaatgaatgcgccaaccgtggcccccaatcacgggctggattcaaagcaaaaccagtcgtggttccaagtcccatcccaataattgcgattaacattccgacaataaagggtttcagaccttgcgtaaagtcacctaagttcagcaaaataaaaatgaatgcccaggttgcaatcacttctgataggaagttgaacaatgggttggcaattgctggtcgtgtggcaaagattcctaccgtgttgccttcttcaacggacggagtcgccttgaagtggggataaaattgaataataactattacggcacccacaaaggctcccaaaaattgccccaataagtatggcaccacactggaccatgggaagaaaccaaagaccgcaaacccaattgtcaccgccggattcaaatgaccatcagaacccagggctccagctacgtagactcccattgttaccgctaatccccaggcaatactaataaaggtccaattactaccgtgaccataggttttcttcaaattagcacttgcgccagttccggcacctagaacaatcagaatcatcgtaccaaaaaactcaccgataaaaccactcatcgtaaaacacctgcccttatcatattgatgaaacaatcgtagtttagcataaacgacccccgtatttttttcagctaaatggaaatttttgctttatttgtaagcggtatcattattaatccattttagccccagttagtcagctattttatgattattctgccactgcttcaccacgactacaaaataatcttaataccacggatcagtcgtctaaataagctcgtaactgatcgacattagctcccgtcagtccagatacctgaaaaacttgtgtggccccagcctgacggagctgccgctgcgcccatgcaatatccttatcggtggtcactaagtctaatttggtgaccacccccactaccgggcaaccaaacatcgtagcaaaagcttctggaaaaattaaccgttgatctgttgcactctgaatgagaaccacgacgttagcatccatcgccgtagtagccaaaaaagtatacatctgccgatgctcaatgtattctcccggtgtatcgataatgttttggaaaaattcaaccgattgcgtcttatcataagcaatcgtctggtgctttaattgctgcaatagcgtggtcttcccacagccgattgcgccgacaaacatggcccgtttcatcaaaccacgccccctttcaattagaaacgcttacatgtttaattctaagtcaaaataaattaaaagaaaggctggttaatctggcacgtttgtggtattagaaaccgactattattaaaaaagtaatgtccatttttccacaacggctattatccatgtccgaccacagtaaaaaagccccaaccattttttcaagaaatggttggggctaagcgtctcagatatatatttagtcttttactaataccgtgacactttccacatgtggcgtttgagggaactgatcaactggttgaacgggaccatccacgtggtagcccaactcagtaaaacgggccacatcacgaaccaacgtagccgggttacagctcacgtaaacaaccttcttaggcgccatcttagcggcactgtcaatcaagctttcagccaagcctttacgcggtggatctaccacaataacatcaggcttaataccggctgcttgccactcagccatctggtcttcggccttattcacagcaaaagtcacgttactcaaatgattcttttgcgcattcaccttggcatcttcaatggcttctgggacaatttcgaccccatacacttgcttagcgtgcttagctagcgccaaagaaatcgtaccaatcccacagtaagcatcaatcacggtttctgcaccagttagtccggccttatcaatcgccatctggtaaagcttttccgtctgttggggattaacctgatagaaggaccgtgctgaaatggcaaaggtcaagcccatcaacgtatcctcgatagttggcttaccgtaaagcacccgcgtcacattacccatgatcacattagttttcttggcattgacatttaacacaatgctcgtcacttctggcaaagcctgatggatttgatcgaccaattgtgcctgactaggaattttttgagttcggctaatcaaaacaatcatcatttcgtggctgtagtagccccgacgtaccatgatgtttcgaataacgcccttgtcactcacttcattataggctggaatctcaaactgacgcagtaaatcccggaccttgatgattgctgcatcaatcgctggatcttgaatatagaaatccgtcagtgggatcagttcatgactgtgctgccggtagaagccggtctccagttgtcccttaaccatccgtaccgggacttgggccttatttcggtactgcgtaggattgtccatccccatcgttggtgcaacctcaacgtcttgatgggacttactgaaaagttccgcaatctggtgttgcttgaactttaattgagcgggataagccaaatgttgaagtggcgcaatccccgtttgccggtaagtcttatccacatccttcacccgatcaggtgattcctgcgtccaagcaaccgctcgagcaaagccataatgactctgtactttggtgacctgaaccgtcacttcttcacctggtaaggtattttcaataaataaggggaaatcttccaccttagctacacctaatccttgataggttaagtctgtgatggtcacatcaagccgttcatttttactaactggtgctttacttttcataattacctcaatttcttagatgagaagagagattttgctactgtcgtgtcgtgcaaaatccctcatcagtttcacttatcctttgtgatcgaatccgttgtttcaggtagcttttccacctgtttaacgaacttttcttcggcttctaacaactctgccgactcactcgttaccgccgaatctggaatagcatccaaattagcatacatttcaatgtgttgccgtagattatggaatttcatcggggcatcgccaccatattcgccgtccaaattaatcatcatccggtcattaactggccgcgcgatcaccttactggttttctcgtaaataatgtgggggtcattgatatgtttgccaccgttgagcactaaccccatcaaccgcaaaatttccggcatgctggccgttttgacaataatcatggtaaatttaccatcatctagagccgcatccggtacaatttgttcaaatccaccaattgaattcgtcagtgccagtaaaaacatggacgcttgaccacggaaatgcccaccatcgtaggttaagtccatttcaatcggtttgattcggggcaacagttcggccccttttaccaagtacgctagatagccaaagatcgacttcaaattcgatggaacatcataggttaattctgttagtaacccaccaccggcaatattaatgaaataactatcaccagcctgaccaatgtccatcttaatcatttggttctttaaaaccactttagcggctgccagcggatcttcccgtggaatgtgcagtgcccgggcataatcgttcgtggtcccagctggaataatggccatctttggtcgatgtgccaagccagctagtccgttcacaacttgattgatggtcccgtcaccacccgctgcaacaatgagttcaaacccggccttagcggcgcgagttgcttcgtcgcgtgccgaattaggggctggcgttgtggcataggcacttgtttcgtacccggcctgttcaaacaccgctaaaatatcgatcaagtctttcttcaacgcctcgcgccctgaagtcgggttgtaaatcacccgtgcccgtttacgcatgctgcgcctccatttgttcttattgctgtaatgctgccatcaacagcttgttgacgacttgtgggttggcctgtccgtgagtctgtttcataatctgacccactaggaaaccaaccgcccgttttttcccgttattgaagtcttcaatcgactgcgggttagcactcaagacgtcatcgataatcggttgcaatttagctggatcggatagttgaaccagcccattggcctcaacaaaggccttgggatcttcaccctcggtaatcgccttgaagaccttcttggccatcttgctagagatggtcccgtcagtaatcaaattgatcataccagccaaatgttctggtgttagcttggttgcttgcaggtcgacttgcttatcattcaggtaggcgttaacgtccccttgcaagtaattggctgccatcttcggatcagctttcagcgcaactgttgcgttgaagaagtcagacatttccttagtttgggtaatgaccatagcgtcataatccgtcaaacctaactcgttaacgtatcgttcgcgccgcttccctggcatttctggcatggcggcatctagttccttgatccagtcatcactgatgttcagtgctggcaggtcaggttctgggaagtaccggtaatcatcggcaccagccttcacccgcatcagaatcgtttcaccggtcttttcgtcaaaccgacgcgtctcttgttgaaccgcgccacctgacattaagacttgttgctgccgtttttcttcgtattccaacccgcgttggacgtaattgaaggagttcaggttctttaactcggtcttagtcccaaatttctgttgaccaactggccgaacagaaatgttgacatcaacccgcatagacccttcttccatcttcacatcagaaatcccggtaaattgaatccgttgccgcaacgcttccaaataagcgtaggcttcagccggtgacgcaatatctggcttcgacacaatttcaatcaacggtgtgccttgtcggttcaaatcgacataagagtaatcccgttcatgggtgttcttaccagcatcttcttcgatatgcatttcagcaattccgatttttttcttgacgccatcgacgtcaatttcaacccaaccatcgtgaccaatgggcttgtcagattgcgtaatctggtaggccttcgggttatcgggataaaagtagttctttcggtcaaaatgggtgtgttgttcaaccgtcgcatgcaacgctaaggctgcaatgatcccgtcggcaacgacccctttgttggtagttggcaatacccctgggtacccccagtcaatcacgttcgtattggcgttagggtcagccccgtaggcaactggtgatgggctaaagatctttgaatgggtcttcaactcaatgtggacttccagcccaatcgtggtttcaaagttcattagtgttgacctcctaacgtgggaacttgtaaatgaaagtccgtattttgctcaaaggcgtaacccgccttatacaacgtgctttcatcaaatggccggccgataagttgcataccaaccggtaagccttgactgaagccagctggcaaggacaagcctggtagcccagctaagttaactggaatcgtcaagacatcattcatatacatcgtaattgggtctttgatttcgtcgccaatgccaaaggctggtgttggcgcaacggggcccatgataaagtcatgatccttcaagacagccttgaaatcattcatgataaccgtccgcaccttggctgctttcaagaagtaagcatcataaaaaccagctgataaggagaatgtccctaacataatccggcgcttaacttcgtcaccaaaaccttcagaacgtgacttcacgtaaacatcttccaaattcttcacatcgtcggcccggtgaccataccgaatcccgtcaaaccgttgcaagttagatgatgcttcagacgagccaataatgtagtaagctgcgacaccatacttgttatgtggtaaggaaacttcatccaccgtagcacccaattgccggtacgtatcagtagcagctaagatcgcctgtttaacatcatcagcgacaccatctgccaaaaactccttgggtaagccaatgcgcatccccttgacactcgttgcgtcggttaagtctgccgcaaagtcagggactggttgtgtcgaactcgtcaaatcatgctcatcatgcccagcaatggcgcttagcatagtggcattatccttcacgctgcgcgtcattgggccaatttggtccagactagaaccaaaggcaattaagccccaccgagaaacgcggccataggttggctttaggccaacaatgccgttaaatgcggctggttgtcggatagaaccaccggtatctgagcccaaagcagccaaaacttgaccggaagcaacggccgccgccgaaccacctgaggacccaccaggaaccttggtataatcccaagcattcttggttgtcttaaaagcagagttttcggttgaaccacccatggcaaattcatccaagttcgttttcccaaccgtaatcatctgagcctgggctaatttttcagtaaccgtggcatcatagacggggttgaagttcgctagcattttagaagcagcggtcgtctttaggcccttcgtcacaatgttatcttttaatgccactggaattcctgccagtggttgatcggttgccacaccttgttcgtcaatcttagtggcttgttttaaagcggcatcttcgttcagcgttaaaaacgcatcgacctgagcatcggtcgtcttgatattgtcaaaagttgcttgcgtcaattctcgggcgctgatctttttagcaaccaaatcagcgtggagactagcgagatctgttttaaagtaatccatttagtcgttatcctcgctttcgtcaatgatggccggcactttaataaagccccgggcagcttctggcgcgtttttcagtaatgactggctttgaccccagttatcagcaacgtcttcgcgcatcacattgagttggtccgtgacactgctcgtggcttcaacgccgtcagtatcgacttcactcagcgtttcaaacagaccgataatgtcgtcaagttggggtgtaaaagcatccaactgggcatccgtaaattcaagttttgccaaactggcaacgtgttgaacttgttctcgattgattcgattagccatcaattatccctctttctgatttatccacaattcagcgtttacccgcagtttctgagaataaacatacactgccattctaccatatatccgctgtacgccaaagattatgacaaaaagaatcttgtctcacggtaaaatggctacttattggtgataacactgggttaagcggccattaacacggagatatagacagcaccttattgggataagtacaaccatgagtagtagcaggcaacgccaatactaacgttcatcaataattagattactatttctagcaagtcagaattgttctagctgaacttggcacttaaccagattaccctgtcacaccacggtagctcggcgggaagcggcaaatgggcccagtaccgtcgttatccttagcgcgtgtttttagcgtaggataagaccgacctttaagacaagtgccctgcttggcttaaagtcgtgtccggtacgttccagcccatttgtcgcgaccagggggcggacaatcaccacccagtttaaaacacaggaattttctaccgtcattatctttttgcgcgtgttttttagcatatttaggataacaatctataaaccaaaaaggcgtgcacgccgtagcccacacaccttcgaaattagatttaataactgttaaagacgtgactcgtgaatttctttgccccactagaacgggaaaggaaactttgcacactatccgtcgatgagacggtaatgtcaatgggcacacttgatggtaagtacttctgtgccgccgtttgcagatattgcgtgaagctaatgatttctgtttggctgtagaattgggtcgtaatattgacgtgcatcccagtcaatgtatttccactgtaatgggcttgcgccgtcacaccactcaagttcgggaagaagttttccacttgcgacttgaagttagtaaaggaggtttcatcgttactgttcgggctactagacccactttcaattgggaacacgtagttcttttcactcaaagcgttccacttagaaacggtcgttgcacttcccttattctcagaataagcgatgaagttaccaccgaccagactatcattggaggcctgccgatagattgcaatcacgattggcacgttctttaacgccgacttcttacggagccgttttaagaccgtattagccgccttcttcgcgtaagcttcaccctcagctttggtaatcttggtctcataagtggcaccgtactgggtcttcttataataatccaccgaattgacggcaatcccaatcgttacaccacctaaagaaagcttattattcttttgggtcatatagtcttgttcttccaacgcttgaatgtaaactggatttcgcttcgttggtgatgttgagccgttactcttcggattcaatccagttggatttgatttggtctttcgatccaaccaattttgaacagttgatgagcttaaatactggccttcttggaaaacgtagctcttcgtagagaagactttcttagaaacgcctaacataccattttcaaaactcttcacgttgtaggtattgccagaatcctgactattggttaccccacgcgacttgctcgtctggtaatgaccactcttaataaccccttcatagtcaccatccgagctttgccccgtcaattgggtcttacttgatttgctggtcccagacgttccagaaatgctggaactgcttaaattgccacacgcggccaaaaataatggcaccgcggctaacgcaataaaggttcgtaaccgtttcacgacttgtttcctcctaaagtcatcatttcgtttcatccatggctgcttgcaattgcgcttcattccacacgggaacgtcgagtgactgagctttggctagcttactaccggccgcttcaccagcaatcagcagatcagtcttcttagacacactgccggtcactgtcgcaccgtgttgttctaaccattcagttgcttgtggacgcgtcaactcttgtaactttcccgttagaaccacccgcttacccgtaaattcactcgtcgaattggtggcgggtgtcccactggtataagtcatattgaccccaacggcttgtagtttagcaaccagttcatggacctgagtattagcaaagtaggtgaccacactatcagcaatgatgccccccactgtatcaatcgcggagatctgctcactgtcagcggccattaaactcgccatatcaccaaacgctgctgccaatgatcgggcagctttagctcccacatggcgaatgcccaaaccaaatagcaaacgttctaatgaattattgcgactattatcaatggctgtcaagaggttttgggccgacttctccccaaatttatctaaagttaataattgatcggtcgttagccgatacaaatcagccacatcctgaaccaaatttcgatcgaagagctgggccacaatttgtggacccagtcccgcaatgttcatcgcatttcgggaagcaaagtggttcatcccttcggccaactgggctggacagcggggattaatacagcgtaaggccacttcgtcatctaaatgaaccaattcagctccacaggatgggcaagtcgtcggaataacataggctttcgcttcagccggacgctttgccgccacatattgcgaaatttccgggataatgtcgcctgctttatgcaacaacaccgtatccccgatgcgaatatccttagcaatcaaataatctggattatgcaacgatgcgcgagccaccgtactcccagctaatgccacgggttccataatggccgtgggcgtaaccacacccgttcggccaatggtccattcaatgtctaacacccgggtctgcacttcttccggcggaaatttatacgcaattgcccaccgcggaactttcacggtcgctcccagggaacgctgtaagggcaaatcatttgccttaatcacaataccatcaattccgtaggccaattccgttcgctgtgcttgatacgtttcgatataagcagccacgtccgccatatcatgggctactcgataagtggcattagtcgtaaacccgagttcggccaattcatccaacaaaccactttgcgtccgcgtggtcagtggctcatagtcggccacgttatacataaacgtggctaattgccgatcagctgtcacacgcgtatcgagttggcgtaggctcccggccgccgcatttcgcggattagcaaatggggcctgccccgctgcctctcgtcgctcatttaacgccagaaaggcggccttaggcatataacattcaccgcgcacttcgattgtcagtggccgactaagcgtttggggaatagacttaatcgtcttcagattagccgtaatatcttctccaatttgcccgttgcctcgggttgagccttggacaaacttaccattctcatacctcaacgaaatcgctaagccatcgatttttaattcacaattataatcaaatggtgtatccacgttgcctcgtagtcgttcatcaaattctgttagttcatcgagtgagaaaacatcgcctaatgacagcattggaatatcgtgagtgaccttaggcaaatcacttcgcgaactaccgccaactcgctgcgttggtgagtctggcgtaacaatttctggaaaggccgtttctaaggccaccaatcgagcatacacgcgatcatacacgtcgtcttcgacagatggggcatccgcttcgtagtactgcttcccccactctaataattgtgggcgtaagtcagcggcctcctcggcagcctgctccacggttagcgtcttaatgggcttatcagtcatctaattcctcccaaactttaaatgcttagtctacgcgtttgattggggcaaaggccgccaataaacgcttaatcccttgttctgggaatgcaatatcgagttcggcatcttcgccagtaccattaactttgaccacggtacccacgccccactttttatgactggctttatcaccaatcgtccagctaaccttaccagcacccgttccggttggttcactcacccgcccagtcttaccagcgtatggcttcgcaaccgcactggccgttcgccgagcaaatggcacatcccggcggctcggtgtcaaaccggatttagtttcactgtagtccaagtgcagcaattccggtgcaatttctgtcacaaatcgggattggggattcgtttgccgccgaccatacaacatccgcgaataagcgttggtcaagtagagcttttcttgcgcccgcgtaatcccgacataggctaaccgccgttcttcttccaattcatcatcttcaagcattgcccgtgacagagggaagataccttcttccagccccattaagaagatcaccggaaattcaaggcctttcgccgcatgcaaggtcattaaggtcacctcggcgggttcttcttcaacgtcatcttgggctgaaactaacgccaaatctgctaagaactcaaccaaccggtcttccgtttcatcatgatcggcgttgtcccagtcatcatcgaacttttgcgtgactgatagaaattcctcaatgttttcgattcgcgtttcggcctctagattctttgaggccttcaacgatgccatgtaccccgtttgatccaataactcactcgtcatatcggaaacactcatggttgccgcgcggtcttgaacatgtttgagggttagcccaaacttctccatcgccgtgcgcacacgagcactcagcgtcgtggctagtgaaatgttttgagtggcttccagttccgtccaatcgttcatttcagcaaagtcccgcaacttttcaacactcgtggccccaatacctcgtttgggctcattaataatccgttccaaactcattgagtcagccggattggccaccagagtcaagtaagctaaaacatcccgaatttcctttcggtcataaaacttatgcccaccaaccatggtgtagggaatgttggccttaactagtgtttcttcaatcacccgagactgggcatttgttcgataaagaatggcaaaatcaccataatcatggtgattttgttcccgttcttcttgaatcttggccaccacataatgggcctcatcattttcgttttgcccccggtaataggagatgggttcaccttcggcattatcggtccacaaatcttttttcttacgattaacgtttcgctggatcacatcgttagcggctcgtaaaatcgtcttcgttgagcgatagttctgctccaataaggtgacgtgcgcatccggatagtcgtgctcaaagttcaaaatattttccatgttcgcgccacgccaaccataaatactctggtcaccatcaccaaccacacatagattgccatgctttttcgctagtaagttcaccaaggtgtattgcgcatcattggtatcttgatactcgtccacgtgaatatattggaatttatcttgatagtaccccagcacatcggcatcctgattgaatagcttaatggtcagcataatcaaatcatcaaaatccatagcctggttcgcctgtaattctcgttgataactttcatacaccgtcgcaaccgtcgtttcaaatggattaccggctgcctcgcgcatcatggctggcgtctgcagggcgttcttggcattagaaattgctcccaatactgagcggggatcaaacttcttgatatctaaattttgttgctgtaaaacacgtttaattaaggtgcgttgttccccggggtcggcaatagtaaacgcccggttataccctaatttatctgcatcccggcgcaagattcgaacacacagggcatggaatgttgaaacccagacatcattaccatctggtcctagtaacttaatcacccgttcgcgcatttccttggccgccttattggtaaaggtaatggctaaaatccgccacggcatcacgttgttatgttcaattaggtaggcgacccggtgcgttaacacccgggtcttcccactaccggcacctgccaatactaataatggcccctccgtttggagtacggcctccgtttgcttatcgttcatgccagttaataattcttctcctgccaccctgaacacagtcctctctgtcgattagtcttgaatagtataccaaaaaaacgtatgttctgctggaagtcttgcggttattttgattaaatcctgattaaacttgctcgcttaatcggcggagtacgtcacctgtcaacagcccgcgtcacatcgcttggctgtaaaagaaaaagaagtttaggctggtccctaaacttcttaatggttactgattgtcggtcgtttgattggtccaaatcgccgtatcgtctaactgatccaagattggcttgatggcactaccctgaactgaaatgtgccccatgacttcatcatcggcttgctgccgcaagtgatagaaagtaaaatgccagttatccttaatttgccactgcgtccgcatcgcatccaattgattagcggtgaatgacgccgtaacagctggcgttaataattgaggttcagctaatggcatgcccgcaatcgcgcggaaatgctccgcaaattcatccaccgtagcagcgacgtcaaagacataccccgcttcactaggcgctggcacaatcttcttcacataaatggcgccactactcgtcaagtaaaaggccacttcaaagaccccaacgtaatccacgtgtttggccacttcgccggcaattcggtgaatttcaccggcaacggcatcatctaactgggctggcacccaagtccgttgtacctgatcaccgtcagcctgaacttccgtgattggaaagacttgttgatttccttcttggtcacgagccactagaatcgagtattcccgatcataagcaatctgggattctaaaatgtaagttccccaatctagcaaaccagctgctttggcaatatcggtttgtgtcttaatcaccagttcacggccgctggaccattctttttggattggcttcagtacgcacggatacccgatagagttcactgattgataaacatcatccaaattgatgatcgtcgcatagggggcaatattgacatttagttgttcaaagaaagcacgctctagcaaccggtcttgcatcatttctagcatgtcggttccttgaggaatttgcgtatactgcgctaaaaatttcaccgtgctcgtgttaacttgttcggaatcatagacgatcgccgcacagctttccgcaaagtgctgcagcttgtcgcggtccttatttgacccaaccgctttaaaatctgccaactgtaacgcttcactcgtctcatcggcaccgtaagcacccacacgtaagcccatttttcgcgccgtcgtcaccaacatcgctgcgttagcactattgccaatgacgccaattgtgtcgcctggatataagaccgtgttcgccaaattcattccctactttctcacataaatttttcttaggttaaatgatattattctactaactattttaaagtttcatcagtcgttaaacaagctagaatcacctaatcttgagcaaaaattacctgaccagcttcaaacgatgcaatgctggccagtgcttcaagttgaatcccagcgtcggtcaccatctgatgccccttttggaaccgcttctcaatcacgacaccaacgccggcaaccgtaatttgggccgtcttggcaatgtcgagtaacccttgcacggcttgcccgttcgctaagaagtcatcgataattagcacgcggtcgtcagccgccaagaagcgacgatcaatcgaaatttcattggtgacctgcttcgtgtaggaataaaccttagcggtgtacaaattatccgttaaggtcagactcttatgcttgcgagcaaagataaccggcacattcaagtgcaagccagccataactgctggtgcaatcccagaagattccaccgtcaggatcttcgtaatatgggcatcttggaatcgccgcgcaaactcctgaccaagctcattcatcaattggggatcaacctggtggttcaaaaagttgtcaacctttaagacgttgcccgtcagaaccgtcccgtcttggcgaatgcgatcttctaaaattttcatcgtgtgtgccctccaaaaagtattttctctattctacccgattgaaccttaaaaaaacaacgcgtctggccgacatttatgaatgtttaacctaaccaaagccccaacaactctgctaaaacggtcgttagcgctaaaataccaagactacgaacagctaaaataaaggtttcctttttgacttgtttttggaataagccacgcacattacggtaaacgaggggcacactgattaacgctagtaaagaccagtgtggtaaatcgcctaaccagacactggcaataagtgagccgtagccaatgacatagaagctagcaaacaaccacaacgccccgttaacgcccaaataatagacaatggtggtgcgattcaaatcgagatcttcttgggcatcacagatgttattggctaataacaacgccgcaatggccatgacggcaatccctgaagccaacaacacgcgcaacagcaaaacgccggtaaagtttcccgtttgatacaagttcaggtataccgtaatcagcatgatcatataccccatggtgaacccggcaaagaattcacccgtcggcgttcccgataaggggcgtggtccccctgcgtacaagtagcccactaaaaaacagaaaatacccatgactaacaatggccatcccgtctgccaaacaagatacagaccaattacccctgctacgccagccatcgttgccatcagggtaaagattcctttaaccgacaacccgttcacaccaataacgttggtatttttcttccattccgccgcttggctaccagctttggtataatcttggtagttatcattaatgtccacagccatattaaataacaacatcgcaataaagaatagccccgtaagtccccagttaagttgaccatagttggcctgaacgaaaataacccctaatagaaacggccagaccgaggcaattttggctttaatttcaacaagttccagaaaaattggtaacgtcatggtaatccccctaaaattatgaattctgatttgatgataacctttatttgacaacgtttccacttgtcggtaagataaattttaatgtaaccattagtgaggtgcaaaatggatcgacaactttggcggcaatttcctcaagtggagccgcaactaaccgcattgcaagattatttattgcgtacggttcagctggataaccaacctattcatcataaaatattagcgctattaaaatccggcggcaagttgttgcgtcccggttatttttacttattctcaacgtttggtaacgcggcaactccagcccaactccaagcgggggcggccgccattgagattctccacgttggcacgttgattcatgacgacgtgattgatgattcaccgactagacgtggcgtccgaacgattcagatgacatatggacaacgcaatgccatctacgctggggactttatgtttacggtctactttgaccaagtgttgcagtcaacgacggatcggtcactgattcaaaaccacatcgatgctatgcgccgtattttacaaggtgaattgcatcaaatggacttgaactatcgcgaagacatcaccctagacgcctatctcaacgaaattgcgggtaaaacggcggaattatttgccttgagctgctatcaaggcgcccaattggccggtgcgccgcaaagcgttatcgaccacacccgtgagattggcatcgcgattgggtgtgcttatcaaatgctcgacgatattttagattacgccggtgatcctaaaaaaacccagaagcccgttctagaagacttacgctctggcgtctactccctgcccctgctattgagcttatcgcacgcaccacgtgactttcataagttgttaaagaaaaaacaagcgatgactttagaggacatcaagcacgtccaagcattagtggcacaatatgacggggtcggtgcggctaaacaattggctcgtgactatactgaccgagccttgactttaattcagcagttaccagctggttcagcacaacagtcattagaacaactgacccgcctgttgttacgccgcgatcattaattgacctttgagataacaacgtgcgattactaaattgaattataagacgtcatcaatcttcttggacctcgaagtaattagacatgtggttggctttcactatggttaaaagatatttaacggtcttgttcatgcaagcgaccactgcgaccttatccttttggggatgaggtcttttttgcgtttccgaatatctggtgtcgaaatgtgcgctaaaaagcagatattcgccttttgatgcgctcatttttataaaaaagacgccagcctaatcgactgacgtcccaaatttcctaagactttaatggccgcgatccaaatcatacaaagcccgaaaacgagcattattttgatacagatcttgcggactcccttgcatgtcgaactgaccatgctcaatgaagcggacctgatcgacatggttaatccccgccaaatggtgcgttacccagatgatcgtcttatcatgtagaaccttaaagacggtatccaacaagtgttgttccgtaatcgggtccaagctaacggtaggttcatctaaaatgatgatcggtgcatcttggagtaagatccgggccaaggataaccgctgacgttcaccgccagaaaagcggcttcccgcctcttgaacctgcgtattatacccctcaggcaatcgactaatcagctcatcaagttccaccgccttgaccgccgcccgaacgtcatcatccgtcgcctgcaagtttcctagccgaacattgttcatcacggtcgtgttaaatagatagggttgttggtcaagcacgccaaagagttgtgcccgttgcgcctgtagttgatcaatggacactccatttaaagtaacccgaccgctgttgggctgttcatcccctaaaatcagtttcagcagcgtacttttgccggtaccgctgggacccaacagcgccaacttttctccgggatgtaacgtaagcgataaatcacttaggacttctcgtttagcccccgaataagtgaaccgcacatgatccagcgtcaaatcggtaagtggcccaatggtggtctgtgcgactggttgctccggtgtgacctcattcagactgttaacccgccgaattgaatcctggtagactggccattcactaacgccttggctcatatcagcaaagggttccacggccggaaataaggccaagccaaacgccgctacccagttagcttctgcctgattgtgcgtgaacgtcacgccagcccaccacacaattagcaccaccgcggcaccaaagacaaactgaatggcaaagttccgccaccactggaaatgatggtcagcccgccgcagagtggcaatgcggtcgatgggttgctcttgttgctgcaaaaaagcttgtcggcgaccagaaatcaaccagtctccgagtcctaacacggcatctgttaattgcgtatagaattgccgctggacttgtcgcgcctgaaattcacggcgaccatttgcggcaaccgatactaacggcatgacaatcacaatgacgcccagtaagatgagcatgagtaacccaaaggcccaattgaagtaaccaatcccgacaacgacaaataaatacaataaccaaccaatcactaacggaaagaccgtgcgcaaatagaggttttcaatgtgatcaatgtcatcagctaaaatactgagaacatcccccgtttggtgcgtttgccgaatcgcaacggcttgcttttccactgcctgatacaggcgcttacgaaagtccgaaacaatccgcaatacccagttatgactggttaaccgttccgcgtaacgaaaggctggccggccgatcccaaaggcccgggctaggacaatcggaacataaatcatcaaaatattgtaagggtgcgtcgctgctcgactaatcagatagccggagttaaacatcagcgcgccaccacaaaagaacgtcataaaacctaggaacagcacgagtaccaataacttgcggtaacgtcgtagatagggcattacccagtgatcgtgcttaaaggtggtcaagaaacccttcatttggtcgtcgccccttccatctctgatcgtagccggacgtaagccccattgcggcgttgtaagtcgtcaggtgttccctgttccacaactttgccgtgatccagaactaaaatataatccatttcgttcatccagtgaagccggtgcgtggcaaagaaaaccacgtgattctcaaagaccggtagcatcgtttgcttcaattcaacttcggtttcaatatctaagtgggcagtcggctcatcaaacaatagaatccgccgggaatcatccaggaaggcccgggctaacgcaatccgttgcgcttgccccccactgacgccacgagcaccttcgccaatcggcgtcgctaaaccatcaggtagactggcaatccagtctcgcaatccggctttatccgcagcagctgcaaccgcgtcatcactggcatcaggtgcgtagaaagccagattatcccgtaagctggcatggaataaatagggtgactgcggaatatagacaaaactgtgctgccaggccgtttgatccaaatgcggcactgtcacatcattcactgtgatttggccgtcacgcgggctgagaaagccgcctaaggtgttaatcagcgtcgacttccctgaaccagaagcaccaataataccgatcttttgaaacccttgaacacgaaagttcaagtcatgaagtgtcggtgccccatcaccgtagctcacattgacgtgttcaaactgaatcgtgtcgtctgcctgccaaaccggattgcgttcaggcagtaacgtccgatcagtcggcactggccgctgtaagacatccaagaccgctgttagggcattcttcccattcaacgtcgcatgataatcattggcaaagttacggatgggagcaaaataatcgggcgctaacgttaaaataatcagcgctggtaacagctgaatcgtactgtccattaacccaaagcctaaaaagaccgctacaatagcaatcgataacgtggtaaagaaatcgagcgcaaaggtcgatgtcatagcgatggtcagtgtggccatcgttttcttgcgataatcttcactgacttgatagacgttatcggcatactgttcatttagccccaactgtttaagcgtgggcaggccccgcagggtatccacaaaatggttggagagccgttgatatccggcatattgccggtcggctctggcttgtgctgctagtcccagaataatcataaaaagaataattaaggggtagatagccagtaagaacagcgcctctttccactgaatggttgcaatgtagatcaggactagccacggcgtaatcgacagatccaccaccttaccaataatcatcatcagataggtttgaatcttgtcaattccctctagccccatggtaacgacatttccggtccccttttcagcaacaacgctggggccaaggtcaaataacttcgccataaactgttgccgtaaggtcttggtgcttttctccacaaaaggatagagacaccagttcttgaaaacggttaataaatgtcgcgccaaaaacgctaccgcaaataacgccaagggtgtgacaatggtgccaacgggctgttgacgccataaccgaacgatggccacagataagtattgggcctgcagaataatcataatggcttgaatgacggttagaatcgtctcaatcaccatcgccggcttaatacccggaaatttgaaaacacgttgatcaatcaaaaaaacgccccctcgtaacaagtgataacactaatgctatgatagcatttttcgcgtgtcagaacttgccgaagcggcgttttcactgaattttatttaagcattttgtttcggtgacgctaaacgcttgtagaagacccagtaactccagatgaagtagatcaagacgattggcaagatgctaaaggtcaagatggtcatcaggtgtaacgtgtacggggagttcgaagagttcttgattagtaaggagtaagctggattgttggctaccatgacccgtgggaataacccattaaagatcaagaccacaacgctaatcaagcctagaccactaccgataaaggacaaccattcatgattctttaagacgccccagtaagctaagcaggtaaagacaactaacgcgactacaatggccgtcgtggtcatcggcttcttactgaagaaatctgtaaagaagaataagagaatggcaaagacgacctcaccagcaaagagtaccggatagagaaccttattccaagacaaagcacgttcacgcagttcaccggtggtcttcaaccgaatgaagttcaacccatgaaccagacagaggaccacaatggccaccccaccgacgatggagaacaggttcacgtaatcaaagaagtgcgctgtcatatcgccgttcttatcaataggcatccccttaatcatggatgtaaatagcatcccgaagagaaaggcggcacagaaactaccaatcgtaccggcccattcccaaaaggtccgccaacgctgagtttccatgttagcccggaattcaaaggagactccccggaaaatcaaggcggctaagatacagaataagacgaggtaatacccagaaaacagggtggcataccacattgggaatgaggcaaacattgccccaccagctgtaatcagccatacttcgttaccgtcccagtgaggtccaatggaacggataaccacgtcacgttcagcatcatttttggcaaagctcttaatcaacatgccgacgccgaagtcaaacccttcaaggaagaagaacccactgaacaagacgccaatcagaataaaccagagtaattgtagactagtcatggttgaacgcccccttcgaatatggatcaagctcggtatcactcgtggcataaccatctgtgttgtcgacgtctggaccagccttcaaagctcgatgactgagcacaaccatcacaagccccatcccagcaaacattaagaagtagacgatgttactggtcagtaacgaggctacggaaacgtttggtgaaacggcatcagcgatcgtcaacaggccataaacaatccatgggtagcgaccaaactcagtgacaaaccacccagccgtgttaacgacgaatggtaaccagaggcatagtcccatgatgtataggaaccaccgctgcttcatgatagcctgtgacttcttacggttcataatcaatccaacaatggccaataaggcaaacaaagcgccagcaccggccataatccggaagctccagaacagggtattggttgggacgtagtaattcatatcgctaccaaacttcttgtcatacttggcatgtaactccttattgatggtgttcatgcctttaacggtcccggtcgtcttgtgataacttaataagttcaaaacatatggcacgtcgatcgaccacgtcgacttgtgttgcttagtgttgaaggtggaaaccgccgaccattcacccttgttggtggagtccttatagagcccttccatggcagcgaacttcattggttgattgttaatcagataacgggtttggaagtccccactggcgatagaacctagtgagaaaatcaacccaatgactaaggcaacgttcatggacttacggtagaaggacacgtggtctttcttgagtaagcaccaagcacagcagccggcaatcacaaacgaagcggttacaaatgccccaaaaattacgtgcggaaattcattccacagttgcgggttccccacaacttgaccgaaactcgtcatttggacgtgtccggttttttggttgatgatgtaacccaaaggattttgcatgaaactattggcagccaagatccataaggcagacagtgatgacccgaacatgaccaaccaaataaataacgtgtgaacccatttgttaaaccgatcccaagtaaacatccacatcccaataaacgtggattccaggaaaaatgcggcgagggcttcaatggctaatggtgcaccgaagatgtcccccataaaacgtgagtattccgaccagttcatcccaaattggaactcttgaatgatcccggtcacaaccccaacggcaaagctatacaggaaaattttgccccagaactgcgccattttcttgtaatcctcatcacccttgattgcgtacatcgtttccatcacggccacgacaaacgccagaccgattgacaacggtacgaagaaaaagtgaaacaccgtcgtcatggcgaactggaaacgggcaagcccaaggatatccagacccagattgaacattgttctaacctccccaatcgttgttagtgtaaataaataattgctgtcttgacttcattatatcgagtgataagtcaagtttcaatgattggttgcgattatctgcaaagtttgtggtatttgtgcgatttttcaccgcattttgttcggtcaactccgtaacagatttgaaaaggtgtcgcatgtcatgtaatcagttactttagtgtctgaagatttttatgcgagaaattaacaaacacgtgctaaaataagagtaaccgaacgaagttaaggaggccttttgtgatgacagaaaaaattcttgcatttcaagcattaacgcccgctcagacccgtgaattggcggatcaaggcgtggcggtcgtccccgctagtgagtggcaaagtgccacggagattagtatcatctttgggtggagtcgccaacacggtttggcagtcctccaaaacccagctaaccaggtgaagtggattcaaacggtcagtgctgggattgattatctcccacttgattggattcgcgaacaccatattcaggttaccaatgccagtggtgcttactcgggcgcaattgccgaatcaacattgggctacctgctatacttcttacgtggcttcaatgaagccgtaaagaatcaggctggtcacttctggcaacaaccggctcggagtgacttggatgtgttagctaaccagaaggtcgttatttatgggaccggaagtattggtcaagccattgccaacctgctaaacggctttggcaactacccatttggcgttaatcgatctgggcatggcgtgacgggtttccaaggtgcagttgccatgcaagatgatgctgacttggtcaaggatgcagatattattatcaatgcgatgcccgcaacgtcagagaccactcattactttaatgaagcttactttaaccaactgaacggactccgaattttcgtgaatgttggtcggggaaaatcagttgatgagcaggcactgatgcacgccctactctatcaaaacgtcttacatgcggccctagatgttttcgaaaatgaaccactacctaaggactctaaattgtggaattacccgaacgtcttaatcactccccatcaaactggttttgcgccagacaacgccttaccaatctttgattatcttcgcgataacgttgaaagttttgtgcaagatggttcactacacgttaatgtggcggatgtgtcacggggatattaattaataggaacgcaaaagagatacgatgattttattgattgaaatcgtcgcatctcttttttgtcgccttgaaacagcggaccttgtttacagttcactgcccatgtacccgatacccggcctcaacctgagcttttaccggccgccaccaactctcatgtgcacggtaccagtcaatggtttgctgtaagccggcttcaaagtcggtgacctctggctgccaccctagctcattgcgaagccttgttgcatcaatcgcataacgtcgatcatgccccgctcggtcagctacccaatcgaaagcatcggcaggctgacccattagcttcaaaataagagctaaaacatcacgattactccgttcaccattagcaccaattaagtacgtctgaccaatctcaccatgcatcagaatctcccacactgcccgcgaatgatcactcacatgaatccagtcgcgcacgttcatcccccgtccatatagcttaggccgtcgaccacttaaaatattggtaatttgacgtgggataaacttttcaacatattggtaaggaccgtaattgttagaacagttcgaaatcgttgcccgcagtccaaacgaccggacccacgcacgaaccaacatgtcggcactggccttggttgcggcgtaaggactgctaggattataccggctatcggatgtgaacattgcagtactcccggtagaacgtaatggaagatcaccatacacttcatccgtagaaatttggtgaaaccgcacattatatttgtggcaggcttgaagtaacgtatacgtacccacgatatttgtctgaacaaatggatccggattatgtaatgagcggtcgttatggctctcagcggcgtaatgtaccaccgcatcggtctgagagaccagtcgatcaactaatccagcatcagtgatgtccccaacgactaatcgaactcgttcagctggcaaatcggctaaattagcacgattgccagcataggttagcttgtcgagcactgttacatcagtcgttggatgctctcggacaatgtcatgcacaaagttggcacctatgaagcccgctccaccagtaactaataaatgcatcgttcacccgctcccttctttcaaagcttatccgactccagtctagcctatctgatggtaaaagaaaacagcggaagcacttagcttaccactgctttctaaataccctctattctgcttaataaccgtatccataatcactattgtttgttccgctattggcggttgttgcatttgtccccgtactagagctggagcgactcttactcttcgaattcgtactactaaaaaccgcaattgatccagtcttcttatatgataagctcaatccattacgaataaagttcgtcacacttaaatgtgaaccaaaactaacgccgcactgtcagcggtcgcttaaagatcaactgtgccacaccaaaccggttagccaaccagatgtacaatccaatggcgagcaagccccaaacacccacatagatcatggccaagaactttcccgtaaagaatagcgggccgagccaccattgcgtgccatcaatcagccccgttaagatgaccgcgaaccacacattgagctttacaatgggccaaagtagctgtaaacgcaaggcataactttgacggataatgtgccaactacgccaaataatccagccaaaggccaagctagttgtcaataatgccccataaccttgccacaaatagactaatggcaattgcaaaatcagcttaatacctaagccacttaataagtagatggtcgcttttttactcatgcgtaaagcttgcaaggtggtcaagaggtccagcgctaatcctaagattaagctttgccagccattggcaatcaagtacgtcgccccggcgctgtcgaaattaaagaaaattccgtaagtcggataggccaacaagctcaccaacaccactaacggcagtaagacgaaggttaataattgaaaattgttcgtcaacagcgccgtaattcgctgccggttggctttcaaatcggccagttgccccgcaagtaacggtaaggaagtttctgctaccgccatcgctaacgagaccagtaccgtcgtgatcttattgggattggccgaaaagatggtaaacacatattgggtcatcgtcgccgtttggtgcaggattccttgcataatctgcttgaaaaataattggtccactaactgactcagggtaatccccgatcccacaatgacaaagggaatcgattcaaccccgaccatcttcaaaagatcccggccagcatgctgcttgctcgtttcacttgctaccgctaactggcgataagtatgtcgttgccgccacaaatgactgagcaaataggcataactagccaccgcccccacaaatgccgccgcgacactgataaagacggccaatacataactctgttggctccgttcaataatccagtaggttcctgccaaaatcacaatgatccgaataaattgttcccataattgagagataccaaatggctttaaatcaccattgccttggaaccacccgcgtaaaatactcattgacggtagaatcacaattgctggtactaaacaacgaatcgcgatggtggcattggcaaccgaactgacgggactattagccgccaagatgggcgccaatccatacaacaggacgccacaaatcacgcctgacaccgccataaaaccaaaacccgttaacgcaattcgcttggaatttaaaaagctcccctcaccattaaagaaagccactcggcgggcaattgctgagggaaatcccgccgttcctagtgcaataaataacgcatacggcgtgtaggcggtattaaataacgcctgtgccacagtctgatgctgaggcgaaccgatcattgctaaccaaggaatcaggtagacaacccccaaaacccgtgaaaaaatactaccaaacgagagccaaaatgaccccgaaataatttttttatccataaataactgctctcatatttaatctagcgatttaaaaccaccactagccagaataccccactcctttgcctctgtacataaccaacggctaccaaacggggaaatattgaggtcaatggcactcctgaggccagcaagtcaactttctaagttttcttaaattaatgtccgtttgccagcggttgtggctatcgcaaacttatcagctgtattgggcccatcttccagacacatgacttccaagctaagattggttggaagtgttcttgccgggcttaactcgtggtaccataccacagtagcccggtgggaagcggtaaatgggctcagtaccgtcgttatccttagggcgcgtcagatacattccaatttattttatctcaatctaatgagcgtcagacacttattcccaaacaaaactggtttaatgaccaaagaacacgccaatcacgccagccagcgccactaatgcccaccagtaattagccaaaaactcccagaaattcatcgggtgacctgtggttgcccctgccggttccggctgatcgaatgtcgtctcagtttctgtctgatgggtcgcggttgagcgaccactgactagttcgtccaggctcacccctaataccgtagccagactaatcagcgtatctaagtcgggagtcgtttccccctgttcccactttgacacagactgacgcgttacaaatacctgactagctaactgctcctgtgataatcccgcttgtcgtcgtaactggcttaattgcgtattaaacttattttccatttgtcccatctcccttacttttcagcaagtataccggttatctttcaagcaacctagcaacgatctgctattttttcgcaatttgcctgtgctcattgcgcacgtcacagttgccataatggttgcgcgccttacagcagcaagccatcacatatcttctttcatcatacactcacgaaacaaatatctaattttaaataaccggttaggtcagtcgccaaaataaaaaaggccgtgaccttcgccacagacctttcaaagcctaactgtaaacttagtgtttaactgttgggtgcgccgtaaaccactctgtcatatcgtctaaacgttgtagtcgcagattgggcaacccatttcgtgacaccccgtggaaactttgggggtaccgaatcatgtcagcatccacgccatggcgtttaacggcggtaaagtattcctccgactgactgatgggacagcgcatatcccactcgccgtgtaacaaccgaatgggggttgtgacctgctgggcgtatgccaatggcgattgccgccagtacgacgccacgccaccttccgcaaagaggtccgttcccaactcttctggattgaaataaaacccaatatcactggttccaaacaaactaatccagttcgtcactggtcgttgggcaatcgccgccgcaaagcgcttggtatgcccaatcgcccacgttgtcataaagccaccgtaagacccgccggcaatgtattggcggtccgcatctaactgtgggaacttctgtaacgccacgtccagacccgtcatgacatccgaaaaatcatgctcgccgtagtgaccattgacatcactttcaaagtcttgcccatagctagttgacccgcgtggattgaaaaataccacgccaaatccgcgactcgcgtgcacttgaaattcatggaagaaagtttcgccatagttaccatgtggtcccccatgaacgtacaacaggaccggttgcttcggggccgtggtttgggccggtaaataccacccctctaacgcctgcccatcagccgactcgaagtcaaatcgttgggggtgagcaaacgtatgggtttcttcataagccgcattaggattatataagacccgttccgtctgttgtgttaagtcacgggtcaccaatacactcggttgatcttgataggataccgccaagaccgccgtgtgcgcgtcaaccacatcgaagtccacaatctgccgcgccgtgttatctatacggtcaatgccatcggttgcattgcccacatacagctggctatgggcatgatagactgctgtgaagacaacgcgatcagaatccaaccatcgtaccagcttgcttccttgttgctgaatgaagtctgccgccatttccggcgctgggtcagccgctaagtctgctgtcaggttttgcatctggttaccagtccggtcaaccacatagacattagctaccgtatgccgaccgaacgtcccatcatcacccactagtgcgacccgttgtccatctggcgataacgtggcatcttcaaagcgtccagcggcaatactagttgtcaactcgacggtctcgccggttgtcgcatcataacaataggcgcctcgcgtaaagtcacgatcgttgtcgggttggacgtcatgtaagactgtgacatagcgtccggcagcactgaccgaagtcacatcaaagtcaaacccgtgttgaaatagttccgttacggcgcccgtttctggctgatagcaccgcaagcgataggtcacattcagcggtaaccaaccatagccatcggccttgttgatgagtcggtcaacgtggcgcgtttgcggaaaggcctgcggactaggtaatttaggccgttcggcagtcgccgtggttttaaaatagacatactgaccgtcagcactcgctaacaccgtcgtcaccgcttcttcagcagcggtcgttaactgttccggtgtcccaccagctagagaaactcggaacaattgggccttagcgtcacctacattggcagcatagtagacttggtcccccacaattactggctggacagccaacttgccggtcgtggcaagtgtttgctggtggccttgcagatcaacgcgctttagatccgctaagtaactgttactagcctgatcgacgcggttttccacaaccacaacttgaccagcagcaacggtcggttgggtgactgattttaatctaaataaatcctgtgcactgacgctttgtgacatacgtatcgctccaatttttattttctcattgttttctcatcaaataattgtgtttcatgttagccctgtctataagtaatgtcaatttttatttgattacagcgaaaatccccgaaacctgctacactgaatctaactaacgacctaaggagtgagtttacatgaaaattgcaattgcaggtgccggcgcaatgggtagccgatttggtgtcaaattacaggaggctggtaatcaagtcacgttgattgataactggtccgcccatgttgaccagattaatcaggccggattaacggttactacggatgatggtgtcgatcacgtctacaccatgaccgcgcaacatcctgaagcggtgaccgatcaatttgatctcattattctctttaccaaaaccatgcagatggacgcgatgctccagcaactcgcccctgtactcactaaccatcctatcgtcttaaccttagccaacgggattggcaatatcgaaaccatcgaacgtcacgtgcccaagaaccaaattgtcgtgggtaccacggtctggtcttctggtttgacggggcctggccacatcaccgtcactggaacggggagtatttccctacaagccgtcgttcccgatcaattccccaatttggctgacttaatcaccactttaaatgcagctggattaaatgccagcgccgcagataatgtcttagctgcgatttggaaaaaggctggcctgaacagcgtcctcaatacctactgcaccctgtttgactgcaatattggtgagtttggggctctcaaaaattggcaaaccctaacggctaccgtcctcgatgaattccaagcggtcgccgacgccgcacagattcaattcagtgcagctgccgtaactgatttaattgcggcccaatttccagcggcagttaacgggaaccactacccgtcaatgcatcaagatatggccaaccagcgaccaactgaaattgattttctcaatgggtatgtcgctaaattaggtcaacaactccatgtccccacacctgccaacgccttgttgacccagttaattcacagccaagaacaactgaaacaaatctaacaaaaaagtaagagaaccacgctctgtggttttgccactatatgtagaaatttaactattttttgccccatatgtagttgtttttttcgcaaattcatcgtaccatagttataagctgattttgacgaacaaacataatgcatcaattaaggtctggcaaacctaggagggcaaggatagatggacgtcttacgtagatcacaggcaacaatgactcccaccggtctaaccgtggagaatcgagcaggagcacacacaccgtttaactcacggcgcattcaccagacactcactgccttaacgaatgaccccactgtcgttcatcgcgtagagagtttaaccgttgcgcaattggccggcttcgatgtcgtggcaacgggaaccatcgttgccaccattgccgaaacactggaacaattgggctatgctcacatggctcagacttacttaaaactcaatcgctaacgcaaaaagggcgtagccgatcgaattaatttcgatcagctacgccctttcacatctcattctgtggtttactaattttaacgacaataaaaaaaccgaccagcactcccccgagaactgatcgattcgatttatgagcttaattgtgattctaaatggtgtaactctgcagtccgcacatcacgtggtaagaaccgccgaatctcttcttcgttgtaccccacttccaagcgcttatcatcaaagatgatggggcgtttgatcaagtctggatacttcacaactagatcaaccaattgactaactgacaagctgtccaagtcgacgtgtaattgcttgaaaacattcgaacgggtagagatgatatcttcactgccgttctcagttaaccgcaaaatttgcttaacttccgcagcgttcaatggtttggacttgatattccgttccttaaacgcaatatcgtgttcctttaaccaggcccgcgcttttcgactggatgcactacttggtgcaatgtacaaattaatcatattcagcacttccttatcgttggattgagtaacgataacaaacgacttcaactgatcctgttgccgattaatcacaaatcgtacaatagaaccaacttatatgttaccacaattgaatgaataatcaacccctttttggaaagtttctaaattagctcaccgtttgtcaggtgagttggttgcatttcccaactagttcatcctaaagaccattctttgtgcatcatttgtgtaatgactggtacatcactcaatgccgttatcacaaactcgataaactgatgaaagcagtcttttcgaggcccccataattaggcaaatacccaaccaggcgtatcattttagctgttttgcatattaatttattaattatgaattaatattcattagcgaattttagccactttatttccactaattaacaatgagctcgcacattcccattttgacaagaattcacgttccctttatatcgctgatagcgtaaaataaagaccacaattagtaattcttggagggatttttgttggcagtcttttacgctgtactactcttagtgcttgcgaccattgtcgctaatacggtttatccttactttccgatcattccgcaagccttttatcaaatctttgctggcgccttattgtctttggtgccgctctatcaccactttgtcctggaaccagaagtttttatgctcctgatcattgcgcccctcatgttttatgacggccgcaacgccaacgctaaggagcttcgagaaaacttaggctcagtcttctcaatggccgttctactggctattttgaccgttgttctaatggggtacctcagtcacgctatgctgacaaccatgccattagcgttagcttttgccttagcagcgattgtgaccccaacggatgccgttgcggtttcctcaattaccaccaacatggcggttccccaacgcgtgatgggaatgctcgaacgcgaatccctcttcaatgacgcttccggcctagtcgcttttagtttggctctaaccgcctttaccactggtgaattttctttgggcaatggcattaagcacttcctgatcgtcttctttggcgggctattaattggcctcatcttggggctagtcgccgtatggacccggttatatctggttcggaccggtaaggactccaccagcgtcattgttccatttgacgtcttgattccatttctgatctacctcgccgcagaacacctcggattatccggcatccttgccgttgttgccgctggcctgatctacagcctttccaataatcagttgcgtctctccagtacccagctacagcttgtttcccgctcgacttggcggattctcaccagtattttaaatggctttgtttttgttctgctgggagtgtcactccccacagtctgggtaaatattcaacaggatcatacgaaatcaattcctacctacgtattacttgccgtcatcttgtatgtggtcatgctggctttgcgctacctatggattcgcttcgattgggcattgatccactcaaaaccaaccgaacgacgcgaaaatgccttaattggcgcgctttcaggcgttcatggaaccatcacgttagccatggccttttccctgcctttaacgctacatggcagtacctttcctctacggaattccatgatttttatcgccgcggtcgttatcattttaagtttactggtgccaactctactactcccattcattctaccaaccaagcaactaccggttgacccagctgaagcgttgcaagaacgtaaagcgctcgttgcctatgctaccgaccggttagtccaggaaaatcccgactatccagaacaagcccaaaaggtcgttgaaattctgaatagtcaagcgatgaccgaacgacccgaccgacgtaaagtccaggagctgttacaacaagcgacccagattgaggtggaaaccgttcaaaagttggctgacgatggtgtgatttccagtggttttgccaaccgttacgtgcggatgttggtgctaaaatcgcggatgagcaacaataatccctttaccaatctaatcttatggctacgctttgtgggccaccggattagccatagttttggtcgacacggccggcgcaagcggcgcattgcccaacagcaacaacgcttacaacggcaccccgtttcaccagaacagcagcggttgattcagcagcggctacaacaagagcaagccgcgcctcatcacggccggcataagcgtgacccacaagctgacaagcaacgtcgtgaaagcttcctaaagattgaacaggacgtctacaataacgttattgcctttctcaccgatgtctcgagtattgagaatcaagccgaggtcaattcagtacgaaactattacaatgcgcgtcaccgtcgctttatgtcgcaagaaaccacggatcagcaaaatgagttatttattcaagccttccagcacgaatacacttatattcgtcaaaagcgcagtgctcaggagctttcaccggccatggctgaggaactttaccaacaggtttctaccgatcaaatgttatacatgcaagaaattgcaggtgaaaactaatttttgctgccagtgtcacactttcttcacaatttgctgttattatgagtccataacttacgaccaaacaaccgaataagttaataattttactcctccaagtaaaaattcggacggttctattacgatagaccgatccactccaaacgtaagatacgttttacgtaaagcgatgacgcagacaattcaggtctggtcatcgttttttgttgtccggcaataatcggtctaaaacctgataccgttcgtttaaaatgagaaaaatctcagaatttcacaaatttcgccaccctaaatttacactcagggcaaattagcttataatttctttaacgcgtgaaagagctaaggcctttcaccaacggtctgtcagcaactggtctatgtgacccgtggccagccagacgtcctaacttggagggtgacatctaaaatgaagctgacaattttatcaaccagtgatacccacgggtacgtctatcccacaaactatgtcaaaaagggcagtcatcaggggttcggccttgctcgggctgccactgtcattgcgcgtgaacaagccgccgctaaagccgaaggtcccgtgatcaccattgaaaatggtgactttctggaaggctccccactggcatactatgtcgcccgggtccgacccgaacgtgatccccagcctttgatgtccatttataatcaaatcgattatgactgtggtattctgggaaatcatgaattcaactatggccaagcctacttacaaggcgctatccgtgatgcgaagcggacaattctgtgtgctaatattttagatcaaaatggcgaccccgaatacgggcagccttacaagattatcgaaaaagatggccttaaaattggggtcttgggattaaccactcaggctgtctataaatgggaaaaagccactaatattagtggcctacaatttgaatccgcctttattgctgccaagaagtacgtccccatcatcaaaaagcaagcggacatcgtcgttgtctgttaccacggcggttttgagcgtgacttatcaaccggtcaacctaatgacattcacgtgggtgaaaatgaggcttaccatattttggaagctatccccggcattgacgccttggtgactggccatcaacatcgccaattagcaacaaacgtattcgacatccctaccacacagccaggctttcgcgggcaggccgtcggaaagatcacccttgaccttcggcgggatgacgccggtcacgtctcggtcatcaaccatgattctgagttagtcttcactaaagacgcccctcttgatcctaaagttatcgccgcggccgatgatctcaatacagaagtcggtcattggttggaccaaccactcggccacattcaaggtgacatgacgtttgatgatccttttgccgcacgcatgcgggaaacaccctatatcgaatttatccaaaaagttcagatggctacgatgggcgctgacatttcggcaacggcgctattcaacgatgaagcgcgcggttttgaaaatcccatcacgatgcgtaatatcatgacaaattacgtttaccccaacggcctatcgctattaaacatcactggcgccgatctcaaagcggcgatggaagtcagtgcccgttactttagcgttaaggatcatcaaatcgtggttaatccggcctttattcaccccaagcgtcgtcaatacaattatgacatgtatgaaggggtcaattatcggctaaatatcgctaagccagtcgggcagcgcgtcgagaatctgacctaccacggtcaacccgtggaacccgaccagccgctgcgaattgtgttaaatcaatatcgggccgttggtggcggtcactacagcatgtttgacgccagtaagattgtggcagaaggtcaaggggggatgagtgaaatcattgccgactacctccaagaacatcccatcattgacgccacgactaatgataactttagcgtggttaacgacccacaagcataagaaaaaccaaccagtgatagtcgacttaaagtcggttgtcactggttttttgttaggtcaaatggtctccccaccaagcgtgcataaatcactgataccattgatttaggattgtctccttcctggctgcaattaggcattgaacagtcacggttctattttagctaaaccattaaccttatacccgattcacctttattcataggatgttcataaatcattcctacttttttcagagtttgttaacacgactaatttatatctcgagtatatttaaggtgttacataatcttagggggagagtgggcttagggccaactctcttcttttttggataagataccgaaggagatggctcaattgcaattcagacaccaccgtttgacagcgctcgccgttgtctctctggccgttttaacggtcggcttagctggctgttccagcacgaaaagcgcttcatcaagttacaaaattaagaacaacaaggtggccttaacgactgcgcagatcaagaaaaatcttgatacccagatcattacgacccgccaagataagcaaaaaagcctgacagctaaatacaaagctgcggccgaaaataacaagtacacgttggactcaccatacgtcaaggtgagtccttacgggtcctctcccctgtcagccttagtgacattcaagacgaccgaggcagttaaggtgacctacactgtcgtaggcaagtctgacaagacttcaatcaccaacacggtcaatggcggctataccaagacccatcaagtgccggtcgttggcctatacgctgattacgccaatacggtaaaaatcaccacgaccaccaagactggcacgactaagactaagacgctaaagttaacaaccagtgccctgccaaaatacatcaaggacgccaccattacgaccaaaaacgtgaagaaatctaagatgaatattgggaaaaataaattgaccattattaatcgaacaactaagcaaccctttgcgattgatgctgatggcaatgttcggtggtatgacaccaattattcgcaacacaccattgaacagtggtccaatggtcacattatgatcttgtcaaagaaagatattgattcagatgtttacaatgatttaatcgagacggactacttgggtcgtgtttataatgaatatagttttgcgaacaagaccagtagtaccgatggtggcaaagaaacgaccgtcattcaccatgacttggttgagcttccgaaccataacttactagccaccgtttctgatggttcaaagtacaaggaagatacgatggttgaggtgtctcacaaaaccggcaagatcgtaaaggtcattgatatgaagaaacttctgccgaagtccatgtgggctaagtatcaaaaaggttccgacggcaaggtcgattggttacaccaaaatgccgtggactacgataaaaatgataaatcgattgtgatttctagtcgaaatcaagatatgattatgaaattggattacaagacagatcatatcaaatggatttatagtggtaaaaagaaatcaacttggcccaaagcctaccggaagtatttgttaacaccggccaaaggaacgaccgtgaccgggggccaacacgggctgtacctcttaaacaatggcggtaacagctccgccaacagtgaaaactttatcctgtatgataacaacattgcggtgaccaacgggaataagcagacctccggtaagtactcacaagccgttcaataccacgttaaccaaaagaagatgaccatcaagcagacttgggcttatggaaaatcactaggtaagaccaactttactagtgttattggttatgccgagaagcaaagtaacggtaacgttctgattgattttggttacaagaatggtggtcaagaaagtaacattatcgaagtgactaagagtggcgaacaagtcttcaatgctactatgaagaatgcggcagccaaagcctacgcttatcgggcctaccgcgtgccattctatgactcagcttataaattcgatgcaacaaaatcttaattcgtcaaaaaagggtctgagacaaaagtctcaggctctttttgcgtttctaaatatctggtgccggaacgtgcgccaagcggcaactagtcccactctcttttactagccattaatgcttccattttcgctgacgcgtctgttcgtgtagccagccgatcaaaccaccgacaatcacgatgggcaccgcaacactataggtccctaacgacaagtacaacagtccaactaaaacggccccaatcacaaagcttcccatcaacatcagggtatctttcgccttttgccgcgctgcgcgatctcggtagcgaacaccgtcatagagtgcttccgctaccgtccggaagtttcccgtcatcattaatggcgtaaatggggcgcccttaatctggcgaaactcttgcaattcagcagcagcggctaacgacagtaacgccgtaatcaccatatccggtagcacacgggtggtcccagcgacaaccaccaataatcctagttccagccacaaaaccagcgcaggctgattaacggcccgattttcaaatacatgctgtaggccgcgaaccagcatcgttcccaccataaaggctaacattgccgtcagataacggccgatagcggacaattggagctgtcccagatgggtgccgagtaaaattaagttaccagtttgtaaccccgcaaaaacggccccgtgagccaagtaagaataggcatctaaagcaccggcggtcattgtcaggccacaaccaaataaaagctgttcatggagcggataagcgcgttgtgtcactattgttcacctcgatgaaattttcgttcatctagtatagcttaaaagccgtggcgacaagttaagaaaatctaaacgtaccacccacaacctgcttcgttgtcggtggtacgtcgttttactcactagttaaaggtttttaaagaatccgtaatcaaccgaataaaggcgtcacgatcaatatccaagagaacatcggtattcttaggtttttcggtcagctcataataatcacaaaccgtttcgccccgaaccagttctccttgcgtttcaacatcaacgttcattagttcactgtggaacatctctggacgtaagagccacgcaatcgtacaaggatcatgtaatggcgcgcccttaaaaccccatttaggtgcttcatggtaccgttcaaagaaattcagaagcccgtaaaaggcgtgggcaactggattgttaatatcgccaatcgcctcaatttcgggtttgagaatctgtgcttgatgggtcacatttaatggggccatcgtcaacggaatgccggcattcaacacgattttggcagcttctggatcaacgtaaatgttaaattccacggaaggcgtccagttacctagccccatcgcgccgcccataaagacaatccgctcaattttatcagtcagttcgggatgaacccgtaagaatagagccatattggtcatgggacccgtcaccaccaaggtaacgggctctgcactagcccgcaatgtttgcgccatcaattcgacagctggtacgggttgaacggcaaagtcaggctctggtaactcagcaccatcaaggccactcttaccatggacattaccagccgtttccaatggtttcaacagtggtgttcgattaccacccgccactggaatctcttgatgttgcatcagtgtcagcagtcgcatcgcgttattcagagtcttttctggtgtttgattccccgctgacgtcgtaacagccagtaggtcaatatccggactagccaatgccagcatcattgccaaagcatcgtcgtggccgggatcacaatcgagaattatttttttcatgggtgagactcctatcttaactagattgttgtttattcagctggcgaccggtcttgaaccaaagcccattaacgaacagtccaaccaaacttatgatgataactaagcttgaaaaacgactgactatagcaaattgtttgatggcagtaatcattaggctaagaaagccacaactatagaccacaatgacaaagtccattaaaacgcttgcaaatcgtcgctgctgataaacaatgaagatactccaagcatacaacattaatgcaaataatagggtattaaatgtggggcgccaattgacgctcggtgttcccgtctgcacactaaccagggttcccaaggaaaacaacagccatgagccgacaactaattcgattaatctgatccattgccgtttcactttaatccctcctagaaatacatccccacgatggttccagtcaatactgatgctaacgtcgcacccaacaataacttcattgagaacttagccacgtaaccaccttgttctgcgctaatagatttgattgagccggtaataatcccaaccgtcccaaagttggcaaaggaaaccaggtaagcggaaataatggcattggcttttgcacttaatccagcggccatgccatgcaaagttcccatcgccacaaattcattagtaatcaattttgttgccatcagactgccgactttcatcgcttcatgcgctggcacgcccatcaaaaaggccactggcgcaaaaacataaccaatcaaatccgtaaaggaaatatgaatcaaagcgataaatgagctgttcaagaaggttaccagtgccacaaaaccaatcaacattgcgcctacagtgatcgctaaactaaagccgtccgtaatgtaggttcccaaaacttggaaaaatggttcttgtttcttcttggatacttgaaccaactcatcattcgcttctgtttcataagggttgaccacacaagaaataatcaacgccgataagatattcaagaaaaccgcaaccacgacaaactttccgggaaccatcttcatatatgaggccaacatggcagcggagacggcactcattgccgatgcacagatggtatacagacgccgttcatttaacttgggaatttgatccttaacggttaagaaaacttctggttgtcccaaaatagcggtcgatacagcaaaataactttctaattctcccatacccgcaactttatttagtgcccagccagtccacttaataataaacggtagcaccttaatgtaattcaaaatacccactaacgccgagatgaagacaatcggcatcaatacgtttaggaagaaaacggaagaaccggctttaatgctgaatccaccaaagacaaaattaacaccgccagccgcttgaaccattaaccaattaaaaaagctagaaatgcctgctaaagtcttaaccccaccagacgtatgtaaacatagaaaggaaattaccaactgcagaccaaataaaattcccattcgtttatatttaatatgcttacggtctgtactaatcagccaactgatgccaaaaaccaatgctaatcctgttaacagaaaaacaaaattcatgacgttcaccctttttcgttttgattaagcccgacaaccaaatcgtgttaataactttgtggcgacttgcttgttcatctctccaggtgtgtttcctgcaaattgttcatttgcaacagcctcagcattcgtcactagttcttcttcagaaatcccataatcgttaaatggatgcaagccgactaaatcatctcggaagtgttggtacgccttaatggcttgattacaccgctctgataaggtatctgttggagcgtacgtcacacctaagatttgaccaatttcagctaccttatggggtaagagtggggcaacttgttcaagaacccctggcaaagcatacgcaacggcttcgccatgaaccagatgatacttagatcctaagatatgggccattgaatgtcccgcattcgtcccagcattattaagcatccacccggctaaggcagccgctaccatgacacgttggcgagcctcccgatcgtgaccattttccactgctcgcggcagataattataaagtaaaaacatcaccttttcgcaaatcgcgtccgttacaggacttgctagccgggacgtataaccttcggccgcatgagaaaatgcatctaacccagtggcaatggtcatttttttaggcaaagataagagtaaatctggatttaatatagcatattcactaacggcgttatccgctaaaatcgctacctttttctcagttgccacgtccgtcacaaccaatgcattagaaagctcactaccagtccctgaggttgttggaatagcaattaatcccggacatggttcaatcgacttttgcgtatcggtatagtctaaaatatcgccaccattaacccgaacaatattaataccgcgggcgacatcaattgaactccccccaccaattgcaattaaactatcagcatgggcggccccaaatgccgttacaccgtctcgaattgtttgtgccggtggatctgatactacctgatcaaacacgctaacagttatcccacttttctccaataaagcctgagtttcctgcaccaatgggacctgtgccagaaaactatccataacaaacagtggacgttgatacccttctgtttgaagaacctctaaaacagtctgcgccaagtgatcggtgtctaacaccttaacgcgctgcagtaactttacatccatctgcaattcctccttaattttgtctcaagataaggcgcttacgaaaaatactacttaatgcctgaatcgttggtcccgtcgttaaggccgttaaaatcgtaataatgccaaacttaccgcccaataaaacgcccatgatgatcagagcgccatcaaatgttattttgctacggcgcatgctccaaccggtcttatcccgcaacgtcaacatgaacccgctaaacgggtccacaccaatgtcggccgctacaaacaaactaattcctaagtaatataaggaaataccgaccaagccacctaacgatcgcccaagtaacgtcgttgatgtaaaaatcatgggatatagagccgacccgattgagacaaataccccataaggaacgagatacatcagggttccccaactggcataatgacgacccatgaagaataatccgataatcaaaacaacattcaaatagttcgaaacggtccccaactgtgcttgttctaagtgaaatgtcgttcgcaaaccatcataaataatgcccaccgggtcattaccaagctgcgtattgttattaaaagccactcccatgcaaactaggaaaataccaagaagcgctaatgcgatggtcttcggtgtataccttgctgacatttcaccgccctcctaatatttataatcctaacttttcagctgcagcatctgcattttgacaaaaggccttaaccttatcaatatctttctccatattaccgccctcatacttgatactcgtcttagtcaacgaatcaaccccgtatggtcgaatcttttcaattgcggccgcaacattatcaggtcctaaaccaccagcttcaatcaccggtaccttaacttcctggacaatcttggcatcgatgttccaatcatgggtttctccgctagcaccaataccggtatcatgcgccaagccagaatctaagagaatatagtcaacaaaatcttcaaagtgtttagcccgatcaatggcaccttcattgtccactaacacggcctgcatgagttctgtatgtggtgccactgcctttagccgcttagcaaattcggcatcagcagcataaccatctccggcaatatgcaaaatatctggctgaaccttttcagcaatgtcaatcatctcttggggatcattcgtcaacataatggcaacggaggtcacgccacggcgcttggcttcatcgaagattttgtggacgcgatccaacggtacccgatgagcaggaacgccaccgtgttgcatcggtactaatccgatgttatcggcaccggccgccatcgtcttaacagcttcgtcatattgaattaaagaataaatttgcttaatcataaaaaatcgctccttcttaatttaaaattgtgagtgcttctaatttttggctaacttgatgcggggtaatatctggcaccgactttgtactttctaatgcaatgctagaggctgcttgagcaatttgcccagtcgcctgtagctcacgttccggattcgtaaagtaactccaagtaattgctgccataccacagtcaccagcaccattggcattaacaatatcggtttttagaatcggcacgtggaccatttcacgctggttggcacacagaataccatctgctcccaatgaaataaaaacgttttgcacacccttatccaacaagacagccgctgctgcctcagcagatcgtgtatccgtaactttcacgccactcagcagtgatgcttctaacgcattgggctttaacgtatgcagcttatttaaaatgtgctcgaagtggtgcgccttggtcactgatacggtatctccaaataatggaaccgttacatgactgccaagccaatcaatggcttgctgggaaatattggcatcaatcaaacaaatatcagcgtgattaatgaagtctaacttagttgctaagaattccggcgtaatctgttcgcaaatcgccatgtcattcacacccactagcatatcaccatgctcatcagtgatgtacatgtaggttgaggaccgacctcctttgatctcatgtgcctgatctaatgagatatggttctctgcacaagactgttgcaacaaagccccgttataatcatcgccataaacggtgacgaggtaggttggtacctcaagatgtgctaagttttgcgcaatgttttgacctacaccaccaacggccatgccaatctcgccaatattggaatcacgttcaattacctttctgtctggcattccgaaaatatccatattcattccgccaaccacaactacataacccgtttcactttgtaatttctgactgttcatgtagattgcctcccgtttagttaaaagcaatttataaacaattgtttattcatatagtcatttgacacttagataatataatcattgggtagggtttgtcaacaccaaatgtatccgctttcaaaagtacttggagtttgctcatttttaaatctgccagtatcacctattgttcagtatttaacagccatataatctctgactttcacaaaacaaaaaaatggcatctcctttcggaaataccattttttaagcgactaatttgaaatttgttgttgttgctcagttagcttagccaaagccattgtttgattaactgcatcatatgattcggtggtaatataagccgccgccacaccaaacttagccgtctccaaaaaatcttgatgattcacccgcgcccaagctaggcccgcaatcgcagcagcacctgcaccattcgtattacgaggaatcttttcatcatcttgaaaaaagtaggcttgcgtctggctttgataaagaatacccacttcatcgatataaataaaaacgttctggacaccacgttccagcaatcgttccgctgccatacgtgctgtttgttcgtcagtaatcgttacttttgtcagcacggttgcttcaactgcattgatgaccaacgtatccaaccgattcatgccatcataaagattcatcatcttattacgaccaacggctttcgcaaatatcggcacttgcacattattataaagccacttaatgctacgcttaggcaaattagaatcaatgataattaagtcggaattattaatgacttgttcctgttgcataagatattccggcgatagataactattaatcgccatatcatcaattccgacaatacgatctccattgggttgattcacatacatataggtcgacgttgcagcttgattaacttgcgttgaatgactaatatcaacaccattttttaaagcatcttctttaattcgttcgccattgcgatcatcacctaatgctgtaattaaataggtctttagttctaacttactcaaattaacagccgcattgcgaccaactccacctaacttatagtaaatattacctggataagaactttgatttttaataggttctttagcaacaccaaaaacatccatattggcgccaccaattaccgtcacatatttaggtggtgtaatcacataaccttttccttgaatatagccttttttcactaggttagaaatatgcgcagccacaccagaacgggtaataccagctaacttggccaattcgttttgtgaaatcattggattttgcttaatccactctaagatttgctgttctctactgatcacccatcgtcaccttatccttccgttcatgatagtctctatacctatcatacctaactttaatgagaaatgaccgtttctgtacaaaaaatcccatcagtcataattgaccgataggattcaccataaatttctctaattgggctagctgggttcgaaccagcgcatcacgggatcaaaacccgttgccttaccacttggctatagcccaataagtggtcaatacctgacccccaacaagaaataattttagcattacattaggggaaaacgcaagaccttttgtaaaaaaaatcgttgaatctggcttgcgtccaccggcttgaaccgctaacataatattaatagctacgatacatggcccataaaatcaggtgacgaggtgaatttttatgactggaaaagtaacgattaaggatgtcgctaaggctgcaggggtgtccgaagcaacggtttcccgcgcgctgactcacagcccacgagttaaacgcgatacgcgccaaaagattcaaaacattgcgaataacttaggctatcaccccaacggccttgctcgtagcattcgactccaacatacccatacccttggggtcattatcccagatattttaaatgcattctttactaaactcagtcgggccattgaagacgccgcagataaagccggctatgatgttgtgttggtcaacaccgatgagagtctcgccaaagaggccaacgcactcagtctgttattagaaaaacaagttgatggtattatcatcaccagtgctggtggccccactaagtacactgatattttgggcaacacaccagctgtctttgttgatcgcgtgccgcccgttactggccaactagcttacgatcgcgtgctggttgacaatatccagggcacgcgggctgttgtcactgagcttattcatcaaggcgcccaacgaattggaatcatcaatagcgccgtttcctttacagcgacggaacgcatgaccggttaccgagaagccctaacccaggctggcttcgagcctgatgctgctattgaggcaacggcgcgaacggacaatagtaacgtacaacagatgacccgccagctactggttaatcaaaaatgcgatggcctcttcgttgccgacaataccatcatggaagaagttttacgcaaacttccagcgcttgatctcccacccattcatttaggtggcttcgacgatcaagattggtttgacttcttaccccaaccgattgtcacggcgcggcaacccattgctcaattggggcaaacagccatcgaccgtctgttggctaagattgacgaccccgacttactcccggaagagattcgtctcgcggccacaaccatttcacgctaactgaacccctaaaagctgttgcgcgaaatacgccgcctgctcggtatttaaatgacacccgcgcaagtcattggccgttagccgtaactcatcaaagtcacacgtactcagatcaagggcctttaacccagtaccagaaaaatcggcctgattcaaatcacagcgggtcaattgagtcttaatcatcacgctgtcgaggcaattaacttctactaatcgacttgctattatcttgacgctagtgaacttaacctcattaagattggccaatgataaatcacagtccgtgatgaccacgtctctaaataccgcgtggtcaaaggtggtcccgaccaacttacaattctgcagttgaacccggtacaggctggccacttccaactgacagttaaccaatgtacagttcttaaaaataacatcagttaactctgcacgatagaagttatcattaataaacgtcgtcccttcaaataaacactgatcaatcaacggatgctccagtgactggtcggcaatcgtctgctgttgtacatgggccatttgtagctgccggtcttcatcagctgtaatggctaaaaagctctgcgcagttaatgttgcgggtaagattctcgggtcgttcatgaaaggtcctccttaatcagtgaccttagtataccgtaagtatgttcccaaattaaaccgggcttcaccatctgccaaaattggcagtgctgaacattaaaaatagcggctactgatcagttatttccgtcagtaaccgctacttttattaaaattcattctctttaatcttgcagcaatatcagttttaatccaacaagactaccattccttgccatccaacaccgccgtagcccagcgggaagcggcaaatgggctcagtaccgtcgttatccttagggcgcgtctttcgtgcgcttaggataagaccgagctttaagacaagtggggtgcttggcttaaagtcgtgtccgggacgttccagcccatttaccgcgaccagagggcggacaacaatcacaaacactcaccgccagttggagaacctacgcaatcggatcataattagcccggggaccgccaacatattttggccgtgagcggagggccgtcacgtgagccccgccgagttccaaaatacttggccgaacgggaacctgaacgaacttcacgtgcatcccaattgctgtatcaccaatatctaaaccggcttgtgccacaacgtgttcgacttcaattgggtcggtgaactgctgaaaggctgcaatggaacaagccccacccgcgtgtagcgcgggcacaacggttacctcttcaaatcctttatctgcggctaccgcacgttccaccacgaggctacgattgatgtgctcacatccctgcactgccaaatgaatcccctgcgggtccaactgggcacgcaacgcccgaataatcgtcgtgcccaccgccaaatcagaattcttaccaatgtgtccacccacgacctcactagttgaacaccccaagacaaagacatccccacgatgtaattttgccgccgccaacacgtcttgaacaatcgttgtaacctgctgtgttaagtgatctaagttcatttctgtcatattaaacgctcctatttttatactaaatctggtttcaaccgcgtcaaaggccccacaattgagagggttacccctgcaccaaaaccaacttgaaccacattaccaaagattgatgccaatccggctggccagccaaatagcaaggtcgtggccaaacaatacccaatcaccattaccaagctcccgactaatagcggtaatagcatgctcctaatacctttatggtgtcgcggaagcaaccacccaacgactagcccctgcgtgccgtggatcaccagcgagaagagacaccagactggatagcccgtcaaaatatcaattaaaaagccactagcgccaccaactaataagcccattcgccgaccgtacaaaatagcactggtatagataccaacttcgcacaaggtaacaatccctttagtcgccggaattggaatgacgacgagaatagatagcgccaccgtcatggcaattaataccgctgcaatcgtgttctcttttaagcttcctttggtcatttcgtcaccacctgatgccagccaccaggccacacactaccatagtcatgactaatggcaacgccgtgtgtaatggcagcatgcacaaattttttagcaaacgtcaccgcttcaagtagctcctggccttttgccaattgcgcggtaattgcggctgagaaggtgcaacctgccccatcgctggctgcattcaagatgattggcgcttctaaccacgtcacgtcatccccaatcaacaagcaatccggggccactgacccacccaagcgactgccacccttgatgaccacattagggcaccccagcgcttgaatctgccgagctgctgcgaccatctgttcacgattggtaatggttaatccacttagctgctgggcttccagcagattgggtgtggtgatcgtggccaatggcaacagtgtctctttcaaggccgttaaatactcgggcgtcacttgcaacggcccttccttaaagaccattacgggatcaacgaccaccgatatttgggatgaacgtaagcatttgactgccaaagtaagcgctgtcaaattaccgagtaatcctgtcttaacggccttaatcgggacctggtcaaaaacggatgttaactgtgtcgccataacttcagccggcaactgaaaagccttcagttcatccgggagcacactcacgacactcgtgagcacactcaggccaaaagtatgtaattcttcaaacgtttttaaatcggcttgtataccgccaccagctaagctatccgagccggcaatggttaagacattttccatctgatcgcccccacgctctccagtatcggtcagctgtgactcaagtacaaccaccaattggcttgttttaaaaccagccaattatgctatgctagaagcaaccacgaaaggatctggacgtatgctaaattggtcacatctgcccgccatcaagcctaaatacctcgccattacgcaattcattaaacaggccattcaaaatggtgatctgctccccggccaacgtctgccagctgaacgcgaactcgcaacgttattgcacgttgatcggtcaaccgttacccgcgctttattagacctggctgccgtgggtatcttggtcaaaaaaagaggcagcgggacgcttgtcgcccaactacctcacgtcaatcaactggctaataaagttaactggcaagccttcttggagaatactactgccacccgacacgctacgtatcaacgaaaactagccaaggctcgaactaccgcaacggttcccctcattgacgcagcagcaaatgagctgccaaccaacctcattccccaattgggaaccttaaccttagactggcagggctttttgactgcccaacaacaagaggaacgtacgggttatctgccgctcatgcaaaccatcaatcgctatcacaccgcacggcagcaattcacattggaccgccagtccctgattatcaccggtggcgcccagcaagcgctcctcctcattcttaatagcctgttacaaccgggagacgcggtagccttcgtgaccccgtcatactttagtgccagtgcggtgttcagcgccgccggggtacgcgcctacacgattccaacgaccacccttggtttagatttgacggcgttagagaccgccattattaaacaccggattaaactacttatcctaaatcccacactccaaaacccaactgggcgcatcctccccttagccgaacgtcaggctattctggcactatgccaacgctatcaggtcgccattgttgaggacgatgtcttcggttggctggttgatcgtgacatcgcagttcccccatttaaggccctcgcaccagacaatgtgatctacatcagttcgttgtctaagctgctggggtctagcacccgaattggctggattgtcgctccacaagctatcggtgaacgcattcgccaggttcaaaaaaacttggatttagttcccagtctattggcccaggtcatggccgatcacgccctaaacagtccggaattttcgctcggcgttacccagctcaccactcagctcgcccagcgccgccaaaatgtgaccgccattctccgacaattacgccccgattggcactttgtcacgcccttgggtggcttttacctctgggtaacacaagctgaccgcaatgtctttgagcatttgcttgagcagcacctcttagtaacgccgggaccgatctatggcgctgatcgttcggcctttcgctttaactttgcagggctggactatcgccaacaacggctgctcatccagcgcctttcttgacccgcattaatggtcgggatacgctgttgacgtatggtccgattgccgaaaaccattcgttagtggtacttctactggtaagcgtcccgtcttagtattacccggctctccaatataaacgtgtggattaccataatcggtgtcggctttggcttcgctggccgctgactgcaccgtctcgtcactattgtataaatagtgcccgttggtaacaaatggcccttgcggtagtggtgcccggcgtccggcggcagcttgtaattcagcaatggtgtgttgacggctatctggataaacttcaaccatactacgcccggccgtatcaaaggtgcgccactgaaatgtcacgcgtttgactcgatagtgctttagaaccgttcggtatttaatcaagctcaacatatctccttctgacatattggttcgcacttgtcctttcacatcccccattatctgacttcccttagcgactaatgccccttgattgagtcgtttaagtaacgcatacaacaccgcctgttgtcggaagccacgatattggtcattatcgacgtggcgctcccgggcataagccaaggcgcgggcaccattcatctcctgtagtcccgctttaaaatgaacagcgtgtccccaatagttttgaccaacaaaagcacgatcgacgcgaacgcttaatggtccaatatcattaatcgcttgaataaaaccatcccagtttagcgtcacgtagtaatcaatcggtagcttcaagaaatgctcgaccgttgcaacggcggccgcatcaccaccgtacgtataggccgtttcaattcgctgatagccatgatattgttgcgaatagatcttcgtaaacgtgtctcgcaacaaactgcacaacgttattgtcttagtcttatgattcacgataaccaccatcatgccatccgttcgactagttgataactttcttttcccactgttatccagtccgagtaacaaaaatgtgctgactgatttgttagccaagtcttgatggtgcttgataacctgttcttctttaaacgaacgtaacgtctgaaaaaactgaacgccttcaaccgtcacggcgattaatacgatcaccaagcagactcccactaaccaaaccaatcgccttactcgaaaatgttggctctgcccatgcttcattagttacgcctcctacctgcgattcatctgcttgaaatattgcgttatttcaagtgttttgcgcataatttgtgatgccgtccgttgttcaacgggcgttttaagtcgatacacgcggactaaggttcccggagacccattcatcacatagatgacattagacaatcgaaccgcttcggaaatattatgcgtaatcatcaccaacgctttcatattcaggtcaccttgtcgccacaaggtcatcaagtctgaacttaattgctcccccgttaacacatctaatgctgaaaagggttcatccaacagcaataattcagggtccaccgccaaggcgcgggcaaatccaacacgttgcttcatgccaccggataactcatacggataagctgcttccaaccctttcaacccaatcaggttgattaggtcacgcactttctgctgaatctgtccctgattgcgtttccgactattctctaacccaaacgcaatgttcttctgtactgtgagccagggaaacagcgcaaagttttgaaaaaccatgctgattcgctgactgggcttaacgatctgtctcccagcaaaatcaatcgtccccgtactcggccggctaataccagccatcatgcgtaacaacgttgatttacccacacctgatggacctatgatactgataaactgtcccggtttaacagcaagattaatatccgtcaaaactggccgaatgcctgatttttctgcgtgttcaaacttcttagagacgtgtttgacatttaataattcgctatttgtcatgatgctacctccccgattaataatgaaatcgtcgttctgcaaaccgatacaggggctgccaaataaagatgacacagatccctaccaacccacagataatcaataccccagtggcttccgctggcttattgtccgtattacccgcgatatacgcccctaatcccgcaacggaaaattgcttggttccccaagtaatcaactcagcagcaatatccgcattccatgcagcaccagccgcattgatgattgctgtaattaggtaggggaaaagtgagggaaataaaaatcgcgtccaccagcgccaaccttttaggtgaaagacttgtgtgacttcttggatgtcagcggggattgccaagtaccccgcaataacattaaagaaaaagtaccattgcgtaccggtcataatcagtggaatcacccaccactgatgcgtggtcccggttgcgacaataagtagggccaccaccgggacatacacgtccgcaggaatcgagccaataacttgcccccagggctggattctatttaatcggcgcggattgctagctacccaaactgctaacgggataaagatcagcgccgataataccaccgctgctaacacccggccagttgttaaaagtgtccaccaaatgagtgtttgccaattgagccattttaaataagtcgctaaaaatccgattagtcctaccatggcacagcctaagctgaagtaccacagcgtcaaccaaagctttagccacttatgcaaccactgcataaattgtggtaatcgcaggttttcccaaacctggggtaagctaagcaaccaccacgtagacacctgatgtcccccactgatgcagccacttaggtaacttagcgtggctcaccagatcgtagactcgtgactgcggcggtaactgattatctgtgcccgtactgtatttatagtgaaccgtcccctttattagtggctggaaaagacacacattagtaaataacacacagaccagtaaggcacccagcgccgcagcgaccgcgccaaatttcgacctatccaaagcaatctggatatacgacccgatcccgggaagaattaaggtctctgtccgtgggaacgccacggtggcttgttcacaggcaactaaggcaaaccacgcggctgattgtgaaataaccatattccataagattccaggaacggcataaataaattctagccgccaaaaccgttgccagctattacagccaaactgatcggcgaccgtcagtaattctttcggcgtcacccgcagcgactgatatagtaccaacataatattccaagcctgggccgtgaatacgccaaagatggcgacggcttcaacacccaacacattattgggaaaccatcccataaaccaagccgtggtaaatgtgagaaagccccgtaatggtaccgattctaataaattaacgagcggcaagataaaataccgagccgttttgtaacgcgccgccatgacgccaaatactaaagaaaacgctaatgaccacagcatgccaataaacaagcgggtcattgttcttaacgccgcttcgacaagttgcgcgaacgtgaaataattcttagatcccagcacatctaactgttgttgtgtcggtaactgactaagtgggcggttcatttgcgtgaggcaccaccccatcattatcaaaattcctaaaccaatcccgcatagcacgagatttccaactaccggttgccacttccttggtaattttaaccacgttataagtaccccttcctatcattaaattgcgcttagttcagcgactaaaaggcccatcagcaaactgcagctgatgggcctaaactaaaatggattgcgagtattatatcgacgcattcattgagttttagcactttaagacgtaagaactagtctagttgttttgaaaaagccttaattcggcagtttctgctttactcattcctgtctctcgacatttctgggcaacaacctatgttcttaaagtaacctcacctaattgcaatttattttttgagttgattcacgaatcaacaactgaattctaatcgtaactattagaatagtcaatagttagccattcatattctccgtaacgctaccaattattatcgttatttaagcttcctttagaattctgtcactttacttaggggacccgcactgttaataaaacttattgggtagtgaaaagatagatctaaagctccgatattgtgctgaaagcactagcccaattcccataaaattaccgagcagcgccgacccgccttgactcataaagggcaaggggattcctgtcagtggtaacagccccaccgtcatgccaatgttttcaaacatatgaaacgtcaacatgacggccacgccaattgagacatagacgtataacaattgatgactcgtcaacgccgcttgcaccactaaataaattaagtacatgaagatacctaacacgaccacgctaccaacaaatccagtcgtttcgccaatcaccgaaaaaatcatatcagactctctgacgggcacataaacggattggtggtgaaagccaattccccagatgcttccagaaccgatcgccgtcatactttgccacaattgatagctttgccctgaagtatccccactggggttaatccaagagttaattcgtgcaaattgataggctttaaatcccagatgcgtcagtaactgttgccccccactggaagtggccgcccaaacaaggcccgcgccaactgtacccgcggataagaaaagccgccacagaaacttactgcgacattgcgagacaagtaaacaccctgctagaatcgccacgaataccattgtcgtccccaaatcatgaatgaacttcaacaagataatgatgggtaaggtgtagcccagcattttctttaaaagccgccagtcgtcttgggcacgctcatgcaagccccgatgataatcttctaccaataggcggctcatcatcaaaatataaaatggcttcatcacttctgccggttgaaacgtcaagggcccaatcgcaaaccaacttttggctcccgtctgaataaaataagctctgctgtaaaaaaacaacactaagactaaccccgctaatccacagtagtaaccaacagtggtccactgcaacaactgcctttcactaacgtgcataatgagactagccaatagactccctaagagataccatatcatctgcagtccaactgttttaactggactggtaggatttaagtcacgactactcgcaaaataaagcgcccccatactcagacaaaataacaggatgagacacagcacaatcccccaaccataatcgcagattcgatcgttggtctcaacgctattgacggctcttttatccattttttctcctccactagtaaccctaaagatgcccttagtataacgacatagagaattatttcactagctaatggactttgtttaatctttattaaaggccttaatcagattataaaatttacgaatgcgacgttaattctcaatatcacctaaccgattcaatccttgcagctcaagcaactggaacatgaccaaatcatctgcaaggaggtcgatagaacttacgtcccaatcaaaaccagctatcatttatctccgctgggtcagtcgttggttcccctcattcgggcgatggatacttggagtcgagattatttacaaatcgtggcaaataactagaaacgttaatttatacactaacggactagtgctactttaacaattacccgataatgtatcccattggcacttatattcagttcccctatccggtatactaattaacaaatacagcggcaaaggatgaaatacatacatgaatttccgaaaaactagattactgttactcctcgtactcatcagtggattatcgctgacaccccctgctttcgctgataaacaccttattgccgctacgtcgcttaatgctagtcactcagaacaactagggcgtcaattcaccgaattagcaataccattacacctcaataaccgcttaatgccgacggccgcgtccagcagtcagccaacgtcaactttttatgagaagtgggttaatggtgggttaaatacatttgcaccaaataaatcggccttggtggccctgcatacctattacggtaagatcgcagtttctctgatgctggggggtcccgctggcggtgctttagttgctggcctaccgggcgcagttgtggggactgttggtggcaatctgatggctaaccgcttcaacaccgcacaagctgacattggcgaattgatcaatgccggtgccactcagggtggttgtcgcatcaccttagttgacgagtttcccatcgctaatctgtcttctcaaatacaagccaccactcaaaaccgttaggagcgctatttcccatgtattttttaacactcattggtctagttatcctactactggcccttgtaattggattcatcagatatcgtcatgaccacacccataagcgccacttactattttcaatcctatacgggttatttggtctcttcgtgataatgtggtcttttttaccataagtacacaaaaaccggcaaaccgctctcgtaatcgagactggtttgccggttttttggtcatgcctaactaaggttttgacacaacttttgctgattatccgtgtccccccaacggcccttcgctaggctccgggccggagaccgattagtttaagatctcacagaactcaatggtttcgtgatttggaccgagaatattaaagaagcgaatacccttatcccaaaatgacggaatcgattgaatttcagtattcaccaggtgtaagccttgttgcttagcagcagcaaacgccttttccacatccgtggtgtttaatgagatatgattgattgcgcctgccgtgggattcgtgggatcaccttcccacgtttcaatcgttaaattgcccaagcgcatgaaggcacagcgattttcaccattgtgaaagaggccagcccgttcaaatcctagtgactgataaaacgccatcgtttgctccaaatctgctgtgggaatacctacgtgttgaatgcccgtaataaattcttgcactgccatattaagactcctttacttgaccaacgtcaaccgcttgatgcttcaatcttgggaagatcaccttatccgcgatacccgtaatcccaccttgtgctaagaaagcaaagatggttcccagcccaaagttagtaaatgttcgggtaatcaccagagcaacaatcgccatgatggttggtggaatgtatgaggcccacatcgccttggctgcattgcccttaaagtaccggaaccgaagaatctgcatcaaatcatcagccggatgtaaaaccaagttaacccgttggtaaatcgagattgccaccgcaataaaggccacgccaaggaagttcaagccgacatataggatcaccattcccagactacgggcttccggtaatccactgaacaacgccggatacttaccatcaaagaaatcttcaaaaacttgaatcaatgcggagaatgggaccataaagaccatgtttcctgcgatccgtttccaatcccaatgatgaatcaaaatggcatttaaaacggccgtgagaaaccccataatcaggaatgcccaaaagaggttccaatgaaaggcggttcccaagttcgcttcggctgcggaccaataggccgccccgaggaaagaagggtgaatcttcgcactggttaccagcgttaagacgttacccgccgaattaatcacaagggagagtgcaaagtacgcaatcgccttgcccatagaaatggtgcgcccactgttaactgccatcgtatccatcccatcgtttgaacgaagtgcttcagctttcacaataatcccttacctttactagtcgctgaccttcacaactgccttgctgacatgttccactttgccgttcaagacatcttcaacttgttccagactaacttcgtggctgatcaaagattccacgtccaattgcccacttgccaacaaagcaatggcatcttcaaatgcatatgggttgatgaaggccccttggatcttcaattgcttttggtaaacttcatacgtgttcattgagaacgtttggttaggcttaccgaccccaaacatcagcacttgtgcgcccttcttagtggcttcaacggcttgttcttgcgtttgtggcagaccaaccgcttcaatcacaacgtcgtagtcggctggaatgctgtcacgagtggtgttgtatgtgttagtgacgccaaatttttccttgttaaaggctaatttttcatcaacaatcccggcgaaatcaacttggtgaacgccataggcttgcagtaattggacaaagagttgtcccataaagccatccccaataaccaaagccttttgataaggggtgagatcaagtaacttgactccgtgaacggcacaggagattggttcaaccgtggccgctgccttcagtgaaacactgtcaggaatggggtaaacaacggaagcaggagctgtgaagctttcttccaaaccaccatcacgtgtcaccccaacggctgataagttgtcacataattctggacgatcagtccggcagtattcacattcgccacagtagatgttagggtcaacagtcacccggtcgcccaccttcacgttggtcacgttacgaccaattgcggcaacaattccggaattttcatgacccaagacaattggtggcacagcatccgcagaaccaggaagaccagcgtataaggcccggtcagtcccacaaatccctgcataggcagtattcactaagacttcatcgtctttgacagttggtgtcgtgacatcttgcatctcaaattgttttgtacccgttagaactaaagctttcatcagtaaatctccctctcttacttgttgtattcgttaagtgctagggcaaaatcccccagcgtggctgacccattgtccttgacggctggcatcacaatgtaatctgtgagcttaccgacatcgacatagtggttcaataactggtcaaattcgtggcggaccttatccagaaaagcttcactcaccacaccgccgccaaagacaatcttgtcaggccgcatcatcaaggtgacctgtaaagcggcttgggccacgtaataggctaaaatatcccacacgtgatccgtcagtggcacgtccttaccaggtttccctagccgcgcgtcgaacgtgggaccactgactaagccttctaaacagtcaccgtgaaaggggcaaatcccaggaaaatctaaatcgtcggggtggcgtttcaatcggacgtgacccatctcgggatgaccgaggctaccaacgaagttcccgtcgatgatggcacccgcacccacgccggttccaatcgtgaagtaaacgagtgagttaatgttttcgttgaatagcgtggacatcacgtactcaccataagccgaaccatttacgtcagaggtccaatacatgggcacatctagttcctgcttgaggcgaccgacaaagtccgtattggcccaaccaaccttgggcgtattggtaatgtaaccatatttaggtgaattgtggcgcagttcaatcggtccaaaagacgaaatggcaatcgcctttaaatccgggaactgtttaaagtacgcgatggtctgactgagcgtttcttctggggtggtcgtcgggattcggaccttatcctgtgtgcgataatcctcgttaccgattgcacaaacaaatttggttccccctgcttcaatacttccgagttgcatattgctaacctccatatttacgccgggggccgtgacccgcggcaccgttttgactaaatgttatctgactgagacagccatctttaattcgagattagtatagcaagctaaatttgtgaaaataagggcttttggatttttattttttcagaaaatacgcttccatcccgataatattgcaatacaatcgatttcatttttcgtgaaattggtcacttatgggcgattttaataccattttctgtaagcgcttacttttaaaaataaatggctgaatctagccgtttcatcctttacagacccctggtaaaactggtataaagaacgtaacactttaatcaagagaggaactcagcccatgcaacgaaaatatcgtgattattttgcctacctaaaaaccattaaccctgatcccaacgcctccttcatcgccgtcagtcctgcaaatgtgcagaaaactgaccccgataaattcgccacactaacggcgcgggctggccgccgatggggcgttattctcttccacgcgctttatggaaataaaaccacgaagaaaaccaacgttccctatgcggtagtccatgaggattccttcgcccgtgactgggacggcattgatcgggccgaattcgatgaagatgtcgcaatcctcgtccagtgccacatgctccaagtcaaggaggttcaaggactcacgcgtctaatcatgcgctacccggaaccattagccagtctggctgacctgcgaatcaaaggtattgaccaaatcaaccctggataataaaaagctggttgcgggtccgcttgtatttatgcggacccgcaaccagcttttctaatcttttaattactttgcatggcgtgcctggtaagcgcgactataggcatcaacgccgcgcatggcttgggcaacatcatctggcgttaccttaaatggcatacgatccatggtgtcggccggcgcagttgcttgctgaccaaccttcaacaggtcttcatccgtgacatctggaatcttcaagtcagctaaggttgtcggtaaccctaatgacaaatcaaaggctaaatagcggtcaaattccgcttcactccgaccttccaagaagagttgggtcaacgtgccataggctactttttcaccatgagttaactcatgaatcggtccatccaatgccgttagtccgtcatggatggcgtgtgccgcagccaaaccaccactttcaaaaccaacaccactcattaatgtattggcctccactatcttattgagcgctggcgtcacagcatgttgtttaacggactcgagggcaaggtgaccgtaagcaaacaaggtatcttcacacttctgggcaatcgcgttaccgaccagcgtttgtttagcgcccagcatagtggcattatcccccttggcaactgcttgagcctcaacattggtggctaacgcatccgcaatgcccgatgctaataaccgagctggcgcaccggccactagtcgggtatctaccaacacgaggtcagggtttttgtcgtaaaagcggtattctttgaacgagccatctgcatgataaataaccgataaacgtgagcacggcgcatcagtcgacgctaacgatggcaagatggctaccggcaactgtagattatcagcaattgctttggcagaatccagcgtcttgcctccgcctaaaccgataatcacctctgccccaaactcccgaccaatgccagtaatccggtcaatctcttcaggagacgcttctccacggaagatcaccttatggaccgctatgtggtgatcatcaagatacgccttgaatcggtctccaataatttgatacaccactgaatcggccattaatagggctttgtgaccaaatttttctaaataagcgatactgtcaaataggacatctttaccttgtacgtatgaagccggactaccaaacatctgggtcatttaaatcgctccttactaatcgtgattattttcacaacaccatcattatacgatgtgctatggacaaccgcaaacattccggttgcccccatttttaagatgtgctaagctatggctacattatcaagtcgcatacatttgttctctagggttccgccacacgggtctggtccgagagagaacctgcgggtcagtccgtagacacggaagggaaaaagcctgggagattttgtcagtcattgacaaaatttctcaggcgctttttttgataattgctgattttaattaagcaactaggaggtttttgatgatgtggaaacattggttaaccgtcgttttgggcgcggtttttgaagttagttgggtggtcggctttaagcatgccacgaccccctgggaatggttagcaaccggtatcgccatctacctcagcttctactttttgattcgggcgagtcgaattctgcccgccggaaccgcctatgccgtgttcgtgggcctaggaacacttggaaccaccagcattggcatgttcatctttggcgaaccgattagctggttaaaaattgccttgattctactgctactggtcggtatcggcggactgcagtggacaaccacaaaggaggccaactaagatggcatggttatttctcattggcgccggcttaagtgagatgttaggcgtcaccttgatgaattgggcacttcaccgcaagacgtggtggctgtgggtcctgatgattctcgcatttaccctgagctttggtggcttggaactcgcgttaaaaaccttaccgatgggcaccgcctatgcgatttggaccggaattggggccgccggtggcgttcttaccggcatgctattcttcggtgaatcaaaagactggcgtaaactcgtctgggtcgctgtgattctgagtgcaacgttgggtttaaaattaattagttagtaacttatcgcttgtgccactcttctcgcaacaccccatactttactgaatcccaataacgaccttgccagtagcgaacctggcgcacccgggcttcttcacgtaagcccagcgactcagcaagatgacacattcgccgattacctgaccacgtggttagtccaatgtgggggagcggcgtttgagtccatagccaatcaatccattgtgataatgcggctttgccaatccctcgttgccagcggtgttggtcataaatggttatgccgacatctagccaacggttgagcggcgcatcatcgtaatatgcaaaaaccatccccaccatttgaccatctacccaaatcacctggcgccaaggctggttcacgtagtcttcgtggccggggcccgtcacaaattctgcataggtcggcacgtgatcgtgaaaatacgggccattccactgtgtccatgccgcctgcggatcacgaaaggccaattgccaaaacgccgcaacttcctcgcgcgctaggggttttaacgttactttcatgcgtatcatctccttaatggcttctagtataaaaaaagatgcccccaccacaacctcagggtcatcttctagtcatctatttagctaacttggcgcctttatccacgtatgtcatggaaccaatcggaccactaacggctaatttgccgtgtttataaactaatttcgttaccgcagcattcttcagcggtgcgccggtgtacttgctaccggccatggttgagagatattcgttaatggacatcccggaactaacgaccaatgcgttaccgccgccccgcttttgcgtagccttggcgatggttaacaattccttagccatccgcttttgtacttgcttagaactttctgctcggtcactagccaccagattggtcttttggctattttcctgatcaagtttgtagtaggcatcctgtaacagattccagtagtctttaccttgcttggccatcatttcatcaccggacttgaagccgtaaacaccggcaattaaggcattgtcagctgcaatactgtcaccttcaaagctgccgtagccgccttcacgtaagtatttggacacgttgaccttaaccttcttgtttcccgagtacttgagcgcttgcttggccgtcacttgttgccgggtcaaattcccagcataggccactttgaaagtcttgcccttcaagccgcgtcccaagttgttggcaacggcaatcccattgctggtcagtgggaagtcgctccatccttgaacccgtcccatcacgtttccagtcgtttcaccatgccgcgttaaataaatcgtcacgggtttaactgctgctttcttcttggtcttggcctgcgcattgctgggtaccgccactagggccaatgcaccagcagtcacagctaatagactaacaactttcgtcaatttcatgggtgatctcctccgaatctgaaatgatgttgcatggttagcgatgctctatttgacgaatgactaaaattgccaataaggaatcgcttacattctaaaatgtagcatattcgcttgacgagaacaaccatttttttgcggtcttgtggttcgaccacttaacgtttaggaattaactagcgagcatggcgttcgccgatttaaaccaaagctaccatgttccaacaatcacaggaacatggtagctttgactggacttttcaagatgctttgccataatttgaatcaacaacaaggccgcataagctaacgtaaacgcccccaagacactgaagctggggcgtgccttaggtaaaagcaagtagcgcatccaagccaacgcgagtattaccgaatttaccaacaatatgacccgctcttttgatagcgcgacatctggtaataacatggttcattcccccttattgctggcatcgtactgtttacgtgaccaaatcgcaataattacttagcagatgatttattaaatgcacgcaaccaagatcccttgtgacccatatgggttgaccgccgttaaatatcatatataatatgtttatcaatacaaaaagtggcgaccgtccgaccggccaccacaagttcgcaagtctagtgcggtattgtgggggctacttctttttagaagtagctttttttattatccgatatgctctagccaaattgactatcgctaaggataatacgtaggtcgccatggcgaacgccacgcccccaatacctttctcactagtatcgtcatgttcaccgccccctggtctagaatgtgggagggcgtaaccgactatcttgctaagtcgtgctccgggtaattacgccttcgcttgactgtatccattactatatagtagccactacgaataagcaatacattttatactgtatctttccgttacccagctagcctagcatcctagaaaaggcaacgactgacggtctaagtttccgcaatcgttgccttttggtattacttacctttcacatctaccgagccacgccacttcaacgcactttcttggctagcgaaatcaactggccattgacactcacaccatacgttggaatggggccactaatcaccaccaccgtggtctcagtggccgtcagcttaatctccaacacgctttcggcaatcttcatccggtaggttagctgcgtcagttctgacggcagatgattggtaaagtgaaccacctcgtcttgcacgtagaaccccgagaagccagcgactaaagccaaccaactgccgcccaaattagcgagatgcagaccatctgccgtgttcttttgcagattgaccaaatccatttgtgccgtatccataaaatagcgatagcccttctcgacatcccccatccgtgccgctaaaatactgaaaatcgaacgcgacaaagaagaatcatgcgtggtcatgccttcatagtaatggtactcccgctgcaactgctctggcgataaatcctctggaaacaggtaatctgccagcaacgtgtccgcttgtttggcaacttggtaccgatagattgtcaacgggtgatagtggagcaacaagggaaagttttccggtgttgactgcgccaccggccagcgtggcttgctcagaaaactatcatcttgcgcgttgatctgctgttcagtactataaggcaaatacacgtgctctgccagattttggaaggcatcaatatcggtcgcatcaatcccaaatttagttaaaccattggggtccactttcaaaatctcctgtgccagatacgtaacgagttcaaagttgtgtttagctaagcgattggtatagtagttattattgaccaacgccgtgtactcatcgggcccagtaacggtgtgaaattcaaaccgctgactcgtacccacctgatgccaggaaccaaacgcttcccagaaatgcgccgtttccaaaaccatttcaaaaccacattgcttgataaaatcaatatcgcgggtaatctcgtaatacttacccactgcataagcaatatcggcatcaatgtggtactgtgcggttcctgctgggaaataagccgaggcctcttcgccattgattgtccgccaagcaaacaaggcgccttggtcgacccccagtgtccgggcgcgttgccgggcctgtggcagtgtttggtaccgatagaccagtagctgacgggccatcggctgattggtatagatgaagtacgggagcatgtacatctcggtatcccagaagtaatggccctcgtagccggaaccactgagtcctttggccgcaatattggtccgtccatcacgtccagccgcctgattcaattgaaagaggttgtagtgaatcgcgagatctaactcatcgttgccccccaccgtgacttcactgcgttgccagacatcttgccaaaagtcacggctgtcggccaacagtgcggttagagccgttgccggaaatgggagggcgggatcgatggtattttgttgccccatctcccctacatagacttcatagctcaggtggtgcgttgtatggtcgctcaagtctactggctgccgcaagagactccccggtgttgtcaacatccccaaatagatggtcaccgattgcttggtctgccgcgtcttaacgtgatactgctgcaagtcttttgccataaaggtggtttcacaaatgggcagcccggcgagtcgcgtcttgcgggggtcagcagatggtaagctttcggcttcggcgggaaccgcaatcgttttattgacgactaggccaccagcataattgccggcgagaaagccataattgaccgcccaaaaagccgtctgcgtctgcccaatcacagactgaacactcattgcaatcgtttcaccctgccgtgtttgcagtgtgtagtgttccgtgagttcccccgttgccaaatccagatcaactttcgtccgctcactgctggtaaagctgtgcccggtcgttgtcgccacgttgatatggcgaaagtcgggtaagttaagaatcgtttggtgggccttcgcgtaccccacaccggcttcgccatacgtaatcggtgccgtttcatagaagccgttgatgagcgtccccacaattggatttcccgtaatggggtcattggctcgtaccccgaagtgcccgttggctaaggaaaagacggtttccaaataagccggttggtgattggccacatcgtgtagtgttaaatgataatcttgtaacgtcaacatgatctcccccagttgtcggatttgcacccggtttaaatgaattttgccgctgtcatcaacgcatcttccacggctgggacattgcccgtaaagttcaaaaaggcatggctgatgccgccataacggaagtagttagcatcaccattggtgtgccccacacgcttgatgaaggcttctccctgtaggcggaacggatcatattcgcccaccagtaaggtcacgttgtgaaagatcgttgggtcggccaacaatggcgatagaagtggggccgtcaaatcaacggcttgatccgccacatagtaaccactcatgatggcatcgagttgctcgaacaactggtaactccgatgtaacgccgcccgttgctccggaacaatcgtaatctggctatcgtcccacagtgggcccgtcaacttagacccttgaataactgttgggtagaacaacacgtgactggcaatctcacaaattcccatggacttgcagagttggctaacgcctagggcaatcgatgctccagcagagtcaccgcccaaagaaatatgagcgtattcagcagtcatcgctgccaccacagccaagccatccagaatgccggctgggtaaggctgttcgggggccaaggcgtagtcgacattataaaccacgcaattggcctgttcagccacaaatttcaatgccagtaaaacatcttccggcgtgccgccgtagtaggcaccaccgtgaaaataaatataagctttgtccgcgttcaaatgatcctcacgggcaatacggatgacccgcactcgccgattcatcgccacaatctgttgcatttcaaccttcatggctgttgtggtcaagtcccgctgaccagacgtttccgtcccctggcgcaaactgaacaggtcggtgggcaactgcggattggcttcaatccccgcaacggtttcccaaactaacggttcgaaggtgtgcagtgggtcccgttctttaacccaactggtgactccatcagcgatatcggtcacaccaatcccctgtagtcggcgtaactcatcgctgtagcccaatgactgcttggtcgttgtatcatttagcatcttgattacccctctcgtctgacacagccgtcaagacctgacggcgattcccgaattcagattaagcgtcttcttcgcttaatttcttctcggcttctttagccgctttcgctgacgcaatcttagattcatctaattggtaccacaggtagagaatcccaccgatcactagggccaaaacgaccggtacccagatgaagttagtggcaatggcagtaacggctttagcaccttgcaccttagccgcagcgttaaagccaccccaagacagtaaccagccagaaatcaaaccggccaggcccatccctagcttagcgccaaccattggtacggcagataaaatcccgggttcgtcaatgtgcagttcggaacgcgagtactcaacggtatcggcaatcatgacaaaggcaatcgagaaggccgcacccatcgcaactaacgcgataacatttccgataaaaagtaacggaatgttcttaaaggccatcagcaattccccaaaggcaaaggttaccatggctaagatcatgacgttacggtgcttcatgaatttactgaggaaaggcaccgagatattcccaataaccgccacaatgactaagccgttaaaggccccaactaacgctggttgatgagagacatacgtcaggtagtaaaccgcggtctgtagccgcatcatccagaaggtctgtaataagataaagctggcactcaagatgagccatggcttattcttagcggccccttttaaagagtctttgactgatagatgccctttgatttcaggggcgtcttcggtttcagctacgatatcatccttttcacgaaggttagcaaaggcgcctaggaatagcgcgataatggcgatcccaatgatgacaccccaaattagccaacctttttcagcgttcttgccgcctagttgagctaccatcggcaacgtaattgcgccaattacggcggtcccaatgtttgtcatgaccatccgcgcactggccagattggtccgttcatcagggtctttggtcaaactcggtaaaatcgccgtgattggcgtattagctccggaataaactaagctaaagagcgtgtagacaacggagacccacgccagttgaatgactttgttgccgccaaatgacgggttaaagaagagtaacatggtcaaaattcctagtggaatcccgaaccacaagaagtacggccgtgccttcccaaatttggaatgcgtgtggtcaattaagaatccatagaccacaccatcaaaggcatcaatgatccgcacgacaaagaacagggtgccagcgaaagcgggcgaaatccccataactgtggtgtagtagaacagtagatatagccccacaatttgccaaatcagatttccagccatatcagtggccccatagaagaaccgctgtttccataattgcatcttactcatgataaaaacctcccccaagatttgttaaccattggtgtaatcgcttacatataaagcataccgaggcatccaacggccgtgaatcccaaattccgaccgctaacttaccttttctaacgtcttgtcacacctagctgagttcgtgcgcgtcgcactacttctagctatcgtctctatcatacgcggtatggtggcctaaacatgagtgaggcccctcactttgttggcccagctaactcacttggactgctaaacgctggttgattggattgagatgatacagatttaaggatacgtgagatcagataaaaggcgagcattatcagcagtggcggttgcgggcgctcaagttatgccgcgtcttgttaagttaccaattttttatagtctggtggttaaactgccgttattgtttaggttaactgaagtacctcgctgtcaaagctagtgataattcgtttgctaacaaaaagagttcaattcgcaagttgaattgaactctcatgtttacgcccactggtgctaattgacagatctatagaccattttttacaaggtcatttaatatcttcaaagaagttatctcgctcttatcaatgagccattttatcaaaatcgtaagacaccatagcacctagcagcattgctagtgggtattcttgatcctattgatttaccaagattctaaagctgccttcgtggatggttcgccttacattaagttcttaaccctattgatttaccaagattctaaagcatgcttggagttgcatttgttggtaattgtgttcttaaccctattgatttaccaagattctaaagctaaattcgatgtagtcgttgatttcttggcgttcttaaccctattgatttaccaagattctaaagcaaggcggtttatacattaacgcctcaatgagttcttaaccctattgatttaccaagattctaaagcacaggaacagcgttcccatttacttgattcgttcttaaccctattgatttaccaagattctaaagctcgggatcatttaatgatttacctttgggagttcttaaccctattgatttaccaagattctaaagcttcagcgatcgttatctatggaggcagccagttcttaaccctattgatttaccaagattctaaagcacatgggcatatcaagattggaaaacaattgttcttaaccctattgatttaccaagattctaaagctctcgagtggcttatattcttccagctcatgttcttaaccctattgatttaccaagattctaaagcaacttgacggccacccaatcaactgggttggttcttaaccctattgatttaccaagattctaaagcttaaactgactgcttaaatctttggaacttgttcttaaccctattgatttaccaagattctaaagcgagattccttccaaagcggcaatcaacaaagttcttaaccctattgatttaccaagattctaaagcagccacgccggatgagttaatacagctggcgttcttaaccctattgatttaccaagattctaaagctacttggtcagtttcttggttaaataaaatgttcttaaccctattgatttaccaagattctaaagctggctggccgccttggtaagctctgaacgggttcttaaccctattgatttaccaagattctaaagctctatgccgtagccaacagctcggttaatagttcttaaccctattgatttaccaagattctaaagctagtcgactaattccatgtttgtgttgctcgttcttaaccctattgatttaccaagattctaaagcaagtctgcaatatttgttttagctttagaagttcttaaccctattgatttaccaagattctaaagcaaaatggacttaccacagggactagaagaagttcttaaccctattgatttaccaagattctaaagctgtatcagaagtcggctagccgacaacaaagttcttaaccctattgatttaccaagattctaaagctaaatgccgtcatatacttctgctttaacagttcttaaccctattgatttaccaagattctaaagcgtcaaaggggacttaagaatgaagcctgatgttcttaaccctattgatttaccaagattctaaagccgacattttcacaccattatctcaccttgagaatttaccacaacacaaaatcgctgtcgatgtagtgatagtcacaatttctgaaatagtctgattgcttggtggatgaaaattcaattagaagaattggtaaatcaatatttgccataaatcttaccaacgattgaagttggctgacctgaagataatggccgacattggtcaaaaccaccattcggtgatcattcagttctatcaacgccttaactagtgtctctagtataccatatacgtcatctcttaaatcaggtactagttgaataccactaaattttatcagctttgctagttctggtgtctctggcaactccaatggaacatccatcaagtaactatccgctaatagttgagatagcaatgattgcagcccatccactaagcccaccgtttgatcatcagctaagactttcaacaacctcgtttgcagttttcgttgaaataacgcatttaaatccacgtttaacaggggatctccataccactgtgcgcccttccctactgtgaccgtggtaaagttgtcatcactaagtttcacagtgtctgttctatcttgcaatcccaaaattatttcttgataaatatgcggggaacccgttgccaacacgactacttttcctggcgtaatcttgaatggctgaaaaccatagtaagttaaattcatatcatcacggttctttctgcggaatttagcagatcctgattaggttgtccagcaataaagtgcatcgcctgatactgcttttccgtcagcataactgactgaaccaatccattagccggtgccagagcagctatccgcttttctatcgccgctgcacccgctgaattcgggcatacccgtacatagactgaatactgcatcataaagaatccttcttgaagcaaggccttacgaaaatgacgatagtgccgtcggtcttgactggtctccattggcaaatcaaacataatcattaatcgcataattcgatacctcatctggcacatcaacctcaattctaattgtctctgtctcttcacttaagtactttaagcactgaacaatcaccttctcaacaacattactcaaaacctcttgtttaccgttatacctcatatctagctcgaacaaccgcgccaaaccaaattttacatccggcgttaagtccagaatattttgttgggcaacccaataatctatgatcggtcgaaagggttccatcaaatctgaagctaaattaaaggcattaccggcattatcgtgatggattccaaaacatgttagatagccccgtgaaacaataatgcgattgaccagggacaatagaattgaataaccatagttcaatgccgcattaattggtacgagatctgaacgcgaaaagtctttaccaaagatcaacggaaaatattgtcgtgcgacaaccgcttctcgattagtcgcgtcattaagctctaacttctccaattcgccacttaaatccatcgtggacacttctaatagattaccaaccgctatttgattctgtatcttagcagcaactacccgtgtccataaattctcaattcgcccttctgaccagccaacttgttgtctaactaacgctgccgttcgcgcatgcggataacattccgctgtctcacagattggttgaccatcccgaccggtaaaaataatcttcgcatgcgcttccgctagcgctgccactgccgccgtcgttattaccacttgtaacgactgaattagtaagacgttaatatctctaaccggagtatgatatcgatctgaatctgtctgaatcaccaaatttcccgatgtcaatgaaatcttagcatgctggctaattaataatgttcgccatcccatagaattttgcctcccttgcattgtgcctaacaacatgatattctgaatgtgtcgagttgacctacttgaccctattgatttaccaagatgcgttaaagtcaaacaaggtgattcgtcaccaagttttaccttttgagcccgttatcgggccatacataattttagtcaaagggcacttcactgaacctatcagcgaagtgccctttgttttttaactttctggatcaatgcgcacttcgcgtttaaacaatccagttggtgattccataatcattttagcagctaatcctaatcgaatgccattaccttcctgtaaaagaccaaatgatgttttaatacctataactttcaaatccttacgttctgcattagcatgtagccctctcataagtcgactaataatttctcgtttgcctacttgcactagctttccgtgatcatcaataacgttggtggttggtagcgcaacaaattgactgcgactgttttgcagtgcctgccggaaattattacgctcatacaagctaaagtatcgttgagcttgctcgcaaatttggtcaaaaactcgcgtcaactctccatctttagcatccttcttcaataacacttgttggcttgacagcggtaaccacaattgctgaagattgcggtaataggtgctcgatctcaaggcaaactgatgaacttctccataaacttcatcctcaatccgctgctgtaagtacacatgcggccggacaacttcaaagtcgattgtgccggacttcttagtaaattgcggcaagaaaagtttcttcaaataggctttttcggcggccagtcctaacttacgctgctggttcacctcagacacaactcgaattggcaccgccataacttttaaatagtccactttatcgtgaacctttacgattgctaaataggctgtattttgacccgaatagccgccgtagattgctgtatctcgcccttgtttcgttggtatcaattttttattttgagctttccgcgccggataaattgtctgatcaaacaacgcaccgtgatcctcaaatacttcatgtgtcactaacaaatgttttaacccgttcaaatgctctaggtacttgatatcagcttcgcgatcccacaataactcaccggtatcaggattaatcacctgcttatctgagactaggtcgtgaataaagttaaagcgtcgtaagtctaactgtggtgctaccttgtattggccgtagacgaagaaacgttccagtttagggtaacgttttaataagtacgtcccaatcctagctgccaagtaggcatcaagtgcgtggtgatagtcatttaattcccgtaatttgggtagtttcagttcagtccgtaattgatgagatagcgcagctttcactgagattaattgtgttttctctgggtcatagagactgctcaatacgtccgttgttaacttaataacttgtcgtgtttccactaactgacgattaacaaaccctgttgcatacttattaatctcatcagcccgcatcaatagatgccgcaatttacgcgcactaactagcccggctgaacgccagagttcccacgttccttgcatcttgctagcgtataaatccgcagcaaagctatcatttttatcacggttaatccgttgctgaacgagtacccgattgtctaacgaatcatctttaatcaatgactgtggcaaaatatgatcaatatcatattgggacagccgatcaatatttaatttttcaccggtgtacatatcacgtccattttgtaagaaatatagcagcaatcgatcagtgaatttggctttatcggctatctggtcttttagttcctcagtgacggtctgactcacaatctctttggcccgatcggcaaataagtcggtcaattgcttttgccgacgccgcgttcgttgtgggttgttatccatcgcgcctcgagccgcctcaataaaaatccgacttggtacctgcccgtgacgcgctgcttgaatgtctctgaccaccgcaacaatctggcgtaaagctttcttattctgcggtgacgtatataactcatcaatcgttgtttccaacgttcggtctttgaacccagctgcgttaatcgcagtaattgcagcagcataatctggttcatgcacaatttgcataaaagtatgttgggtttgccacagttgatccataatcgattgtccttgtgcgtcttgaatctctgtcagcagccgtgctgataagcgtccccaaccgcggtaccgcttagcgctcaaccgattacgttgtgtatccgtcaaccagccgatttcttgtaacttatctttgaaaattcgctggtcttcaaataccgttgaccaattaacaatcttttcaatatcgacctggcgtttaggatcatccactgccgttgacaaaatagcttttaagtcctgatacgtagacaaagaactattaaagttcttcggatcagctaggccctcaataactggacgcttgtcaacatcgccatggtttaccagattttcttgaatcgctttaatactaaccgttctgcgggtcttaaaaacttgattgtacaatcgctgtttttgatcccgccgtaaccgctcaccattaactctgatgccatttaattcattcagcaccataaaacgttgataaatcaggctttgtaacggcaatacatcttcaccaattaagtacgtatcagtcgtcttcattctagcgatgaagttcgttgccgaagcaacccggtcgaccttcttgtcaaaattccagactgtaatgtcaccgggttctttacggaccatccaggcaaactgacccgctgcagttttggcttgttcttcagccgtgatcatcggtcccacatagtatggcactctaaaatgaacgagttcatccagcttataaggttgttctcgtcggtcttcaacgactggattaggcgccgcaagaaatggataataatctttttgattttcaataatggcgtctagttcctgctgatgaacctgataaggaatgaccccattacctttggtacgttgcttaggcatgaacttttctagctcgatggcattcatcatcttctgggccaattcacttgtatcacccttcagcaatcgtctcaattcattgtaaaaatcacctgtcgtctcagccttccccttatcattaccatcaatataatggtcataagccaataggaccttggtccgtcgctgttcgtcagtctggactgtcgcatattctttcagccagcataaatgttctttgtggttgacgtagctttgcaccatactctccgaaaagcctttcccatcaggcataatctccgttaactgaatggccgcctgtaggtcaactagcttttccagcagggccgtttgcttttcatccattagcgccgccaagtcatctcgatgatcctcgatatctgctaggctgaaggttaatgatttctgatcctctttagcaacatccagtcccaaaaccagatatacttgcgcctttaatcctaagattgccttacaaaatgctgtcagtattggcttccatgacttttggttaccagtcattttcataagttgcttgaccaaatcacgctggcggtctagccggctacgagtagtatctaaaatgatcgccgtcacgtcttccagatcttcttctggtagctggggagctaattcatcaaaaactcccaaccaagcttgattaattcgtgtgaagcgctcattaaaatccaacttacccggttggaacttttgtggattaccgcttcgtaaaaagtttccgcgatacttaacaatatgatgaatggccaagtaaatctcacgtaagtcaaactgccgatgctcggtcattaaggcttggcgtaaatgataaatggtcgggtatttttcatagaattccccatcactttgatccgagaatagccgataagtggtgacgagctttgtatccttaggtgatacattcgacgctttctgacgagcaaagaagcttgcatcaattgctgatatcggctcatcaaaaatctcccgtaataatcgcagtcgccaccgtcgtctgcttaggcggcgacgagttgttcggtaaccgcggcgttctgcggccgcttgtccttcttcaaacaagcggacccccagaccagtttgccccttcacccgtttaattcgaccgttcatgtcaacgacactccacccgatcgagctagttccaatatctaatccaattccgtaaggttctttatccacggcgataacgcctcctagttttatcaatcgttcttcgacacccgaagtcattgtactggcttaatctcattttatgctgaattgtaaacgctgtctatactctttatgtgatgaatcatttataacccgtctggctatcaagttgagaattttgatgagtattttatcattttaaaaaaagacttctcttccataagtacccatcatccccgtcacatcagcatcaaaaaactttcaactcccccattgacaaatctaacggccatcgctattattagagtcacattagaaatacatgaacgcatgactaggaagagtagctgttctcgctaagacaagagaccaccggtagctgaaaaggtggcttacaactgagcggcgaagatgaacctaggagcaagtcaccggtggaagctggtggctcgggttgaagctcgttaccgcttccgacttttggcaacagaagttacggagatggtggatgtgaatccaccatgaatcaaggtggtaccgcgagtgaaatcgtccttatgtttttacataaggacgatttttattttgaggagatgttttgggatgcaaagaaaaggaaccattttgaccgttgcagcacttagtttattaaccctagcaggttgtgggagtcagtccagcagttcgaacaacagtggcaagtatgccgctaagcaagtcctgaattggaccgaatcttctgaattggcgaccaccgatcttgctcaggccaccgacaccctaagcttcaacgtgctacagaacacccaagagggcctgtatcgcttgaacagcaaaggaacgccggctaaagccctcgctaccagcactaaggtcaccaatggtggtaagacctacacctttaacctccgtcatggcgtgaagtggtccaatggcgatcccgtcactgccaaagattttgtgtattcttggcaacgaaccgttagcccaaagaccgcttctcaagacgccttttacctctaccaggttaagaacgccgaagccgtcaacaagggcaagaaatctctcagtgctctaggcatcaaagccactggcaagtataccttgaccgtcaacctgaccaaacctgtttcctacttcaagaagctgcttgcttggcccctgttctacccggttaatcaaaatgccgtgaacaaatacggtaagaaatacgggaccagctctagcacaaccgtctataacggcccttaccggcttaccaaatggaacgggaccagcaagtcatggacacttgccaaaaacaagacttactgggataagaaggctgtccatttgaccaagatcaacgaacaggtcaccgagagcaccaccactagttacaatctttataacgccaaaaaggttgatgaaaccttactgagcgggcaacaaatcaagaacaacaaaaacagtaaggacttcgtcaagcgcttgccaaccggttcacaacgtcttgacctcaacgaaaaaaaggttagtgccttcaagaatgttaatatccgtaaggccctctccttagccatcaatcggacacaactcgttaacgacgtgctgcaagacggttccgttgcctccaagggctttgttcctgctggcatgggtaacaatccgaagaccggcgaagccttcaaccaagaagctagcatcaaatccgctgtttcatacaacgtgaaacaagctaagaccttactagccaaggggttgaaacaaacaggtgataagaagctcaacgtcaccctttccgtttctgataccgactccagcaagcagacggctgaattcattcaaagttccctagaaaaattaccaaatgtaacagtcacgattaaaaccgttccttacgttcaattgattactcagcaaaacaacggaaattacgagttaactttagctggctggcaatccgtcttcgctgacccaatcaacttcctcgatgtcttcgaagccgattctagctacaacacaaccggctggaagaacagcacttatgacaagcttcttaatgaagccgagaacgtttacggtaaccaaccagaaaaacggtgggccaagttagttgctgctgagaaggtattgatgaacaaccaaggcaccattccactgtaccaagctgccaagtcacaactcttacgtagcaacgtgaagagcgtcgtttataacccagccggtgtgccttatgactggaagacaacttacattgctaaatagtcactttgtccaattcagctacgatcccctcgtagcgcatccgattggcaggcgtcagccagcatcaccatgtctttcttaagatagtaaaaacaggtcttaaccggcgtttgaagtgcacactggttaagacctgtttttattgtctgtgggtccattcatatctgactgaccaagatagtcgtttaattaataggtaatatccgacaacgcatgggtccgtaatggcttccggaatgcatagacgttagttccatcggcacgtagccgtaatgccgtaacttttttacctaagaccttgacgttcactttggtcttacccaaagtcatcaatgtcacgctatcatcaatccgggctttcacccggtaagttaccttctttttattgttaacctttttactgtaaatcgtggggaaggccgcactcaattgccactttaatgaagttaattgcttcttagtcgtcgtgtagaccttgtaacccatcttcttattggtcagattcaacttagccacagcgtaagccgtaaccttatcttcggtatcgctcccgccgtatatgtaccacgttccgcggtaactctttggtaacgtcgtcttgctggcagcattagcagtcgtgctgctgaccatggcaaacacccctagactggctaccgctaaaacaatcccctttaatccttttttcatcgtatctccactccttttaatataagacatcgtcgccccaagcgtgcgtcttgtttagactacggaaagcatacacgacatcatcttcgccatcgtcaaatgctaacgccgtggttttctgccccttcactttaaccttggtcaaactaaacttccccaaactggcattatctgtcgccgttcgaaccttgtagctaacgtgatgttttttagtcgttttaagttggtacgtcaccgcactttgcagcgtcacttgggttgttaaatcactcagattggcgttctttgtgacattcagttgcgtcgttaagctggtatcagcaagcgttagtcgcgccgtgtaataatagttgacgtgatgatgcttcgtcttaccgatgtacgccacccagtccccttgataatccgctggcaatgtggcagcctgcgccgtttcgtgtcccattccggctaaggtgaataccgcaagtcccgtgatgacacccactaatagttgtttgcgcatagtagtcccctgcttccttcattgatttgtgattcgattcattaattcaaagataatccaaccaggttaacaagacaaggggtttttaaattattcataaaatgaatatcgattgctagtgggttttgtccttatttatctctcataatcagtgacctgtcccgtttgtccattcaaaaaatggcgcctaactactccttctggtggagcatcgttaggcgcctaataatcggcttagctttcaatgaaacgaacactttctcgggtcactaccgtaatgggcgtaatcttaggtggctgttgttgggccgttgtcagttgttccaccccggcaacgcccatatcatagaagctctgggaaacactagacagttgtggctgcactagctcacacaactcggtcccgtcaattgccatgattgacaaatcttgaggcaccgtcaagccaaagtcacgcgcctgattaagcacgccgatcgccgccatatcactaccagccaagactgccgttacctgtggtgcttgaccgtaagcccgcatcgcggcttgacctgccacgtaactataatcacccggttgaatccaagcaggatctggcgtgatccccgcttccattagggcttgcgtataacccgccaaccgtaactttcccgtatgggcatgcacactgtccaccgcggcgaggccaacctgccgatgaccttgcgccaatagcgcctgtgttccttgatagccgacttgccaatcatctgaggtgataaacggtagctgatcttcttcaaaagaaatcgacaaaaaacaatacggaatctgggccgcctgtaaataggttaggttctctgctgacaagtccaccgacagcaataagattccccgaacgggccgttcgatcaccgtggttaatgcacggcgctgctgctccggatcggcatccccggcatacaaaataatcacattcaacccttgacgataggccgcatcctgaatgccttcaataatatgattcgcaaaattggttttcgttgaattgacaatcgccgcaatgacgtgactttgctgggtcaccagctcagccgcggccgtatttttctgataacctaacgtggttgccgcggcctgcaccttagccgccgtatccgcactaaaaaaggccgtcttgttggctaatacacgtgagactgtggccggtgacaccccggccaactttgcaatatccttgatggttgccgccatccgaccaccctactttccttaatctttgctttcattttaccgttaacccggcaaaataacaaagggcatcccaaaaactcatcgttttttacacaaacgtttgcttttctttcgtaaaggcattgcaaacgtttgtgtaaaatgatagaattcattttgaaaacggttacttattttttaaaggaggccttcctatggcacaaacgacacccatagaatcgacggacgttacgccggccgcaaccagccacaacgcgttgcccaagatttcattaaaaacaattttcgccatgacctttggtttcttcggggtcaatatggctttctctttgcaatcatcccaaatggggcggatcttccaaaccattggtgccgatcccacaaaactcggcttcttcttcctcttaccaccactggccggcatgattgtccaaccactagtcggtaagtactccgatatgacgtggaaccgcttcgggcggcggatgccctacttactgattggggcccctatcgctgcattggtcatgatcctcttgcctaacgctggttcatttggctttggctacgcctcattggctgcgctatggttcggcgcagtcgccattcttttcatggatttatcctcaaacgtttgtatgcaacccttcaagatgattattggcgacatggtcaacgaagaccaaaaagatttggcttggtcttggcaacagtccttctccaatctggggggcgtgttagctaccatttttccattcgtgttaacctggttcggggtttccaatgtggcgcctaaagggacagttcctatgtccgttcgactagccttctacattggtgccggtattttattattaacgtcactgtacacgattatttcggttaaagaatacgatcccgaaacgtacaatcgttaccaccacgtcaagacccaagctaagcaaaaaacggcgagtctctggcatttagttaagacggcgccccgcgccttttgggaagtctccttcgtccaactctttgactggtttgcttttcaatacctatggacctacggaactggggcgattgccgctaatgtttggcacactgccgatgcttcttcggcgggctatcaggcggccggtaactggttcgggattctctcatgtattcaagcattagccgccgttgtttggggctttgccgttctatcacggacaaaacccgcccaacgcaagctctggttccggattagcctcatcatgggtggggctggcttcatctggattttcttcatccactcccaatacctgttgatcctgccattctgtcttatcggtatctgctacttaaccatgcagacccaagccctgtccctatttacagaatcactgaatggtgaaaatgagggcgcttacctcggcttgttcaactgtggcatttgcttaccacaaattatcgcttcactcttgagcttcgctatctttccagcaattggtcaatccatgcctggtatgctcgtcattgccggtgtggcgctactcttaggtgccgttgctgtcagtgtgattcaccctaaattgtccgcaaacttataatcttacaggaggttttatttatgactaaaaaatggtggcaaaatgccgtcgtctatcaggtttatccacgtagttaccaagacagtaacagcgatggtatcggtgatctcgcgggcttgacccaacgactgccctacatcaagcgactaggcgctgatgtgatctggctcaaccccatctacaagtcccctgacaaggacaatggctatgatattagtgattatcaaagtatccaatcagcctacggcaccatggcggacttcgatcatttattagatagcgctcatcagcagggcttgaagcttctcatggacttggtcgttaaccatacatccgaccaacacgattggttccaacaaagccggcaatctaaggacaatccgtatgctgattactacatctggcgtgacccagtcgatggccatgaacccaacaactgggggtcatactttagcggctccgcttggacctttgaacccaagcgtaaccaatattacttacacttatttgcccccggtcaacctgacttgaactgggaaaatcctcaggttcgccaagaggtctggaacctgatgcgcttctggttagacaagggcgttgacggctttcggatggatgtcatcaacttaatttctaagccagctggtttaccagatgctcctcaagctcccggtgccgcttacggcgattctcaacctatcgtttctgatgggcctaagctcaacgattatctgcgcgaaatgaatgacgaagtcttgtcccactatgacgtgatgaccgttggcgaaatgcccggctcaacgcctaaagacgcgatcacttataccgggctgaacgccaacgaactcaacatggtcttccaatttgaacacgtcggcctatcacctaaccccgacgcgcggctgggcaaatggaacgcggttcccgtcaaattaacggaactcaaggacagcctctcccgctggcaaacggcattggatggcaaaggttggaacagtctgtattggaacaaccacgatcaaccccgtgcagtctcccgctttggtaacgacacccccgagttccgggaacgttctgccaaaatgttagctactaccctgcatatgatgcaagggaccccctacgtctacgaaggggaagaactgggcatgaccaatgtgcactacacccaattggatcagtatgaagaccttgagagtctgaacgcttatcatgaattggttgatgaccaacacattgttgaccagccaaccatgttgaaatacctcagtcacatctcccgtgataatgcgcggacaccgatgcactgggacgataccaccaacgcgggcttcacaaccggacaaccgtggtttgctttgaatcccaattaccccacgattaacgcggcggaccagctcgaccaagacgattcggtcttcaattactaccggcgcttaattgcactgcggcacagcagtgacctgattgttctggggtcctatgaagaactggaccctaaagatgaccaagtctttgcctacaagcggcattaccaagagcaaacactcctcgtgatgagtaactttaccgaccaaaccgttacgcgcgactatgggcaagctgaggctagtgaacggttaattggcaactatgccgatgaccaaggcactacgctccggccgtatgaaacgaaggtttatgtgtttaagtaaatcactgataacgattaatccaaaaacctttcaattggttttcgtcgacttgattgtagcacagggcagtatgccctttttagtttgttttgaaaaaaaggcgtcgatggattttatccatcaacaccaaatatcatagagccatttaaagaagtggtacgctagcttattgttgacgttgcaatttgctcagcagatagccggtaacgcctaagagaataatcagaccgataatttggttcataccgaagtgtggcgaagtaacgatccagagacaatcaagcggcataactgaaaaagccaagataatcgccttcatgtggcagcactcctttcttattaagaatcatagttgctgcaactttgaacgtaattgaaataacccctgaatagtcgggttagtaaagatcactttagttcgagaaaattcttaattcttagaagttaaccgacctaaggttaaccgtcttaaccggcaaacccgtgattaatgaattatttgcgtggatactggtggattccggcgagtttagttgacagcattgagggcaaccattaaaattaaggttgtgtcaaattagcaaatgaacatcttaaaacgtctgatttaactattagtcatttttgatgatgcggaggtggaatcatgagtgttccaattgtaatcctcgcaatcatcgctatcgttgttggtgttgtgggcgggtattatttacgtaagtccgttcacgagcggaaactagatgcagctaagtacaccgctgctggtgtcttagctgaagctaagaagcaggctgagactgcgaccaaggaagctctgttagaggccaaggaagacagtcacaagtaccgcgcggaggtcgaaaccgagctgaaagaacgtcgtgccgaagttcagaagcaagaagatcgcttgattcaacgggaagaaacgttggaccggaaagataactctctggaaaaacgcgaaaactcgctaaatcgacgggacaagaaactcagtgctgaagagcagaatttagttaagaagcaacagcaagcagactcactgattgaaaaacgccaggcagcggtggaagccgttgccgccttatcccaggatgatgcgcgtgagctgattatttccgaagccaaaacagctttggccagcgaacgagcaaagatgattaaagaaagtgaagagaccgcgcgtaagacggctcaggccaacgctaaggatctgattgtgtcagctattcagcgaagtgctgctgatatggtaactgaaactacgattactgtggtgacgttaccaaatgatgacatgaaaggccggatcatcggtcgtgaagggcgaaacattcgaacactcgaaacgctaacgggtattgatttaattattgatgatacgccggaagcagtggtgttgagtggatttgatccattacggcgggaagtggccaagattgcgttggaaaaattgattcaagacgggcggattcatccagcccggattgaagaaatggtggcaaaggccaaaaaagaactggacgaacacgtccgggagcttggcgagcaagcaacctttgacctgggcattcattccatgcatcccgagttggtcaagctcgttggtcgcttgaactttcggatttctcatgggcaaaacgcgttggcccattcaatcgaagttgctaaaatcactggggtgttagcagctgaattaggtgaggatgttacgttagcaaaacgtgcaggattattacacgatattggtcgtgctgctgagcatgaagacgataattcttacattaccacgggaatggaactgacaaagaagtatcgtgaaagttccgttgtcgtcaatgcaatcgccgctcaagcagaagaaacggccgcgcagtctgtgattgcggaactggttagcaccgctgatatcatttcagcgacgcgtccaggtgcacgctcggattccttagaaagctatattcaccgtttggataaactggagaccatcgccaatgaatttgacggcgtggatcatagttttgccattcaagcgggacgagaggttcgagtcattgtacggcccgatcggatttcggatacggatgctgtggtcttggcacgagacattaaacagcagattgaaggtgacttggattatccaggtcacgtcaaggtttctgttattcgggaagtacgatcagttgaatatgcaaaataagtcagagaagctaggccagttggttctagcttttttacgtctgttgagacgcaaagcatggtaaaatagagggtatttaatagaactggctcatgggtcagtggccacgaaggctagataggggaacgaaaatgcgaattttgtttgtcggcgatgttgttgggaacttaggaatggcgatgattcatgagtacctgccacagctcaagcgggacctaaaaccacaggtgacgattgtgaatggggaaaattcaaccccggttggccgcgggattagtcaaaccatttataagcagcttctcaaggatggcgccgatgtagtgacgatgggcaatcatacgtgggataacgctgaattgtatgacttcattggtgatgccaagcgcctagttcggccagccaattttcccggcgtcacccccggacaagggtggactaaagtaaaagttaatcagcagatattggccgttgttaatctgcaaggccgagtctttatgaatcctttagacgatccctttgctaagatgcatgatttgtttcctaagttagaaacagactttgtgtttgttgattttcatgccgagacgacgagtgagaaacgggcctttgctatgcgctatgatggccaggtttccgcggttgttggtacgcacacacacgttcaaactagtgatgcgcaagtcttagctggcgggacggcctttatgacggaagccggcatgaccggtcctgctgatagtatcttaggcatgcaagcagacagtgtgattgagcgctttgagaatcaacgaccaacgcgttacacggtacaggcggctggtccgggattactttccggcgccataattgatttgaatgataaaacagggcatgcaacggcaattcggccaatcctgattagcccgcagcacccctaccaaagttaatcgatgatggaaggatgaaccatttttcatgactaaaacaagcacaacccctatgatggagcagtatcagaagattaaggatcaataccccgatgcctttttattctatcgtctcggtgacttctatgagatgtttaatgaggatgcagtcaaggggtcacaattattggagttgacgctaacgacccggagtcacagcgctaagaatcccatcccaatgtgtggcgtgccccataaggccgtccagagctacattgatattttggtagatcagggctataaggttgccatttgtgaacaaatggaagatcccaagcttgccaaagggatggttaagcgcgaagtaatccaattggttacgccggggacacaaacggatactggcgcagctggtgccaagcgtaataattatctgacggccttgacgttggctgattcaggcgagtatggtctggcctacaccgacttgtcaaccggtgagctgaaagctgctgcgatcactggcgaggatgctgtgttgaacgagctgatgagtctacaaaccaaagaagtcgtggttgataccacggttgccgagggactacgccaacgcatgaagcagttaggcatgatgatttcgacgcaagatgccatccaaactagctcagagattagctacgtcgagcaggacttaaccacggatttattacgacaagttgtgggtgtcttagtgacctatgtgacggtgacacaaaagcgaagtttagcgcatttgcaacgggcagttgtttatcaaccaacggcctttttgaagatggatcacgcttcgcaaacgaatctggaactgacgcaaaacttgcggaccaaaaaaaaatcaggaacgctactgtggttgctggatgaaactaagacagccatgggtgggcggctgttaaagcagtggttagatcgcccattaattgatcgtcaacagattgaaaaccggcaagcacgcgtggccgcgctgctggatcattactttgaacgaaatagcttgcaagaagagttagtcaaagtctatgatcttgagcgattggctggtcgagtggcttttgggagcgttaatgggcgtgatttgatccagctgcaaacgtccctcgaacaagtcccccagattcaacataccattgaagaacttgacgagccagtctttgataccactttggcaggcttagatccagtcagtgacgtggctgatgctattcgtgctgcgattgtgccagaaccgcccttatccgttgccgatggtggcgttattcgtgacgggtttaatgcgcaacttgacgagtatcgtgacgctatgcgtaatgggaagacctggttagccgaattggaagcccatgaacgtgaagttactgggattaataatttaaaaattggctacaaccatgtctttggctactacatcgaagtgactaaggtcaatttgagtaaattaccagccgaccgttatgagcgaaaacagactttgaccaatgcagaacggttctcgacaccagaattaaaggaaaaagaacggttgattttagaggctgaggaaaaatcggtggctttggaatataagttgttcgtggaacttcgcgaacaggttaaagcggccattacgagactgcaaaaattagccgcagttatcgccagtttggatgttttgcagagctttgcagtcgtcagcgaagactatcactttgttcagcctaagctagtgagtggtcatcagctaaagattacccaaggtcggcatccggtggttgaaaaggtattaggccgacaatcttatgtgcccaatgatgttacgatggatgaccaaaccaatattttgctgattacgggacccaatatgtctggtaaaagtacctatatgcgccaattagccttgacggtgattatggcgcaaatgggttgctttgtcccagctgaagcagctgaaatgcccatcttcgatcagatctttacacggattggtgcggccgatgatttaatttcggggcagagtacattcatggtcgaaatgcaagaggccaatcgggcactgagtcacgccacggctaacagcttgattctatttgatgaaattggccggggaacggcgacctatgatgggatggctttggcacaagcgatcattgagtacgttcataatcgcgttcacgccaagacgttgttctcaacgcactatcacgaactaacggctttagatgaatcactcaagcaattaaagaatgttcatgtgggtgccgttgaacgagatggcgacttagttttcttacatcagatgcaaccaggccctgcggacaaatcttacggtattcacgtggccaagttagcaggaatgccaaccaagctgcttcaacgtgccgaagttattttgacagatctggaacagagtgcggctaatcagccagcggcggctgcttctcagtcaagtagtgcaccggctgagcctgcccaagcaccggtaagtgattcggtggtagcgcaggacgttgccgcaagcgcgccagaaccgcaagaaaaggcgacagcaatttctgaaacggaccaacaattatcattgttctcagatgccccagagttgagcccagctcaggctaaggtattggaacagatcagtcagttgaatctcatggggatgacccccatggcgattatgaatcaggtctaccagtggcaacaaaagctgactaaataatgacgaaaggagcggatggcagtgccaaaaattcatgaattagcgtcagttctagctgaccagattgcagcgggtgaagtggttgagcgaccagcctcagtggttaaagaattggtggaaaatgccatcgatgctcacagcacgcaaattgatattacggtagaagaagccggcctacagcgtattgtcgttgttgatgacggtgatgggattgccgatgaagatagtgagatggcttttaagcggcatgctaccagtaaaattacggatcggcgtgacttgtttcggattaagtcgttgggctttcgtggtgaagcgttgcccagtatcgcgtctgtcgccgacgtgaccttgattacgtcaactggcggtgtcggaactgagattcataatgtcggtggaattattcaagaacacaaggcggccgaagcgcgtaagggaaccacggtgattgttaaagagctgtttggtaacgttcccgctcggttaaagtatctgaagtcaccagcaacggaattagcgcggattacggatatcgttaatcgcttagcactgagttatccgacggttgctttttcattagtccataatggtcgcgagctgacccggacaactgggcgtggtgacttacaacaagtcattgccggtatttatggtgtccagagtgcccgcaaaatggtggcgattagtgggcaaaatccagactttcgggtatcgggatatgtaagtttaccggagctgacgcgtgcaagtcggcagtatatttcacttttgttgaatgggcgttatatccacaactttcaattgagtaaggcgttgattgcgggatacggctccaagttaatggttggtcgctacccactggcggttttagacatccagatggatccacttttagtggatgtgaacgtgcatccaaccaagcaagaagtgcgcatcagccaagaagctgagttaacccagctcattcaagagaccgtcttcaagcgcttgtcccaagaaaatctgattccagatgtgtttgatgaggtccaaactaaacagccggaaactaaaacaacggatcaactgacgatggcgttaaatgacgtttcggccaagtacgacatgtccgatcggcaggttctgggtgcccaacagatgcctagtgaaagtgttgcccagccaagtgacgctgcgccggtcgcaacgtcagtgggacagcccgcaccgttacaaacgccggaggaagtccccgttgagccagtagtggttcatgataagcgcgattttgcgacgccagcagttcagcgctttgatgccaaatatcgacaagaacaggtcgccgcgccattgggacaatctgcggcctctgctgctgtcgaccagcctgccgtagaggcaacagcaccaattgaacccgttcaagcaacaccagcacaacggttcccaactttgcgctatttgggacaggttcacggaacttacttgttagcagaagcggatgatggcctatacctggttgatcaacacgcagcccaagaacgggtgaattatgaattttaccgtcaggcaattggtgaagtcagtgatgatgaacagaaattattggtgccaatcgtattagattatccaacgacggatgtcttggagttgacgaatcacttggaaacattggcaagtgtgggcattcacttagactcatttggaccaaacagcttcattgtgcacgaacatccaacgtggttcaaagcaggacaagagacggcaaccattcaagaaatgattgattgggtgctcaaagatggcaaaatctcggtcgctgcttttcgggaaaagacggcaattatgatgagttgtaaacgggcaattaaagccaatcatcaccttgacgatcagcaagcccgggcgttactccagaaattggcaacagctgagaatcctttcaactgtccacatggccgaccagtcttggttcatttcacggatcaggatttggaaaaattattcaagcggattcaggacccacaccacagtggggatgattgggaagaggcgtaaggcctgttggatttccggtaatgggtgtaagtggctagatgattgggttgcaggctgaaccagtaaaattaccagttttgcaacctgatgtggtacaatttgagaagcaaacatacgttttcttaaaggagagttactggaatgtacgaataccttcacggcctcattacagcggtctatccggaccatgtagtggtagatgtcaatggcgtcggttatttagtgaatacggcgaacccctatcgttatgaagtgagtgccacagcaattacgatttatgtgtatcaggcagtcagcgatacggcacaaaccttatacgggtttagtgattttgctgaaaaacaattatttctaaaattaattaatgtcaacggtattggccctaaaagtgcgttggccattttggctaatccggatcatcagggactgatgatggcaattaaaaccaacgatactggattcttaaccaagttccctggggtggggaagaagacggctggtcaaatcgtgttagacttgcaaaataagttagatgatttagcaccggctactgatgataataccctgttcacaccagaagtggccccgacaaccactgaaaatccgcagttagccgatgccttggcagcgttgacggcactgggataccgggagacggcggttaagaaaatcaccgcgcaattgcgtcagtttaatggtcaaacaaccaatgattacttgagtgaaggattgcggctgttgactaaataggaagggggaaaagcaatggtagatgatgaacgcgtcgtatccccagaaacggctgatgaccatgaagattctgttgaaaagtcgttacggccccaagtcttagcgcaatacattgggcaagaaccgattaaacatgaattgtcggtgtatattcaagcggctaaacaacgcgaagaatcgttggatcacgttctgctatatggaccaccgggcctggggaaaaccacgttagcgatggtgattgccaacgaaatgggtgttcagattcgcaccactagtgggccagcgattgaaaagccgggtgatttggtggcgttactgaatgagttgcaacccggagatattttatttatcgatgaaattcaccgactacctaagattgttgaagaaatgttgtattcagcaatggaggatttctacattgatatcgtggtgggacagggaccaactgctcatcccgtgcatttccctctgccaccctttacgttaattggtgcgacgacccgagcaggattattgtcggccccattgcgtgatcgttttggtattgtggagcatatggcctattatgaaacaactgatttgcaggaaattgtactgcggtcggctgatatctttcatacggccattgcgactgagggagctcatgagattgccttgcgttcgcgaggaacaccacgaattgccaaccggttgttaaaacggattcgtgatttcgcggaagtggccccagaccacgaccagatagatttggcaattgttgaccatgccctagatctgttacgggtggactcggcaggcctagatgccaccgatattaagctattagagacgatgattgactattacaatggcggtccggtggggttgaataccttggcggccaacattggtgaggaaaccgaaacagttgctgcgatgtatgaaccctacctcttacagcgggggtatttaaaacgaacggcacgtggtcgagttgtgacggctaccggctatcaacacttgggacgcaccatgccagataacaactaaaggagtcgaactgattatggcttatacgctagacgattttgattacgatttaccacatgaactcattgcccagacccccattaagcaacgtgatacgtcgcggctactggtgttggaccatcaagctaatacgttagaagataagcacttctacgatatcttagatgaactacacgccggggatgccgttgtgatgaataattcacgggtcatgccagcccggctgtacggcattaagccagaaactggtggacacgtggaagtcctgttattgcacaatgttgaaggtgacgtgtgggaaacgttaatgaagccggccaagcgcttacgtgtcggaacaacggttacctttggtgatggccaattgacagcaacggtgacggaagaacgtgaagacgggattcggctgatcgaatttcactatgatggaatttttatggagatcttggaacagctgggtgaaaccccactgccaccatatatcaaagagaagttagatgatccggaccgttaccagacagtctacgcgaaggaaaatgggtctgccgctgcaccaacggcgggactacattggacacaagagttgttggatcaggtagctgctaagggggttaaactggtttacatcaccttacacgtcggtttagggacgttccgaccagttgaagaggctaatattgaagatcataagatgcacagtgagttttatcgtctagatgaagcggctgcggcaacgttgaatgaggttcgggccaatggtggtcggattatcgcaacgggaacgacgtcaattcgtaccctagaaacgattgggacgaagtttaagggtgaaattaagccggattctggctggacggatatttttattaaaccgggttatcagtggcaagtggtcaatgccttcattacgaatttccatttgcctaaatctacgctcgttatgttagtcgctgctttcacgggccgcgatcagatcttaaacgcttatcaccatgccattgaagaaaagtaccggttctttagctttggcgacgcaatgtttatcaagtaatgcaattggaggatgattcatggaacccgcgattaagtatcatttgattaaaactgaaaagcacactggcgcccggcttggcgaattgattaccccacatggaacctttaagacgccgatgtttatgccagtggggacccaagcagccatcaagggggcaattagcccggaagaattggatgaaatgggctcacaggtgatcttggccaatacttatcacttgtggctgcaaccaggcccagacctcgtgcaagaggctggtgggttgcataaatttatgaactgggacaaggggattttgaccgactccggtggctttcaagtcttttcactggctaagcaccggaagttaaccgaagagggcgtgcatttccgtaatgaacttaacggggatcgcctattcttgtcaccagaaaaggccattgacattcaaaataagctgggcccagatatcatgatgagcttagatgagtgcccaccattttttgaaagttacgactacgtcaagcattcggtagaacgtacgagtcgttgggctgaacggggacttcgggcgcatgctaaccccgccactcaaggcttgtttggtatcgttcagggggctggttttgaggatttacggcgccaatctgccaaagacttggtcagtttagattttccgggttactccattggcggcttgtcagttggggaatccaaggctgagatgaaccgggttttagacttcacgacgcccttgttgccaaccaataaaccccggtacttaatgggagttggaacagcagattcactgattgacggggttatgcgtggcgttgacatgtttgactgcgtgttgccaactcgaattgctcgtaaagggacgtgcatgaccacccatggtcgattagtcgtgaagaatgcggcttacgcccatgattttcgaccattagatccggactgtgattgttacacgtgtcggaattatacccgggcttacttacgtcatttgtttaaagcggatgaagcctttggccaacgtctggctagttatcataatctctacttcttgcatcaattgatgaagcgtgttcgtcaggcgattatggatgataatttgacggaacttcgcgaagaggtttttgaaacgtatggctacaatgccgaacatccgaagaatttctagaaataattggacggattccccggattctggtaaagttgtccaatagatagagcataaaggggtgaacaaatgtgttaggaaatcttgcaattggtgctgccgctggtggtgggtactcaacattacttattctagttgttttcttaggcttgatgtatttcttaatgttgcggccacaacaaaagcagcaaaagaagcataaggacatgatgagccaacttaaaaagggtgaccatgtcatcacgattagccggttacacggggttatcgatgaaatcaaccaagctgaccaaacggttaccttggattgtgacgggatctacttggtctttgacttacgagcaatcgctcaagtaacgtcacaggcaccacaagctgtcacggcacctgtcagtgctgacacaactagtgctagtgcagacacgccagctgaaaatactgacgaatcagccagtgatgaaccagctgaaaagactgacgatgagtcagctaaataagtgtcataaaagtgcggtctcctggaggccgttttttttcggctttttaggggttagatatgcgggttttaagttgaaggcaaacgcccgttcgggtataatttaactattcgaggaggtggtgacgttgattccagctcaatttactcaacgaaaaattattcacgttgatatggatgctttttatgcgtcaattgaggagcgtgaccatccagcatttaaacaacacccgttaattattgctcaagacccacggaaaaccggtggacgcggcgtggttgccacagccaattatgcggcccggcagttgggggtacattcagccatgaatgccaacgaggcattgaaattagccccgcaggccatttttcaaccgcccaactttccgttgtaccgacaaatttctgaccaaattcatgaaattttccacgaatacacggacaaaattgaaccagtggcttttgacgaagcctatttggatgtgactgagaataaacatcatttacattcagccgtccaggtcgctcacgagattcaggttgagatttttgaaaagacccatttaacctgctcaacgggcatttcctatagcaagtttttggctaaggaagcttcggactttcgaaaaccggttggcgtcagcgttattttgccggaagacgctcatgattttttgatggcgttaccgatcgaacggtttcggggagttgggaagaagacggtacctaaaatgcatgagttgggcattcataccggagccgacctgtatcactggtcggagttggccctcattcatgagtttggcaaatttggctatgttttgtatcagcgggtccggggaattgatgagcggccggttgcctaccagcgtgaacgtaaatctattggcaaggaacggacatacgggccgccactgaccacgttaggtgaagttgaaaatcaattacaacgactggccgaaatggtggcggcaacggttcaagaaaaacagcggcacggtaaaaccttggtgttaaagctgcgaaccagtgcgtttaaaaccctcactaagcgctacacccaagccgattttatggcaaacgatgcgcagacctattacgatttagcactggacttatatcaaagtgttgctggcgaaaatgagcaagttcggctacttggtattacgattacggggttggccgcgcagacgtttgaaaatgtgcggttgccattatttgactcggatcgattgaattagcagactttctttgtaattagtcggcaaaacttgtatactaaaacgcggtatcgacgcgtcttcgtcgaaaaatcggatagaaaatgggtgaaccacatggcaattgaaacagccattttagaaaaaatcaaacagtatcaaaccattattattcaccgtcatcagcgtcctgatccggattgtattggggcccagttggcattgcgggctattttacgcgctagttttcctgaaaaaacggtggtggctgtgggtaagcactatccgggatttgactggatggggcaagccgaccaagaggttagtgatgacacgtatcaccaggccttagtgattgtcgtggatacggcaaaccaaccacgagtagatgacgaacggtggcaaaacggggccgcagtcattaagattgatcatcatcctaatgatgacgcattcggtgacttacagtgggtattaccacaggcgtccagtacctcagagatcatctatgattggtttgaagcaaatcacactgacttgacgatgcccgatgatgcagcgcgcctactttatgcaggcatcgtaggggataccggacgtttcatgtatccggcaacatcagccaacacgtttgccgtggcgggtaggctattagcttatgatttttcaatgacggcggttaatcaagccgaagatgaaatttcaccagagatggcccggctgtcggcgtatgcctatcagaacttggaaattttgcccagtggtgcagcgtacctcaagttgacggatgaaattgtcgaatcttttggtttggcagctagtgattccacgtcagccattgtgccactgccaggtaagatcacatcagtcgtggcttgggccatctttgtagagtccaaggacaagaccttccgcgtacgactacgatcgaaggggccttcgatcaatgaattagccaagcgccacggcgggggcggccacgcgctggccagtggtgcggcggctaaagaccaggccgaaattgaccaagtcatccacgaactggatcagttagtggcggacactaaaggagaaaatgaatgaccgcagattttaaaaattttaacttgcagccgtatctgatgacggcgctacaaaagattgggtttcaacagccaaccgctgttcaggaaaaactaatcccagtaattagtgctggccacgatgtcgttggtcagtcacaaaccgggagtggtaagacccatacgttcttgctacccatctttaatcaattgacttctgagaaccaagtacaagccgtaattaccacgccaagccgtgaactggcttaccagattcgtacggcggcggaacaattggcggcggaagccccctttgaaattcgcattggaaactacgttggtggaacggataaacaacgacaaattgaaaagctgcggcattaccaaccgcaactggtgattggaacgcccggtcgggtgcaagatttgattcaatcacaggcgttggacgtgcatacgactcgtcagtttgtggtcgatgaagccgatatgactttggatctgggtttcttagatcaagtggacaaaatcgctggtagaatgccgaaaaacctgcaaatgatggtcttttcagccacaattccccaacggttagatccgtttttgcgtaaatatatgaatcatccggttgttgaagaaattccaacggcaactgtgattagttctacaattgataattggttgatttcaaccaagggtcaaaacaagaaccaattaatttatcaattaattacgatgggggaaccctatctggttttaatcttcgcgaatacgaagacccgggttgaacagattcatgactttttgcaatcgcaagggctaaaggttgccatgattcatggggggattaagccgcgtgaacgtaaacgggtcatgcgtgaagtgaagaatcttcaattccaattcgttgtcgcaacggatctggcggcacggggtattgatattgaaggtgtttcacacgtcattaatgatgatattcctgaagatttggatttctttgttcaccgggttggccggacggggcggcaaggtatgccaggaacggcgattaccttgtattcaccagatgaagaagccaagattgccgagattgaagccatggggattaagttccaacctaaacgaatcagtaatggtgaaattgtggattcctatgaccgaaatcggcggcaaaaacgggttaagagtacggaaaagctagatccaactctgattggtttagtcaagaagaagaagaaaaagatcaagccagggtataagcatcagatcaagcaagcaattcaccgcaagaaagatcaggaacggcggattgcgcaacggcagagtgcgcgaagtgaacggaaacggcgtaagcgtgaatccgatcgttatcaataacattctgcaattgacaaggactaatcgggtctctatactttctagtggagacaaataaactaactgtttaaatatatttcaataatatatgagctgaggatatgccacgtcagcgtgattttcagaaacgttttggatgctgcgaaaaacgagtcacgatggccttggtgctccctcacaaacaacgcgactcagcgttatgagtttaagaggttaacgattaaaacatcgttgcaagtaaagtggtaccgcgcttcggcgtctttacgggcaacggtgtttttgacattttttgggaggttattgcagcgatgaaagaattaacaagcagtcaaattcggcagatgtatctggacttcttcaagtccaaagggcatactattgaacctagcgcgtcattggtccccaaggatgatccgtctttactttggattaactctggtgtagccacaatgaagaagtatttctctggtcaagtggttcccgaaaacccccgattgaccagttcgcaaaagagtattcggactaacgatattgaaaatgttgggaaaacggcccggcaccacacgttgtttgaaatgctcggaaacttctccgttggtgattacttcaagaaagaagcaattgcctgggcgtgggaattactgacctcacctgactggtttggttgggaccctgataaattgtatatgacggtttaccccaaggatacggatgctaaggatgcttgggaagcggtaggggttgctcccgaccacatcattgccgtcgaagataacttctgggatattggtgaggggccttcaggtccagattctgaaatcttctatgatcggggcgaagcctttaacaacttagccgctgacgatcctgaaaattatcctggtggcgaaaatgaacgttacttggaagtttggaacatcgtgttctcccagttcaaccatgaaccggatggcacttacaaaccgctcccacggaaaaacattgatacggggatgggcctggaacgggttgtgtcgattttccaaaatgccaaaactaattttgaaaccgacctgtttatgccactgattgaaaaaacagcggccttaagcgccggaaagcactatggggctaatgccgaagatgatatctcatttaaggtaattgccgatcatgcgcgggccattacgtttgccattggtgatggggccttgcctggtaatgaaggccgtggctacgttattcggcggttaattcggcgggccattgtgaacggacaaaagctcggcattgagggggctttcctggaccaattagtaccggttgttggtcaaattatgcaagcttattacccagaagttctcgagcaaagtgactacatcgctaaggtggttcgttcagaagaagatcgattcggcgaaacgttgacggatggattgaatctgttgaacagtttgattgccgatttgaagcaacagggcggtaatcaaattgctggagccgacgccttcaaactttatgatacgtatgggttcccagttgaattgacggaagagtacgctgatgatcaaggaattaccgttgatgaggctggcttcaaagccgaaatgcaaaagcaaaaagatcgtgcccgtaatgcgcggggcaagcaaaaagcaatggggttacaacatgatctgttgatcaatgttaagacgccaagtgaatatgtgggctacacgcagttagccacgaccagtaagctaacggtcttggtcgcaggggacgaactggttgaccacgtcaccagtggcacagccgaagcaatgtttgatgtgacgccattttacgctgaaatgggtggtcaagttgccgataaaggggacatcttggacgaagctggtcatgtggtggcccacgttgcggatgttcaacatgccccaaacggtcagaatctgcataccttaacggtggttgcgccgatggaaaccggtgccacctatcagttgaaggttgatacgatcttccacagtaaggttgaaaaaaaccatacggcgactcacttgctggataaggccttgcgggaagtctttggggaacacacccaacaggcgggctcgctggttgagggcgattacctgcgattcgactttacccacttcggtcaagtagatccagctgatttggccaaggccgaagcactggttaaccagaagatttttgaagaattgccagtaacaaccgttgaaacagacattgaatcagccaaaaagatgggtgccattgcgctatttagtgaaaagtatggaaaggttgtccgggtggttagtgccggggactttgtcactgaattttgtggtggaaatcacgttaagaacactaatgaaattggtttattcaagattacctctgaatctggggtgggtgctggtgttcgtcggattgaagcggtaacttctgcagcggcctatgcttacttgcatgaccacgatgagattttaaatgccgtaggagccgatttaaaggtcactcaggtcgatgaaattgaacagaaggtccaagccttacaagcccaagtaaaggccttagaacaacaacaagcaaccttagaaggtaaattagccagccaagaagctggggctgtctttgaccacgtcacgacagctggtaattaccaattgatcagtggaaccgttcaagtttccaaaatggatcaattgcgtgctttggcagatacgtggcgcgaccaagccttgtctgatgtgctggtcttaggcgcagaagtgaatggtaaagccaatttaattgtggcagtgagtgcggataagcaaaagcaagtcaaagctggtgacctgattaaggccatttcacctaagatcaatggtggtggtggcggtcggccaaacttggctcaagcgggtggtaagaatccagcaggcctaccagatgcgatgacggcagcagccgattggttggctgaacaaaagtaagccaacattttacagtattacgaatagattacattaagtgaccttaattgtagtttgccaagcaatcgagtaaaattaaatcaaagtgaggaagtacgggggtgttttatagtgagttcattagacaaaacgatgtatttcgactttggcgctaatcaaccaaaggatgttcacgatacgttagtgacggtttaccaagcgctagaggaaaaagggtacaatcccattaatcagattgtcggttacctgctatcgggcgatcctgcgtacattccgcgtatcaatgatgcacggaacttgattcgtaagcatgagcgcgatgagatcatcgaagagttggttcgggtatacttgaatcagaatggatcggtgaaaaagtcatgaagttaatgggattagacgttgggtcacgaactgtaggtgttgcggttagtgatgcactaggttggacggcacaaggtgttgagattattcggattaatgaagacgaagaacaatttggccttgatcgggttggcgaattaattgccagtcatgatgtgcaagggtttgtggttggtcttcctaagaatatgaataactcattaggtcccagagctgaggcttcaaagcgctatggtgacatgttgacggctcggtttaacttacccgttgattttgaagatgagcggttgacaaccgttgaggcggagcgtatgttagtggaacaagctgatacgtcacgccgtaagcgtaagcaagtgattgataaattagcagccgggttaatcctgcagaactatttagatcggcacggtaaattaacccgagaaaagtgaggtttcccatgaacgaagaccaagaacaaattacattagttgatgaaaacggtaatgaagaattatacgatgttttatttaccttcgaatctgacgattttggtaagtcatatattttgatttacccagctggtaagagcgacgacgaggaagttgatatccaagcctacgcgttacctgctgatgatgatccagctaacccatccggtggtgacttgcaattgatcgagtccgatgaagaatgggacatggttgaatcagtcttgaatactttcttagcggacgggaccattgatcctaacgctggtagcaaagactaatcacgatgatgaaagggcggaagacattccgtccttttttgtatgccgaattttaagttcattacaattttgcgtgcaaggggtgcgaccgccaacggattaatggtaaaataaggcattgtgtaaaacagggggaatttaaccatgacggaagacacacatcgctttaaagcggttattgccggcaaaacgtatacgatcgttggtcaggcgactgacgaacatatgcgagcggtgacagaagttttgaatgagcagttcacacaattaaaacaattatcacctaatatgagtaaagaagacgcagccattttgatggcgtttaatgctgtctccgaccaattgaaaatggttgccgctcaagacgatacggcggctacggcaactgacgagacgacagaaacggaggactaatttggtcttaagcttactaattttagcaatcctcgttctgggttttcggcggggctatcgccgaggactcgttttgcaactgattaaaaccgtgggctatttgattgtttgggtcattgcccgctttggcgccaaaccattggcggctggaattgggcaatttattggtaaggtttcgttgaacagttcggtaagtgcggtgactgctagccaaagcagtagcttttttcttaatggtctagccttttcggcgattttaaccgtgggctattttatcgttcggcgagtggcctatgggattaacaaggtcacgtggttaccggtcattcatcaagttaactcgttagcgggtggcctgattaatttagtgattcgttatgtcgtgatttttttgacattgaacctattgatcttattacccaataccagttttcaaaccagttaccagcagtcgccagtggcgcaatggatcgttaagaagaccccatttttatccaaacaggtctataactggtggctgactgaacacgaacagtagactgattcgggagaggagaatccgatgaatcaaaaaacacttaagattatggaatacgagcgcattaaacaggcgctacgagggtatctggtctcggcagctggacagcatgagctggccgaactagcccccacagcagatgcaaaacaattacagatttggttagatgaatctcgcgatggtgcggatatttaccgattggaaaatggcattccgttaccaaaattggatgatattcggccacatttacaccgactagctatggaagcggctttgaatgggttagagttggcgcaaatcagtcgggtgctctggacgactagctcggtggttaagtttttccgcgatttgacggaaaaagaaattaccttgcggcgcttagatcgcgtggtcaaagagttggtgacgttacccgacgtgactcggcgattacgaacctccttagagggtgacggtcatatcaccgatgaggcgtcaccagccttgcggcagattcgacaacacattgcccaaacagaagtggcaattcgtcagacgatggaccaatatacccggggcaaggacgccaagtatctcagtgagaccattgtcacgattcgtgacgaacgttatgtgattccggtccgcgcagagtataaacaacggttcggtggcattgtccacgatcaaagcgcaagtggtcagacgttatttattgaaccgcaagcggtcgtgggtcttaacaatcgcttgcgtcaaaaccaaattgatgaacggcatgaagaacagcgaattctggcagagttaacggcattgttagacccctatcaagcagaaattctgcgtaattcagaaattctcgggcattttgattttattaatgccaaggcgaagtacgcccatcaattaaaggcaacggagcctaagttgtcagaggacaatcaggtcaatttgcgtcaagcacggcacccattgattgaccccaagaaagtcgttgctaacgacattaccattggtcgcgactacaagaccatcatcgttactggacccaacacgggtgggaaaacgattacgctcaaaacgttggccttggttcaattaatggggcagtcgggtctctttatcccggccaatgaaaatagtgtcattggtattttcgatgatatttttgccgatattggggatgaacaatcgatcgaacaaagcttgagtacgttctcagggcatatggaaaacattgttgctattttgcggcaggccgatgaacgcagtctaattgttgttgatgagttgggtgccggaaccgatccacaagaaggggccgcactggcgattgccatcttggatcaaatggggacactggggagttatgtcatggcgtccactcactacccggaacttaaagcctatgggtacaaccgaccagaaacgattaatgctagtatggagtttgacggtgagacgttacaacccacttatcacttgctgattgggattccaggacgaagcaatgctttggatattgccgctcggttggggatgcctgaacaggttgttgctgcggcacgtggcttgaccgatcaggacagtcaggacctaaatgcgatgatttctgatttgacggaacaaaagcggcatgcggatgcggacgcggaacggttacgtcaagaattagccgaggcggatgagctgcatgcccaactgaaaaaacaattcgatgcttaccagcaccagaaggatcaattgatgacagatgctaagcgcgaggctaaccgattagtcgatgagtcccgtaagcgggctaatcagattatttcagatctccgtaaaaagcagttggctgctggtaagagcgtggtcaaggaagatgaattgatcgctgctcaaggggcactgaacgccttacagcaggatagtaagctgaagaaaaatcgcgtactgcggcgagaaaaggctaagcttgactttcataagggcgatagcgtcttagtgaagtcatatggacaggttggtgtcttgatggagcagttggacgaccagcattgggaggttcaactaggaatcttgaagatgaagatcgcgaccaatgacttggaaaaggcccaagatccggctaaatcagctaaacaaccacgggctagtgtcaaacgtagtggatcaagcggcatgtccgcaacgttggatttgcgagggcaccgatatgaagaagccatggcagaggttgatcgttacattgactcggccctgttggctggctatccgtccgttaccatcattcatgggaaagggacgggggcacttcgaaagggtgttacggactatttgaagcgtaataatcgaattaaaagtttcggtttttctccggctaatgccggtggcgatggttcaacggttgtgcactttaagtaaggctaacaaattgtaagcaatttagttgtgattttggttatttctggtagactaaagcttgtattgagaactagggaggtaattggttatggcaacagtagtagaaacaacggataaaacctttgaagcagatacggctaagggcgtgacgttaactgacttttgggcaacttggtgtggtccttgtcggatgcaatcacctgtcgtcgaacaattagccgacgaaatgggcgatcaagtcacattcaacaagatggatgttgacgctaacccaaatacaccacaatcctttgggatcatgagtatcccaacgttgctggttaagaaagatggcaccgtagtggactcaattgtgggttaccactcaaaggatcaattaaagaagatcttggatcaatacctgtaataataaaagcgtgtcggattatccgacacgctttttcattagaatttgaaatggaacgcctgcttcgactcccaatattttgacgcttagtccgtggtggcgtcgtcatcagtcatcgactctggatgattaatggtcagcggttgtggcgcatcgtagtccggaataacgtctgtgggatcggtgtagacttcaaaagttaccgcttggttttgcagtttgcgtggtgtatcgacgagttcagcttcggcagcaacccccagttgttgggccatcatttcagcgagaaacccagcttccagcgtgaaagcttcgtcaccactaagggttttacgtaagcggacaatgtcgccacttaattgccaccgcgtggactgggccgtttgcttcaccatcgttagcgtgccaaatccggcttgggcaaagaacgcactagcgtcttgtgggttaccgactggaaaccgacgggcgagtgacttgcccgcccaatacgtaatggcaccctgatcttcccctaataactccggtaaaagtgcttctcgcagtaataattgtggaaaatttgcttcgccggcagcatcctgcatagcggtttgatataagtttttcacgatggtagactccttcatccgaatagtttcatataatttcattataccgtaattttttcgcgaagttcttgatgacagaaatttaacaattttttacgtctgtatgacagttttaaatggctgtaacttgaaaccggttcataaaaaggcgataatatagtttcaagtaaatcgagaaggagcgttgtttcatgcaaaatgatccgattggtctaatggattcaggggtcggtggtttgaccgtcttaaaggaagttcaacggttgttgcccactgaaaatacagtatttctgggcgatcaggcgcgtttgccatatggaccacgctcggtggctgaggtcacaatgtttaccaaacaaattgcacaatttttacgccaacaagcaggaatcaaagcgttggtgattgcgtgtaacacggcaaccgcagcggctctaacaacgatgcagcaaacattgcccattccggtaatcggcgttattgcaccgggtgcgcaggccgcggtgcagacaacccgtaatcaccgaattggggtgattgcaacggccggaacggttaagagtgaccagtatcggcgagatattttagcagcagcacctaatagtcaaatttttagtgtggcttgtccggaaatggtgacgctggctgagcaaaatgacttaacaaccacgcatgcccggtccgtagtagcggcaaacttggcgtcacttatggataagaaaattgatacgttggtgatgggctgtacgcattttccattattgcgaagcgctattcagcacgctgtgggttcacaggtgaccttggtggatcccggcttagcaactgcggaacaaacggcggctatcttaaagacgcacgggttacttaacccagccacaacgcgtggaacggcccagttctttaccacgggggagacggctcactttgatacattagctagtcagtggttggatcagcaaccgatgccagcgaagcacgtgtctattgctcagctgacaaccccgatggaggttaactaaaatgacaaacacaattgtaattgccaccaataatgcggggaaggcccgtgaattccgcgctatttttgaaccgaaaggcttgcaggtcaaaacgctggctgattttccgacactggatcaggttgctgaaacgggtcagacgtttactgagaatgcaactttaaaggcgacagcagtggcccaagcaactcagttgcccgtactagcggatgattctggcttaatggtagatgctttgaacggggcacctggtatttattccgcgcgttatgcgggggatcacgatgatgctaagaataatgcgaaattgctggcagagttgcatgatgttcccgccgagaagcgcggggcggcttttcacacgtcactcgtgttgattaagcctaatggtaaaaagttagtggcaacgggtgaagttcgtggtgaaattctgacagcaccgcggggagccgatggttttgggtatgatcccttattctacgtccccgctgaaggccagacctttgctgagatgggattagcccagaagaatcagcacagtcaccgggccaaggccacagcagcgatgttgccgcagtttgatcaatggtgggaggactaagcatggcacgttggttggtagttagtgataatcatggtgatcgtgagatattggttagtttacggcaggcactaaagccggatgcagtatttcactgtggtgattctgagatggaagcagccgatccttggttcaaaggggcatatgtggttcaaggtaacatggacttcgatagtgaattaccgctagtcgaaacgcctacagttgatggctgtaaggtgttattgacccatggacattatgatgccgtgcactgggatttaaccaagctaaagctgcatgcggatgaagtgcaagcagacctggtgttctttggtcatacgcatgaattggcggcggaagtagttggtgggcacgtttttgtcaatcccggaagtatcagtcagccgcgaggtgagtatcgccaattgggcggcacctgtgcggtggttacggtaactgcggatcactgggacgtgcaatactatacacgcgatgcccaaccagttaccgatcttgattttagttttaagcggccctaacgcagaaaggatgactcacctatgattgaccctgctgtcgagcagatgttacgcaaggacccgaaaagttatgtgattcctgctgaggtggtagccaatgtgacggccaccaatacgctagaacacgccctgatggtgttatctaaggttggctatacgcggattcctgtgttggatgcggatgatcacctgcaagggttattaccgttagccgcgattaccgaccaattgttaaaggttccaggcgcggctgttgaacaattaagtaactacacggtagcagatgcgatgcggccagtagaacattgggtggatgatccagcacggttggaaaccattttaagttacttagttgatgaaccgttcatcccattgattgatgaacagcaggtttttcaagggattattacgcgccgagagatcttaaaacgtgttaattacttggcacataatttggatgagaattatgaggtgataccacgacaagtcttatcggacaatatcgactgaagtagcgtgtcactaatctaggagcgtgggctgatggttaaaataactttagttcacgtttttgtgtgtttggtgatctaggttgtggttaatatctggactcgattgaatgaaaacaaaaaagaaataaattcggatgggagatgacgtgatctatgaaaattattctaggcgttttcattgcaattttgtggctctttaccattggtttagctattatggccgccacaggggcagggcattttgcctcatttgttattttattcgcgctgagtatattctgtacggtcgactggtggcgactggaccgttaagggaggttagctaatggcaggaaaacagcaagttgatccgcagcaacagcttaaagtttttaaagcgttggctgatccggtccgcttgaagatcgtccattacttaaaacagcttgaccatgaggtggcctgtggtgaagtccaacaggccatccagattagtaagacgtcaggcacctatcattttaagttgttacagaatgcaggtttaattacggcgcgtaaagaagcccgtgaaaaatacgtgcagttgaaccccgtagtatttcaaacttacgtcacggatttttttgcggataggcaacgatagtaacgtggttaagtggtgccgaaacggtatcactttttttataacggtttttgcttgtcagccgttaaccgggatggtatggtaaaatagttcaaaaatatttgaactattttaatcgcgattgaaagacgttcatggcagaaggtaaggaatggacaatgaacagacaagggactcaaaccaagtggattctgatactaacctcgctgggattttttatgtcaatgatggattcgatgatcgtgacgacagcatcgacagccattcgattagattttagaattacggtaggaacacttcaatgggcattgaatgcctataacattacgattgcggcggtgttattggtcggagtcgctttgggagaaagatatggtcggcgacgggtctacagttatggtttagtggtttttaccctcggatcaattttatgtgcgttagcgactaatattacgtggctaatcattgcccgggtagtggaaggcatgggtgcatcggtgatgacgccactgtccatggctattttgacacacgcattgcccgtaagtgaacgcggtcgtgctttaggcatctggagcggagtggggggattagccttggttgtcgggccgtccttaggtggcttgattgttgcccggttaagttggcaatggattttctggattaacgtgccagttggtgtggttgctttgggcttaacggggcgcctgcttccggaaagctatggtcgtcgtgagcggttaagcggattagatgccagtctgattatggtggcctcggccggtttgatttgggcactgtcggcactgacgtcagcgcaagtggatcgcggggtcgtcatgagtatcggttccggtagtgggttactgggagcttggtttatttggcggcagaaacagtcagcgcagccactaatgccattgaactttttccactcggcagtctttcgtggcggcaattgggcaacatttttactatatgcatcgatatacggggtggttttcttcttaccgcagtttttccagattgttgggcaagccaatgcgttgacggcgggattggaattattaccgtggaccggaaccttggtcatggtggcgccatttactgggtgggctgtggaccgatttggtgagcgacgaatggccatgttggggttgttgaatcagggggtgggttatggtgcactggcaggactggctgcgccaactcggggatacggttggtacgtgggccccttgattctggcaggatgcggcttatcaatggccgggccagccttacaaaaagccgtgttaagcactgtggcgccagttgcattaggcaaggcctccggtatttataatgtttttcgtttgctgggtggtgcgattggaaccaccttggctgtagcagtctttggttactttggacgcgttcaaacagcggtgacctttactcaggggtttcaagcagcaatgatcctggctgctgggctttcgttgctaggattgtggtatgcacgactgttaactagtggagattagttagtttaaatagcataacgatctttatacaaaaagccattgtcactatctcacattgtcataaaaaggcgactagcgaaaatccgaagactttcgctggtcgcctaatttttaggggcttatatcgcagtcccttttctgagacgcattattgaccagcaactggtgctggcgtatgggtcggtaaatgaataccggcctcccgaatggcttttaaataggcagtcaaaaaggttgcttgaagagcaaactgacttccactcttggcaacgacaatcacctggtagaccaactcgccagtgggcaaggtgacgacaccagttaacgccggttcgccaatgacactgggatgttccggcattaagcgctcattgacgcttcgaatgattgctggcaattgttcgaccggtgtggtgggggcaattggaatattgacggtggcacgcatatcgttgcgcgagcggttcgccacaatagtaatgtttcgattggggatgaaattgatggtaccgtccgccccggtgacttgagtcgttcgcaagcccatggctgtgacggtgccctcaatcgtgccaatcttgactgtatcacccacatcgaattgttgttctaatagaatggaaataccagtgacaaggtcgctgacaaagccttgggctccgagtcctaaagctagactgaagatcccagcgccggcgactaacgtcccaacgggcacacccaaggttgataacagggcgtaaatccaaaagaagagcaccgtatagtgaaaaagattgaggctgagcatgctaatcgtctggagccgattgctgccagtaccgtctgctgcgggcttgaggtagcgtttaaatgagcgatggagaatccatttgcccacaacgttaatcacgaagaacaacagggtgaggaaaattaaacttaaaaagcgactggtgatcaggtgccagaatttttcccagtcaaaggaacttaaataatgttgcagccacttactcgaagtggcggtggaggttactaagctggtcacgatttgcgtctcctttagctgaagtcatttatccctcagtttagcagattttttaagacacgcccagcccactgtaaataaatggtggtgaaatgcagagtattaattgcgtgtaagcggtgagaatgctattctattggtaagtaatgaagcacaaggaggggttgtcatgaccggtggacaagtagcgggcctgatcgcagcaattgcgtttttgatcttggttctcttcattggcatgttcttagtaaagatgaataaaacgttgggtgaggtcaatcgctcaatgaagtcgatgacgtcagatattgatgtcattagtcaccaagccgaggatattatggctaatgcgaatgaactgctgacggacgtgaataaaaaggttgccacgattgatcccgtatttcaggctgccgctgatctcggtgaaagtgtctcagatctgaatacggcgacccgtaatttaacggatcgcgtgggcgtgacggctaagaagacggcaaaaacgtcgatggccgcacgtgtcagcaagaccgcttttgatttgtatcggaaccgcaaaaacaagaactaatcacgaagggaagtcatcaatatggcaaaacacaagttattggcaggattggtattgggtggggcagcctatgcggcttatcacgccttagatttggaacaacgcgaagccttaaaggacgctgcgcgtgaccgttacaatgccttaaaggatcgggccattgattacgccttttatgctgctgacgctgctgacgattttaaggaagccttggacgaacgcttggctaacaaagcagatgcaccagcttggcatgatgccgctagtgatgaaacggccgctgatgcggatgacgatattgtcttgagtagcgatgaagcaacggcaacggccgatgcagcgacacctagtgctgatgatgtgccagaaaagccagttgaataagcatgattgcgggattaacgagtcggttaatccctttttattgcccaaaataaaaaggactggttaaccagtcctttaaaggattatcccacgtaagtgagttcctttgacgtgtgtgtaaagggtaagctaccatcagcggtaacgtgaacacaatcttcaatccgtaccccagcaacgccaggaatgtagatgcctggttcaatggagaagcacatgcctggttccagaaccaagtcatttcccgccataatggaaggaaattcatgatcactcatacccatgccatgaccgagccggtgaataaagtattccccgtaacccgccttggtaatgatgtcgcgggcaattttatccagctcagcggcagtcatccctggtttaacggcggcttgtgcggttaattgggcttccagacagacgtcgtagatttccttttctttagcacttggtgtccccaaagcaacggttcgtgacgcatcagaaatgtaaccgtcatagaccgtccctaaatcgaataggaccagttcattgttttgaaatttggtatcgttagtggcaccatgtggttcagcggcgtgggcaccggcctgaacgaggctaccgaaagacatttccataatgccttccttcatcaaagcgtactgcaactcggcaacggctgattgctccgtcttaccggccttcactgctgcaaagccatgttcaaaggcaaagtcatcccacttaccggcaatttccaacttcttgatttcatcggcagacttaatcaagcgcatgtgttcaatgaaactggtgatgtcaaggtcaaagctaggtgcactaaactgcgctgcgagggcttccatccgggcaacttgtagttgacccttttcaatggccacgtgttctgggttcacgtggcgttgcttaacttggtccgcaatcatagcccaaggattttcatgatccaagtaaccaatgactgggaattgccatcccgtttctttgatgacttcgacttcaagagctggcgcaaagataaaggggtcttggtcggggaagacgactaaggccagaacccgttcgattgggtcgctcccaaagcccgtcaggtactcgatggtcttgggattgctcagataagtcatactagcgtggtgttgtgcggtccattgctggatttgttcaagtttcgtcattcaattcaccccttcaaaaagtactttaattataccatatgcagcaatctggcttgaaaattctatgaaattaaggtattctttgatttgaaaacgttttcaatgttgcacgaatcggcgaggttctgtatactggtcaagttgcttgaaaacggatgaaaacaaatcaaaacaaggaagaaagggctatcgctatggaaaaacaaactgtaacaatttacgatgtggcccgtgaagcggcagtttcaatggctaccgtctcccgggtcgttaatggcaatccgaatgtcaaaccggccacacggaaaaaggttttagaagttattgatcggttggactaccggcctaacgccgttgcacgtggattagccagcaagaaaacgaccacggtgggcgtaatcatccctgacgtgacgaacgcctatttctcttcattagcgcgaggaattgatgatattgcgatgatgtacaagtataatatcattttgacgaactctgatgaaaatggtggcaaagaagttcaagtgctcaataccttgatggctaagcaagttgacgggattatctttatgggtaatcaggttacggacgaattgcgtgaagaattcaagcgttctaaggcaccagttgtattggctggttccgtggatgctgaaaaggcccaaccaagcgttaacattgattacgttgcggcggtggcagaagccgttaaaaacttgattgatcacggcaataaaaaagtcgccttcgtttctggcccaatggatcaggccatcaatcatgattaccggttaaagggttataagaaagcattgaaagatgctgggattacctatgatgaaaagttggtctttgaaaccgactacacctataaagcgggccaatcactggaaccagccttgactgctgcgggtgcaacggcagcatttgtgggtgatgatgaattggccgctggggtaatgaacggtttgactgatgcgggggttgatgttcctggtgaatttgaagtgattaccagtaacgataccaagctaacggaactggttcggcccaagatgagctcaatcacacaaccactgtacgatattggtgcggtggcgatgcggttgctgacgaagctgatgaataacgaaacagttgaggaaaacacggtgatcttaccttatgggttaatgaagcggagctcaacgaagtgatatctaggcaccgggggaccggtgccttttattttggcaaaaattgggaaaaggttaaggttagagacggttaaggtcagtttaacccagataaaatggtgatgtgctaaaatgaaaacaatgaaattgctttatgggaggtgctggagtgagcgccaatagtcgaatggcacggtatcatgccactgaagaaccagagatacaagaaacccagtcggcgagttcttatcaacggcgcccagcgttagctcgatggttagcgcttttaatcctgttgctgaccttgacgctagggttaaagattacggtctttaatgccacgtacacagccggcgttgtttctcgttccacaaccggggaaatggtgattaatcaattaaatgatgaattgcaaagttacgggatctccgggtcaccgattacaactagtctggcgcaaccgtatttggcgatgggcgtcgctcaattgtatgggcaaacacccacgacatcagtggatgacgctgatttatcgagtgcggttagtagtcaggcggttaccatgggcaccacggcctctaatcgggtgattagtcgtatagcgaaacaggctgaaaaattggctaaggcggcatttggtaccccggcgatgaagcaagcggcaatcaaggttcaattcgctcagaaggtgaatttgtgggtgatgattgcgacgttattacttctagtcgtgacgttcttttacgcgttaagtgttcaccacgtttttgctagtctggggccaggattaacgttaggcgggctgttgacaactatagccggtgcggtgagctatgttgggttaccgttagtggtaaccagttctagtcaaacggtggccgcattgctcaccacgattgggcataatgggttggctgtcattatttttatgggtatcgcagaaataattgttggcttggttgtattattgggtcatcgcacattccgcaacgcctaaatgatgtgaatagaaaagccacacaatcgggttaattcctaattgtgtggctttttttaaattaaaatttttgatagaaaatcttgagcacgttcggtttggggatgactaaagaactcatctggggtattcgtttcttggatgtagccgtcagccatgaaccagacttgatcggcaacggatttagcaaaccccatttcgtgggtgacgaccaccatcgtcattccttgattcgctaaatcttgcatgacattgagtacttcgccaaccatttcagggtcaagtgcggaagtaggttcatcgaagagcatgactttggggttcatcgcaagcgcacgggcaatagcaacccgttgtgcttgaccaccagataagctgttagggaaggcgtcggcatgatcatccagattaacttgttgtaaaagttcatgggctcgttgggttgcggtcttgtcatccacacctttgactttcatgggtgccagcttaatattttcgagaacgctcatgttagggaagaggttaaagccttggaagaccattcccatttgttcgcggagttcattgactcgtttggcatctaaggtcgttagattttcaccggtaaaggcgacttcaccactggttggtgtttcaaggagattgagacagcgaagaaaggttgatttaccactaccagacgggccgataaccacgataacttgaccaggcatcacgtcttcagtgatatcctttaaaaccgtgtttttgccaaagtttttagctaggtttttaacctcaataattggtttagtcatgttgcattctcctttcgaagtaattcaaaattcgcgaagccgtaaaggtcaagatgaagtaaaggaccatgataacggcaattggggcaacaccacggtaagtatcagaccgaacaatattgctttggaagatcaattcggagaccccgatgattgaaacaatcgaactgtccttgattaaggtaataaactcgtttcccaatgatggccagatattcttcaatgcctggggcaagataacgtaacgcattgtggcaccactggacatccctaagctacgagcagcctcagtctggccagcgtcaacggaattaatgcctccccgaatgtattcagcaacgtaggcaccagagttaagggagatggcgataatccccgaggtcagtgcaggcaaattaacgatgaggcctaaaccaaagtagacgaacatgacctggaccatcatgggtgttccccgaataaattcgacgtaagccgttgctaaccaacgtaagccggtccggaagacgccaccttgacccatccgggcaagggcgagtaagaccccgagaatgaaaccaaagaagacggaacaaacggtgataattaacgtatattcaaccccagttagaaaagccttccaatagtgccacatactggtgttgacggtattagtttttaaatacttaccagccgctggcaagtaagttttgttgactagattttgtgttttaatctggtcaacagatttgttggctgcatgaacgagggccgatgagcctttcttgaaggcgactgcggcactcgtatccgaagcatttagattgaaatcgctgggaatcgccgccagttctttgttgttcgcaacgtaggcttgagctgatggcttttccatggcgaccccttggatcttatgactttgcagggccaaaatgaggtcggaaacggacgtcatacctttaacggttgtgcctgaggtttgctttttagattcgttatacatcgttgaaccagtctgggccccgatggtcttgccgacaaaggaatctttatttttatagatgcccctatcgttcttgttgatgacgatactatagccaccctgatagtaggtgtgggtgaaatcaacgctttttttccgagcggcggtggggttcatcccggagattaccatatccactttccctgtttgtaaagccacaagtaaagaatcaaaggacatggatttaacgaccaatttaacgcctaaatccttggcaatcttttcaccaactgctacgtccattccaacaatcttagtcttgccgtgaacagtagcttgaaattcataaggtgggtagtcgggggaggttcccatgaccaacgtcccctttttttgaaccttggttagtgaactatcggtggctgcatgcgccgtgctcgtggtcagtgtgctcatgccaaataccatcgtcagtagtaacgcaaggactaaaatgacgtgttttttcatataatagctcctcaataattttgttattgctaacgagtataatagatagtgcgtatttatacaagttttattttgatatatctatttttatacactaattattcgcacatgaaagcggtaacgtccgtataacacggtaaatctataaaaatttatacatttcaaatgaatagcgattttatgggcctagtaattgaatgaatgttgagtaagtgctaatataaacagtgtctgttttatacggatattcgaataaattttagaaaagaggagttacgatgtcaggacattctaaatggcataacatccagggccggaaaaatgctcaggatgcaaaacgtggaaaaattttccaaaaaatctcacgtgatttgtaccaagctgcaaaagcaggtggtcctgatcccgacggtaaccctcaacttcgtttggaaatggacaaggcgcgggcagctaacatgcctaaagaaaacatcaagcgggctttagataaagcttctggtgttggtggcgctaagttcgaagaaatcacctacgaaggttatggtccagccgggacagcaatcatggttgctgccttaacggataacaagaaccggacggcggctgctatccgttctgccttcacgcaccatggtggctcactgggtgcagcagggtccgtttcatatatgtttgatcggaagggttacattgtgatcctccgtgaagaccttgatacggatgaagatacgatgttgatggacgcacttgacgccggggcagacgacatggaaacgactgatgacgcatttaagatctatacggatccttcatcagttacggctgtgcgtgatgctttacaagaaaagggttattccttggatacggctgaagcgcggatgttcccacaaaacacgaccgaagttccagaagctaaggcttctcaataccaaggtttaattgacgaacttgaagacaacgatgatgtttcagatatttatgaagcagcggtgttgcctgaaggtgttgaataagatttgaagaaaaagaggcctgcgggtctctttttttttcacgcattttaatgctaaccgatggcgattgcggagataactaaaagcacccggaggtgaggcagattgatcgacacgttgattgaacaaatgattgcgacggcaattgagcagcgcgcaagtgatctttacgttttgcctgtgaaagcaggactccaaattcgcttacgttgcgtcacgggagtagtgacgtggcaaaccgtgacgcggactgtgggggaacaactaattgcttacttcaaatttcatgccaatatgacggttagtgagcgtcgccggccacaggtaggcgcactgacctggcataagccatacccagtcgagttgcggttctcaaccgttggggattatgcgcatcaggagtcactcgtaatccggttaatttacgcttatcagcagacgcaaaatgcctatttagtgccacaacaggccggagttctacagcaattggcgcaacaacgcgggttaatgttattttccgggcccacaggtgcggggaaaacaaccaccatgtacacaacagcgcaaaagctagctgcgacagcggtcgtcctagcgattgaagacccagtggagatcaaggaaccgcaatttattcaattacaagtcaatgaagccgctggtatggcctatgataccctgattaaggttggcttacgtcatcgcccggatgcatttatcattggtgaaattcgggacgccgtgacggcacaggctgcggttcgtgcagcgttgagtggtcacttagttttgagtacggttcatgccaaaagtgccgctggaacggtgaatcggttattagatctcggagtagatgccacacagttacaacaagtcttaacggccgcttgctaccagcgactaattcctcgcatccagcagggcccggccgttttgctggatatcttgactgaatcagatctttggcaagaaacgacaaccgtttcagaaaggtggcggcatgcacttgaaacagcagcgcagtctggacatattacagccaaaacagcggcgagtttccaagccgggtaagtggtcattggcgacacaggcccggttttgccagttgttggcggatcagttagccagtggcttttctttgaagcaagccattacgtttctacgaactgtggccggcgaatttccccgtagcctagccacgattgaacagcaattggaacagggcacaccgttaattgacgtgttggcaccctacttacaagccaatgtgtattttcaattaagattgacgctggcccatggtgatctacaaccggctttgcaacaagcggcccaatttttacgtttggcagcaacccagcgtcgtcgctttcagcaactattgatgtatccactagggctattggtgagtatgcttggcctatttgtgacgttgaaggtgggcattttaccgcagcttcagggggacttagcggttcaatcgattggcaatcaaggaggttggtacggttggctgggactcggtggtagctgtttgttaggactagtaggagcttggcagtggtggcatcgccagccgcggttacggctggcaacgctgtatttacgagttccgtttgttggtcaactagttcaggcatattatgcttattatctgacggccaatttaagtcaactgattagaagtggcttgagtgtgaaacaaatgttacgcgttttaaatcagttacccgataaggcgctgttacgccagttagcccaggcattggagctgaaattaatgactggtcagtcgccgttgcactggttgcgtgggcagccatatattccggtccaattagtcgtctttcttcaaaaaggtagtacacacgcacaattgggtcgggaattacaagcatatagtgagctgcaataccgtgagctggtcgcgcgaagtgaacgactactggcactagttcaaccaatcttactgggggtggtcgctgtgatggtcgtgggcgcttacttaaccttactgttaccgatgtatcagaatttacaggaggtttaccatgattaagcggcgacgagggtttacgctaattgagatgacgattgttttatttattatttccctattggtcctaattattttgcccaacttgaatggtcagcggcgccatgcccaacacatccacggtggggccatgctgacggtggtgcagggccaagtaacggcttacttggatgatcatgagggcgcgaagaccgttagctttcaagaacttaaagcggctaagtatttgaccccccaacaggtaacccaagccaaacgcgagggcattcatatcaaagatgaccaggcgattcatgaatcaaaatagacggggatttacgttatatgaaacgctccttgttttagtcattaccttgagcttaaccgttttagttggaacgcaaagccatcgacaataccagcgaatggctgaacgtgccttctggtctacttggcagcaaatgtggacagcgggtcgtcaggttgcgcaacagcagcgacggccggtagcagttaaaatcaatcgccagacaggtgaactgacgctttatcagatggcaccctaccatgaattacatcgtttgacgccacccaaatcgttgaagtggcgggggggtgcgtatgaatggggaatttcagcgaccggtgcagcgccagccttgacggttgagtggctcagtacggccaatcatttgtggtggtatcagacatttcaattaggaggggcgattttttatgtgggtgcaacatcaaaacggcactaagcgacaaggctggttactgccagatgccttattagcgttaagtattgtcgctttgacagtgacaacggcccaacacgtgttactgacaacggaacatttggcccagcaacgtcaggagcagttgacgcaggctcgatatcggcatgatcaagcattgctagcttgggctgaggcacagccatgaatcgtcatggatttacgctgattgaagccgtactagctttagtcgttgcgagcggcctgttcttattggcaaccgggacggatcgccggttggtgcgccccttgcaacatgatccagttgcttggtatcaagcggtccgggttttggagcaacctgggaaataccagttttgctcgacgaccggaactattctcaaattgtgggatcaacagcggcaaacgactgtgcatgtctcattacaccgccagattttaaaattaaccaatagccggggacaaggttattacccattattgaaacatgtggtggcggttaagtggcaggcaacaccttattcgggattggtaaaaatgacgattcaacaggagggattaccatcacagcacgtgttactggatctacgcggcaaggattcttaacgctgtgggcactattcttcttagcggggattagtctattagtggtactggttgtcagtggtcaagctgcccggcgagagagcacaacgcggttaatcacggagtataaccaagccacgcgacgattgaagcagcaaacgaccaagcatgtgaaaaaagtaccgagtcataccgctgtaaagccgttaaaataggattagccacaaagattgcttgaataactttcgaaaaatcggtactatagatagcggatacaacgaatcaggtcaatttcacaaggaggcgaagcgtgctgtcacaagaacagacagaagcactctttaaggtgttagatgaatcgacgaccaccttacaagcagtgctaagcacatcttatttagatgccttcgttgaaacgggagataatctcctcaacgggcaagttcaagttgaagacgggaaaccagacgcaccaactgtggctaaattgacggcgctttatcagcaagtcgattggcaaagttttgatgcgcctacggttcgccgggccgttcaattggccatgttaaaggcaattcgagttgatgacattcaagccaaccaccaactaacgccagatacgattgcgtatattatggggtatttggttgcacgtttagaaaagaataaacaacatttgacggtgcttgatttaacggtggggactgggaatttgttgacagcggtattggcgcaattgaaagatgtgattgcgggtgagattgcggcgtatggtgttgacaatgatgataccatgctagcgattgcgcagacgtcgagtgatttacaacggttaccggttgagctcattcaccaagatgctttggaacaattgctggttccggccagcgacttgattgtggctgatttgccgattggttattatccaatcgatgataatgcggctaactttcaaacgcatgctaccgaaggccactcattcgttcaccacctattgttggaacaagcagttaatcagctaacgccgggtggaattggtgttttcttggtaccaactcaactgtttcaaactgaggcggccaagggcttgttgaaatggttgccaaataatgtctatctacaaggactgctgaacttgccaagtgagttatttgccaatgcgaatgcacaaaaggcaatcttgttcttacaaaagccaggcgctaatgccaagcaagttgagcaggtgatgttgggtgagttcccatcatttaaggatcagtcagcgtttcagaaatttgtcgcagaaatcgtcgagtgggaagaacaaaacctactgacggatcgtcaataaaaggagaagttactacatgggaaaatcattagccgttaacgccggaagttcaacattaaagttcaaactattccagatgccggaagaagaagttattgccgaaggcgccattgatcggattagtttgggtaattcgttagttgaaatcaagtatggtgatgggcaaaagtacgaaactcatcaagatatcaacgatcataacgaagctattcaattgatgttagaccaattgactgaactcaagattattacaaactttgatgaaatcacgggtgtgggtcaccgtgtcgttgctggtgggcaagaattcaaagattcagccatcattgatgacgatgtcttacaaaagattgaagacttggcagaatacgcgccactgcataatccagctgcagccatgggcatcaaggcctttaagaagatcttgcctaacgtggtgagcgtggcggtctttgacacgtcattccatacgtcaatgcctcaagaaaattacatgtatgccattccttacgaatactatgaaaagtacggcgctcggaagtacggtgcccatgggacaagccaccgttacgttgcccatcgtgctgctgaaatgttgggcaagccattagaagacctgaagttaatcacgatgcacttgggtgctggtggctcaattacagcgatcaaggatggcaagtcatatgatacatccatgggcttcacgccattggctgggattgaaatggcgacccgttctggggatattgatgcctcattagtcgcttacttgatggaaaagctgaacattgaaaagcccaatgatatgattaacattctgaataagaagtcaggcttagtgggtgtttctggtgtatcagctgatatgcgagacctggaaaaggttcaagctaagaatccacgggccaagttagctcgggacatgttcatcaaccggattgtgcgttacgttggggcttacctagccgaattaggtggtgccgatgcgattgtcttcacggccggtgttggtgaaaatgatattaccattcgtcaagaggttgcggataaattggcttactttggaattggtgttgattctgaaaagaacaacattcgtggcgtagaacgcgacttgagtaaggcaggttcaaagattaagacactcttaattccaactgatgaggaattaatgattgtccgtgatattgagcggttacggaaataagatcgattgactgacacgttggcagaaagccagcgtgtctttttttcacctaaagttgaacaagtatcatttatatatgtataagatgaatgaaattcttttataccgcggttgaggccgtcttggctggaaaaatgccattaggtggtcgctagcgttaatctatcagccgtgtataatgtatttcaacaaaggggcgattaagatgaaaaaaagtcaatcaaatgaaacccaagaattttcgcggggacttcaaagtcgccacgttcagctcatcgcgctggggggcacgattggaactggtttatttctgggcgccgggcagtcgattcatttggcaggacccgctattttactggcgtacttagtaactggcgtgatgtgttttctattaatgcgcgcgctcggtgaactgttactgtcggacttagatgcacattcctacattgatttcattaaacgttatttaggcgataatatgagcttcgttgccggttggacctattgggtttgctggattacgattgcaatggctgaaattacagcagcaggacaatacatgcaattttggtttcctcatttaccacaatgggtcatcggagttgtcttattaggtgttttgctgacacttaattctgttaccgttagtgcgtttggcgagacggagttttggtttgccattattaaagtggtggctattattgcgctgatcttggcgggggcttacatggttgcggttcattttcccacgccggcgggtcatgccagtgtagctaacctgactactgggcacttctttgctaacggcgctaagggcttctttctatcctttcaaatggttctctttagttttgtggggattgaaatggtcgggatgaccgcttcagaaacggctaacccacgaaaagttattcctaaggcgattaatgagattccgatgcggattattttattttacttaggttccctattggcgttgatgtgtatttacccgtggaccgcagtctcaccaactagtagtccgttcgttcaagtctttaagaacgtgggcatccaatcagcggcggccgtcattaatttcgttgtattgaccgcggcggcttcggcctgcaacagttccctctttacaaccggccggatgctattttcgctgacgtatcaaggtaaagggtcctttgctcggcgaatggggacattgtcgcacgcgcaagttccggttcatgcattgcgattttcaacgctggttattgctatttcagttggcttgaactttattattcccgggcatgtttttgcatttgtttctagtattgcgaccacttgctttctctttatctggggagccattgtcgtggcgcatctaaaatataaaaagcaacaattagccaagggcttaacgactgattttaagatgccgttcttcccgtggagtgattattttattttagcctttctggcgatggtggcgatcatcttgctgttccgaacggatacattgattgccttaatgggatcagtggcttggctggtcgcactcagtgttggaaaagtttggcatgaccgacaagctgtagacaaccggccgcaaactgataaaacttcaaactaatcaaggacaggatcggtgagcatacccgatcctgtttttgattagataagggattggaaccagcgaaaaatagggggaagtgctaggataggggtaataagtaaataacggaggcgttaaagatgaagcaattgaccattgcgggacaaactgttccggctatcggcattggcacatggcatatgggcgatcaaccggcacaacgatcggcagagattgcggcaattcaagcaggaatcgcggccggagcccgggtcattgacacggctgaaatgtatggcgcaggccgtgctgaatctctggttggcgaagcactggctaatgaacgacgagaagatttatttttgatttctaaagtcttgccagaaaatgcgtcacggcaaaaaatggctgtgagtttagatgccagtttacagcggttacgcacggattatttggatttatatttgtatcactggcggggcactgtccccttggctgaaactgtaagcaccttgcagcagctacaaacgacgggcaagattcgtgcctggggaatttcaaattttgatcaggcggatcttaacgaactgtggtcactcccgggtggcaatcaagcggcggccaatgaggacctttatcatttggggagtcgtggattggaatatgatgtactcccgtggcagcgggcccatcagttaccgttgattgcctactcaccgattgctcagggggatgtctgggggcatcatctgaccactaacgaaatcgtacagcaggttgcggcagctcatcacgccacagtctatcaagttttgttagtttgggtgattcgtcaaccccagaccttggcaattccccaaacgagttcgattgctcacatgcagcaaaatatcgctgctggcgcgttaaccttaacggcggaagaattggcacagttagaccaagctttccccgcacccacgaccaaacaaccactggacacgttataaaggaggctcagcagatgcaattctttacatcagatacgcattttttccacaaagatttattaggtgatagcgactttgcaccacgaccgtttgccagtgttgatgaaatgaatcaaaccattattgataactggaatgcccgtgtggctgaaacggacacggtttatcacttgggcgacattgccctatattttacgaaaccagccatcaagtccgatgaggcggtcttcaatgtcttatcgcaactgaatggtcatttagaattgattaagggcaatcatgatagccgagcgttatttaaatacttggcggcccataattttagtgaccatggtcaacccaaatttgcctttcatgatgtgggagcattgattaagtacgatcatcggcaatattacttaacgcattatccgatgatgttggggattgttaatcagattattaacttgcacgggcacattcatcactatgctgttccggttaaagaaaatattaacgttggtgttgatacaccggaacaacggtacttgactaccagtgttccatttggtacgccgttttcaccaacggaaattgaacagatggtcacgggtaaggctcaggagttccgtgaaaaacaatagcgcttgaccgttccgtttggatgccgtaggattaaaagcagtgttaagaggagaatgagatgatggaacggataacaatcttgcacaccaatgacctgcattcgcattttgaaaattggccgcgcattcggcggtatctcaaaacaacgcgccaacaagtgatggccgatggggcaacggtgtacacctttgatctgggtgatcacgttgaccgggtacatccagttagtgaagcgactaatggccagcaaaatatccagttaatgaatcaaattgggtatgatggtgtcacgattgggaataatgaaggactggggtttgtgcgggcgcaattagaccacctgtacgaccatgcgaattttccagtgatcctgggtaacttacgcataccagacacccatgaactaccagactgggccattgatcatcgcttgttaacaacggcggctgggacgcggctattagttctgggattgacggcgccgtatcatctaacctatccgttggccgggtggcagattttagacgtgcaaccgaccttagcggcactcttacatcgcttcgctggccagttcgatgtctgtgtgcttttgtcccatcttgggctggatgtcgatcgcttactagccaagcggtttccacaggttacggtaatcatcggcagtcatacgcatcacttattgccacatggagaacatgatcatcaaagcttactagcagcagctggcaaatttgggcggtatatcggtaagattgagttgtcaatcacaccggatcatcaggtgaaatcagcggtggctagtgtaacggaaacggcaacgttaccggttgcggatggcgatactgctgagattacgagtttacaagatctgggagaatccatcttgtctgagcaacgagtcgctaatttaccgacagcgatggaagccgatcccactggacaaccccgattggtccgtgaagggctgcatgctattgcggaatatgcgggtacgcaagcagccatattgaacgctggcttatttctacaagatttgcccagtggtgtggttaatcaaaatcaactgcatcagttattaccgcacaatatgcacgtaatgacggtgacactaagtggttatgatctttggcggctcgtccaagaatttgagctggctcggttatttttacgtcggttcccacaaaaagggatgggctttcgcggtaaaatctttggcgaactcaattacctaggtctggcctatgatgcggtaactcatcaagttacgtggcgcggtgaacccttgtcacctacccgtcaatatcgcattgcaatggtagatcattacctgtttattccgtttttcccgacaatttcgattgttggtaagaaccaaattttatatgacgacttattacgagaagtgttcgcacagtacttggcgcggcactatccgttaacttaacaaatgagaggatgacgacggtggatcgcaaagatttggaggcactagttgcccaacaaaaagaaacccgcgagccagccgctgaagtggtgcgggtggatgaaacacatttgacgattaataaccacccttatgaattggtcgttaatgtacgtgacggttttgactttacggagtttgcggcccggttcagtacgattttaagtaaattcgattatattgttggcgactggggatttgaacaacttcgcttgaagggattttatgccgaagagcgttccggtgcgaaacaaaatcagattgaagccgttcaggattatttatatgaaatgtgtaactttgggtgtgcttattttatcctgcataatttagacgttaaaacagcacccaaaccgcggcgaaatcgacgtcggcgtaataccaatggccctaaagttgaaaaaacaaccgcaacggctgcacaaccagcagttaaggcggatactgccggagacaagcccagtcatgcgaataataaccatcggcggcggtctcggcatcggcggcggaatacgacccatccatacacggaagaacggcggacgacggttaagccaacgtcaacggcaactaagacggtgaccgtcgcaacgggtggtcaaggtcggcgacattttaccattcgaaaaaaggaagaagagtagggagcggttgcagtgaaaaagtatcaagcttatttaatcgacttggatggcaccatttatgctggggctaaacggtaccctaaggcgaaggcttttgtagaacggctacaggctgcacaaattccgttcaaattcgtaacgaataatacgaccaaacttccggttgatgtggtggctaatctagctgacaatcacgatattcacgtcaccacggataatgtttatacggctggtctagcaacggctgattatttagatcaacgtgcaggggctaccggtaagcgaactgtttatgtggtaggcgagattggtctgcatcaggcgctggcggctaaaggatttacggtggatgaagaacatccagaatacgttgtggttgggctagatagtgatgtgacgtatgaaaaatttgctaaggcaattcttgccattcgcagtggctcaaccttcattggcacgaattcagattctaatattcccaaggcacgggggctaatgccaggtgcgggtgcactggttgatttggtgcggtatgctacccaaacggacccgatctttattggtaaacctgaaccgattctgttggaaaatgcattgcaccaattaggaatagcggcggaccaagccattatggttggggataattatcaaaccgacatccttgccggcattcatgccggtgtggatacgttgttgacatatacgggtgtctcgactcctgaacaagttgcccagcaaaagattcagccgacctacaccgtaagtgcgctggatcgatgggatttcgaggtgggaccacgtgactaggttaaaccgttggagtggtttcacggcgttatttttagcattactaacgctaacgataaccttaacgatcaatgcattctggctatatcgactcgatattcactggttagggattacgcacctcgtgaatatgtcaccgacaaggattatgcacaattattaccagttgctacgctatttggaattgccgtgggtgactgagttaaatatgaccaactttccaacttcttttaccggcatgattcattttgaagatgttaaacgattatttttgattaatcatatcgtgttagtgttgtcgatcattccggctggctggttcttacggcaactacatcagcggggtgaggaatggcgactgattcgaccggcccaagtggcggcggtcattcctgtatttttgggtgtgatgttgacgattaattttaatgggttcttcattgcctttcatcaagtcctgttccgaaataatgattggctgtttgatccggatctggacccaattattaacgcgttaccggatacattctttctgcattgctttatcttagcgtttgttctatttgaactgggtgtaggctggctgtattggcgtggtagacacgcgattcaccaagcttaattagggcatcaataagtatttaacggcacgtcattcattaatgaatgacgttttttttgttttggggtagaacgggctggggagattttcgaaggagaaacgttgattcttgagcaatcagttatcttaaatttagtttgattaaagggccaaagataatggggaggatgataatttaactaaactcattaagttgtgcgtatgaatgatttgttaagaatagcagtggcgaccgcacgataattcaggagtttctagggctgatcggcaccagtaggagtgacgatttttgggaatgatcagtggcccccgcaatcaatcagttggtaaaaggctattaaaaataaattgtgagcggttaccatcactaagtgaatagatacgaaactccggcttttgactagttttttaaggcggaagtgagtatgatactcgtgaatcaagtggagggttactccacgtgacgttagtttgaacgctgacgaacagagtggtcggcacggtttaaattttgtggtgggggtaggttgtcaatcggtatgataacaaatgtgtataaacctgttaacggctagatttaactaaggaagtgtggattatggctctccaaatgaaaaaaatttggttaagcagtttagctgtagtcggattaggcttaggattagcggccgcagtaccagcattagcagcaggtagttcctcaagttctggttcttcaagtcctagtgcgacgttgacacctaaagacagtcaagcaacgacggtatttacaacgactaacccgtcactgacattaagtaaggtgccaaatattgactttgggagtaatgcaacgcctaatggctcaacggatctcagcgttcaggcggctaaagtagactccgatctagaagtggccaacgatgggattgccagtggctggaacgttcaggtaatgaattcggcatttacggattcggctaccaacaattcgctatatggcgcgaagctatcatttgcggcggctggggtagccccggctaatgcagataacgcttcacctaagccagcgatgagtgcagtttccttgagcggtgatggacaaaatcaactagttttgtctgcaccagtcaaaggtggtctgggcatttgggatacagagtacgctttgagtgatttcaagttgtcagttccggctggtcagttaccaggatcgtatgtttctaatctgacttggcagttaagcaacgcgccacagtaacaaataaggaggagattgttgttcatagaacgttgggtcacagtgaacctgtgatgaagaatgactcgttgggcctgccggtttgcgcttgtcgcaaacgctacagaccctttgttatgtgatgaatgaaaccgtctttatgaatattcttataccaaatgaaattgatcaaaaaagttgaggtgtcattgactagtggcgcgaacgtttgaaaataaaatgacctaattatcggagggatgaaggtgttaaagaagtggatatgtgcaggggcgattttgatggccgtcggtactggtggcatgactgctcaggcagcggatgcagggagtattaatcaggccgattataagaaggcgttagaaacagcccccatggggattgtaatggatggggaagatgctgctgtgacaacagaaaaaacggatagccaaaatagaagtaaggccgagattgtttccgggaataatccaagtgttccaaatgggcaggttgtctcaatgactcggcatcaaagcgagtatgcctctatttggtccaagcatggcagcgaatttgagctaactaagccgcaaacgacatcaatgtggttatattttgggaaccagtactcagcctcaggtgaaggaatggcatttgctatacacaacgatgcgcggggtgtgaatgcaatgccggaattgaataaaaaagggagtgtcccaggagaaactttaggagtctggccatcagataccgttagaacacaaggagaggccgctggcttagcaaagcgaggtattcaaaatagctgggcacttgagttcgacacacatcagaacattaaaagcggggggcgtgcagcaggtcaagcggactcgtttgatttggaatttgagaatagtaaggttggagaccacattgcttctaatcatcccggaagtagtgctagtttcatacagcacgttgactctggggttctttggactggaaatacaccaataaacgtgatgcattactactatcacatacagcatgttgggatgattggtgataaaagcaatagtaactacttgtcaaacggtcagtggcgacatttaacattaaaatggcaaccggctaatcatgaaggtaattcgtacggtcagatgacttatgtttttgatgataaggatccgaagactggagagcgtcttaatggtcgggaacaaacagttaatgttaatgttaacacgattgatccagatagaaatggcaaagctcgttggggacttgccggtacgacaactactaagtttgcctccaatcaattagtggtcttcgaaaaagcaccagaccttatcgatggtaagacaactacaacgctaaaaaatcttacgcgaaagaaggaagttaaagcgggggacgaagtctttgccaaggataagctcgagctatcctatcagttcaactatcaagatgggcaacaagctaactgggcgaatattcaaagctacttaaagctccctacggatattgattatgataaggccgaagtcacgtatagtaatgggcaagtgcaaaacatttcccttgatgatcgccaagaccaatcaattaatgtcttcttggcagagaagctaaataaggatgttgccacggctagtattcgatttacggggcgcgccgctgcggtggacgatcggcgtgaggtcgctagcacaactagtaaatacacgtctaacgtgatgattggtgagttaacgacacccgactttgttattaatcccagtcaagaattaacgttaacggtcacgagtgatcaacatctttcactgcccgtcaatgaagcgacaactattacgggtcaagttgacttagatagtgctgctacccttgcacacgatgagccaatttgggtacacgtaactattaacggtaaggttcaaaaagaaccgatcaaagtggctgaagatgggacgtttaaggttacgctacaggctaaccaattacaaaagggtgataatgtcattgaagttgtcgcgacctctggtgagttacggtcaaatgcagaagaagtgacgatttcttgttcaggctgtttagaattaacggcgcctagtgacgtgtcgtttgaatcgaaacaactgactggtcaacgccaggaattaaaacgtggtgatggttgggaattgtctgtgcaagatacacgaggcgctggttctaaatggcgcttgagtgtgaaagctgcgacctttgttaacgaggtgggcgatcatttacttggcaagcccgtttatgcgactcgcgaaggaaaaacgccaattgaaaaagaaatgacgccaattgtgacgcacgaaacgactaaaaaacaggcgaaaaaccataatgtttatggcgttaccgatgattgggaccaccaaacagggatgtttctttcaatcgacgatggcgcgacgactggaaactatcaaggcgaattaacgtggtcacttgatgatgttcccagctaaccttgactagggcgaaacaaaagtattgagcggaatagaaagcaccacaatgaaggatgaaatctagttggctactaggtttcatctttttgtcttgaatcaatgaacgaccattgcttcttaactatagaataacgaagccgcttcaacggtggaaccacaacgaatccgcttgtaaacgaacttaacgtgaaattagctagtttggggcacgaactagctaaaattaaccattcgaatgggttatttactgacagcccatcattttcgcgtatagtgtgggcagcgttaggaagtaagttgtcggttttgttttttggaggaggtgttaacatgagacgaaaaacgcgcacagttctgtggagcttgcttgtcgcgttgacttttttgttagcaggaggatttctgacgcaaagtatatcggctcaagctgatacggttccgattatcgggttaacgggtagtgatgccaaggtaactgactttgacgggaacccgattgctggtggtcaagtaaccaatggtcaaagctataaggtgagttatacatgggggattcgagatggtataccagtaagaagtggtgatacggcggttgtttctttgccaagtgggatgtatgcggctaatgatatggtaatttcaattgtagatgatgctggtcgagaggttgggatcttcacaattaaggcaggtgaaaccagcgggattatcacattttcagatttgttggggacaatagcgaccaaccgtgccggtactttgactttcgcggttagagctggtgaaagttctgggaataatgcgcagagtaataagatcgcaaagcaaggcattattcttgagtcagatgcgcaagggcgaccgaccaaattacgatggacgatttatgctacacaagccggtaaagatgcaaatgacgtggtgttaactgataccatgggacctggccaaacgtatgttgagggctcggctactgcagaacgggggcagttgatgccaactggcgtctttgtgggatcgtcaaatgtaacgcctagtgtagcagttagtggtagtcaactaaccatcacggttcccggtgtgaccaatgctactcgagtaacctatgacacaacaccaacgaattttgatcaaaatgggtgggaaaactctgtttcgtttaatggtcaaaagagtgattctaatattgcgtggggcggtggtgcaactggtggcggtacgcagccaaacacggccactggttcagttgtattaaccaaaactgacccagaaggtaaggtcttagcgggtgcaatttacacgttgaaaaaggccgatggaacggtcgttgcatcgggattaaagacagacgaacagggtaaaattacgtatgaaaaattagagccaggtgcgtatgagtttattgaaacggctgcacccagtgggtatcaagtgagcgaaaagccagtgacatttacgattgttgctaatcagacggccgcggtgagcgtaacggcgcaagacgatcccttaaaagagaacccagggacgacaacgccaacggaaccggaaaatccaacgaatccaacggagccgggtaatccgggaacgaccacaccaactgagccgacggagcctggcacccctacgaatccaacggaacctagcaatccggggaccacgccaccgacgaaacccgaaaatccaggaaccacggtaccgccgacaaaaccgggtgtcacgcctccaaccaagcctggtgtgacaccaccggcaaagccaactaagccgataaaatcaacagtaccaccaacgatgccaaagcatccgacgactccaggtacgcctattacgaccaagccgggacatcctaagacgcctagcacgccggtagcaaccgttaagccaaaggtagcaccgtcaagccgagtgacacctaaacacgtggtaacagcgactacgaatggttcggtttcgacgggaacaggtgccccaactgggactatgtcgaccgggatgacgccgtcaagcacgggaacggaacatcgaatgggtcacagtaatggtgcggtttatgctagtggacatagcctgccacagaccggtgagcaacgaacaaccagtcaagatctacaagtcgttggaggggtacttctcatcctggtaggtattggtggctatggctggtatgagctgaaacgacgagattaattgcataaaggaaatgacgcgtcctttaatggggcgcgtcattttttttgagaatttgggggttcatggtcttaaacggtcaacgctatttgctaattagggggattaaccataaaatggggttgaaatggcaacttaattagattacagttaaaagattcgtggcagaatgattacttataggggtgggttatgaaagacatatttaaaaaagagtcaattgcaacatatttgaaagcagatgctcggttatccaagacgctgcgtgcacgtgatttggtagcgttaggaattggtgccgtgattgggacgggaattttcattcttcctgggcatgaggcggccttgcacgctggtcccgccgtggccgtggcctttttactcgccgcactggtttctggaattgttgggatggcatatgctgaattctcctcagcgatgccagttgctgggtcagcctattcatttggttctgtcgtttatggcgaaattgtgggctggattctaggatgggccttgattttggaatattttctagcggtgtccgccgaagcaaccgggtttgcagcgtattttaataataatattttacacgctgttggtctcaacttgccgcgagctttgcaggcagggccgatggaaggtggcgtgatcaatttatcagcaacgctgatcgtgctcattgtggcgttcattattgttcacgggacgacgttatctaaacgcgtggagaatgtggcagtggtcatcaaagttgcaattattatattatttattgtagttggtgtattttacattaagtcggcgaactatgtcccattttatccgcaaaagttccgaacatcaccgtgggggctaggtgggatttcaacggccgcggcaactgtcttctttgcttttattgggtttgatgcgctagccgctaactcagccgaaacaattgaaccggagaaaaatgttgttcggggtattttaggaaccgttgtcgtatcagttatcttatacgtcgccttttcgttagttctgacggggattgttaattatcggcaactaaatgtggatgatccggccgcctatgcgttacaacttattcacttgaatacatggaataagttgattaccattggggcattaatcggtatttttacgtcgatgattaccatgttctttggcggttctcggctggtttacgcgttggggcgtgatggcttgttaccagctcgtatgggtgagattagttttaagcgtgccgtgcccaagaatgccattattgttgcaacggttgtgcaggcgttctttgcgggactggtgccgctgacagaattggcttcgctcattaatgcgggaacattgctggcgtttgcctttatttcctttggggtcattcccttgcggcgacgaaccgatattgaaaatcatggctttaagatgccattgtacccatttctacctattttggctggggtagccagcatttactttattattatgttgccgaacgtgaccaagatttccgtggggctatggctcttggtgggagttggggtttactttggttatggtttgcgccattctaaactgcaaaatcgaactgaatagtcaaattaaaactaggagtgacccctatgacgaggggcactcctagttttattatgtagaaaaaaattcacaaaaaaacagcacaacgtttgaccgttatgctgcaatggtgaggtgcggcgaccttcggaacgcttgcgcgccgatcgcgtaccctcaccgtggtttggcacctcgactagtatcgcatgagtggcgagctaagtcaaccgaaaaaactagctataggactagtgccttacataattgttggcaccaagccaccatctagacgtaaggcctcaccggaaaaggagctagcatctgggctggccacgaaggcagtaaatcgaccaatttcagctggtcgaatcaagcgttgaatttgggagcgtgaacgatggtttttcatgaaatcagcttcccattgatcccgtggtagaccactgtcagcgtacatagtggtcaacatagcttgaacaccctcggtaagggtggatcctggcatgatggtattcacggtaacgtgtgtcgcaacggtcaattttgacaagcttttagctaaggagaggttcatggacttggtcatactgtattgtggcatttcaccagaaggcatgatggcttcttcactggcgataaagataatccgaccgaagtcttgagctagcattttgggaagataaaatttagctaaggcattacccgctaaaacgttaacgtcaaagaatttacgccaaacatcatcggtaatttcttggtaggccataggctcaaagattcccatattgttaatgagaatatcaacttgtgggacttgcgtaaagagtttttgctggtctgccgactgggcaatgtcggcagcaattccacggggatgggtcgttgggaagtccgtagtgagttcttgtacgacgtgctcaacgaccgaagcttggcgaccattaataatgacatcggccccttcacgagccagttcagttgcaatggccttgccgatacctttagtagagcccgtaataagcgctgtttttccggttaaatgtaaatccattgatgtaacctcctaggtcagaaatcaaattcatcagggttgggtcccacgcgtaagtcggcattgagggcgtcaatccgctgcatatcttcaggcgataacttaaagtcaaagacggcggcattactagcgcggcgttttggcttaaccgatttaacgacaagtagaatgtcttgctgaatatcccagcggagaatgacttgagcgactgtcttgtgatgactggccgacaagcgatgcggttcaaagttgtttacaccaaggactttaatcttgttcactttaaagtaagttttgaagcagcaatcggaaaataggggtgccttaattttttgtaaacaaaaaaccaagtcactaagacttggcacgattttaatcgtcttcaggaacgcgattgggcgttgcagggtgtcgacctcttagccaaccaacaatggctggaatcagtgaaatgatgataattcccagaacaactgcggaaaagtgttctttcacaaacggaatgttaccaaagaagtacccaccaccggaacagataaagacccaagtgatagcagcgctaacgttgtaggttaagaagcggccatacggaaactttgagcctgccgcagtgaacggaacgaatgtccgaataattggcatgaagcggcctaggaaaattgcgaggggcccgtgtttacggaagaacgcttccgattgagccaatttgtctttattaatcagacggccaaaccaggaatgattcgacagagcggcgcccgccttgctaccaagatagaagttaagggaatcaccggcaacagctgcgagtaagaatagaccactaaaaagccagatatttaggccataagcgggattagccgctagagctgcagcggcaaagagtaacgaatcacccggtagaaatggtaagataaccgcaccagtttcgataaagatgatggcaaacaagatgatataggtccagccgccaaaggtattgacgatattgaccaagtgactgtcaatgtgaaggacaaaatcaattaaatatcccattaaggttctccttatacattttaatttagtgaccatagtgtaagtcagaagacacctcactgtcagcagaatcagtgaagcttaatgaaattatgagaattacttaaagggggtatcttgttccccctgatcgtcatgggccaatcgtgctgcagctgcggcagcaatggctccaactaaatcatctaaaaaagtgtgaatgattccgggttcatgagcattcaatttggctaggattcccggtttaacccggtcgatgtaaccataattggtaaagccaattgacccatagatatcgacgatggatagcgccatggtttcatcaacaccgtaaagaccctcatcacgttcaacaatggtttgaaggggttccaagagtgtgtgattttcagctgcaatatctagttggatacctgtgataatggcattttgaacttctcgtttgcttaggacggtttggacactatccaaggctaattcaggactcaagtctttaatgaagtttttttgtaagaaaataaccaggtcggctatgtcttctaaattgacaccacgctggttgagtagatcaatagtacgttgttttaaagcagttgctggttttgccatgagggatctcctttattagttaattaatttcagtataacaccgaccgcgtcggttgcatttttgttgactggcggtgataatagataaaagatagtgtttgaaaagatatggaggataattatgacaaagtttccacaaattgatttggctaacgccaggggcccacaagtcacgattgagacatcgatggggactattcagctgcagctgttccccgaacaagcaccaaagacggttgaaaactttgtaacccacgctcaggctggttactatgatggcttaacttttcaccgagttattcctaactttatgattcagggtggcgatccaactggtactgggatgggtggcgaaagtatctggggacaaccatttgaagatgagttctcacaagagctttataacttgcgtggtgccgtgtcaatggccaatgctggtccgaatactaacggtagtcaattctttattgtgcaagataaggacatgactgaacaaatgcaaggccaaatgaaggatgctggcttccctgatgaaatcgttgatgcctataagaatggtggtacgccatggttggacttccgccacacagtctttggtcaagtgatctcgggaatggatgttgtcgatgccatcgctcaggtcaagacggatgctagtgatcagccagcaacgcctgtaacaatggataaagtgacgattcaagaaaatgactaatcaaaaacctactataagaaggaggacggtagcatggcatttcagattggccaacgggtgactggccatattaccggaattcagccttatggggcctttgtcagtcttggcggtcatcgccagggactgattcatatttcagaatgtcattgtggctatgttaaggatatccatgattatctagcagttaaccaagaggtggatgttgttattttagacatcgatgagtttacaggtaagattagcttgtcgttaaggtgtttggaacatgttgactttaatcaggagacattaccacatcagcatcgacactattggacgaatcatcgaatcaatattggttttaaaccaattgcagaccgactatccggttggaaagcggaagcgtcacgacgtttagatcaagaaaaggtctcctcctaaagaggggcctttatttttttatttttcccttgacctaagacgggatgcttggtaagatattacctgttgctgtgaacgacagaaatgcataaaaaataaattgctgaatagtcatacaatttgaaaataatgcttgacgcgttaaacagcaactgatacaatgatttatgttgtcgaaaggcatcaagcatccgaatatctcagccaaccggttgaatatatattcaaaagttttaaaaagatgttgacatgatttagacgacatgatatactttaaaagttgtcacggagcgcttgcttctgataactcaaaaaaatcgccactcacgagtcagtgaatggcgattttttattcaaatgacagttcaaccaaatacgtttgggcatttttaatgtagctggttgtgatccagacttcttgatagtcaagcttagagctattagtacgggcgaagaagtcattcagtagctcaccatgcttcgcgagaaaatcattgtccatccggttgactagcagatgacccaccgggaaataaatttccggattagctacaggaaccgtatccggaacgccaatcgcaatgacattgctgttgcgttgacgaataaaacgtacgcggtcttgatgccgatgaatgtaggttaagacgttatagattgaatccgagttactcgccacagttctctttctcccttcggtgtctacattgtaacaaatatttgctggtttgccagtaagatagaacggtaatcctttattgcaaacggtcaataggcgagtataattatcgcatatgcttttttgatgtttcatagagtaatgcaaagaaagaaggccaaatttctaatgatgcgacttgcccgaaaacatttggactggtgggcagtagtccttgctgtgggttttatgattattcaagttgcctgtgacctatcgttaccaacgctaacctcaaatatcattgacaagggaattgcgaataacgatattggttacatctggcgaacagggggcaaaatgctccttttaagtttcatcggtgtgctgggagcggcagggaatgtctactttgctgccacgcaatcccaaaagatgggacaacgaatccgcagtgttatttttaagaaagtgacgtatgcctcaacggaagaatttgaaaccgtcggtaatgcgtccttaattacccggacgactaatgacgtggttcagattcaaaatgtcatggttcaaatgttacgaatgatgttaatggcgccaatcatgctagttggcgcgggggtcttagcctatgttaagagtccgcggctgacaatggtgttcctagtggcattaccagttttagccctgtttacgggattagtgatgtactttgcggtaccactctttaagagtctgcaaaagaagattgatcgcatcaatttggtctttcgtgaaggactgacgggtgtgcgggtcattcgggcgtttaaccaagatcagttcgagcaggaccgttttgaaggggccaaccaagattacacgaaaactgggattaaggttttcatgattgtgtcattaatgttcccgattattacgttgattgtgagcggaacaaatattgggatcgtctggtatgggggtcaattgattggtaaccaatctatggaggttgggaacctagtggcctttatgacttacgccacacagttgttgattagttttatgatggtttcgatggtcttcgtctttgttccccgggcccaggcttcagctgcccgaatcaatgaagtgatggacttgaagtctaagattaatgatccagatcaacccgtgacagttaaggatcaagcagctagtttggtttttgaccatgtcaatttccgctatacaggcgccgaaaagttggcgctagcagacgttaattttcaggcgacggctggacaaacggtggcgattattggggggacgggttccggtaaatcaacactggtgaacctgattcctcggttgtttgatccagagagcggtcaaattaagctaaacggcactgccctaacagcaatgagtcaacaggccttgcatgcggcggtgtcaattacccagcaaaaagccgtactgttttcagggacgattcgtagcaatatggtttacggcatgcaagatgccagtgacagtcaaatatggcatgctctagatgttgctcaggcgagtgactttgttaaagaagagggcggcttagacgcggttgttgagcaaaatggggataacttctctggtggtcagcgacaacggctggtgattgcacgaacgattttaaagcgcgcgagtgtttatatcttcgatgattctttctcagcactggactttaagacggatgccttactacgacaacaattgcgccaagacgagcaagttcaggctggtgtgactgttatcgtggcgcaacgggtgtctacggttgccgatgccaatctgattttggtgattgatggtggaaagattgtgggtcaaggtacgcacgatgaattaaaggccaccaacaagacctatcaagaaattcttgattcgcaaatccgaaagggggatgctgtcgatgcgtaatggacgtgggtccgcaactaaacagcggccacagaacttttggaaaacgacgggtcggttatttcgatacatgaagcgctggcttcctgggattttcgtcgtgttaatttttgcgattgtctcggttgttttacagattagaacgcctaaaattttgggccaggctacgactgaactctttaaaggtgtgatgaaagggcaggcgcaattgaaggccggcattgggattcacagtctaccaattgattttggcaagattggtcatatcttagtggtggttggcgtgatgtatgctggtgcggcaatctttgggattgtgcaacagctgattatgagctggatctcgcagcgagtcgtttaccgactacggcgagatttgaaacaaaagatgcaacgtctaccgatcagttattatgatacacatagcaatggtgacttaatgtcacggatggcgaatgatatggataacattggggggacgttgcagcagacgctctcacaaatggtaaccagtgttttgacgttcttcggtgtactctatatgatgctcaccattagtggctggttaacattagtggcgttgatttcggtaccgttgagcttattagtggttatgattgtcgcccctaaatcgcaacgtttctttgccagtcaacagaagaacttaggtttgttaaatgatacagtcgaagaaacttatgctggacatacagttgtgaagacttttaatcaagaggccgaggctcaagcagaatttgaagagcataacaacaaatactaccattctgcttggaaagcacagtttgtttctagcttaatttttccgttgatgaacttcgttaaaaatttggattatttagctgtagcagttatcggtgggattcaagttgctaacgggacggttagcttggggaacgtgcaagcgttcttacagtataccaaccagttctcacaaccgattacgcaaatggctaacttgaccaatacgatccaagccaccattgcatcggctgagcggatctttgcggtgttagatgagacggatatgtcgccggaagctacgggaaccctaccagaagccactgcggccaatggcaacgtgattgagttcaacgacgtagctttccagtacgttccagctaatccgctgattgcagactttaacttgaaagttaaaccgggcgagatggtggccattgtcgggccaactggtgccggaaagacgacgattattaatttgctggagcgcttctatgatgttcgttctggggaaattaaatatcggggtcaaaatacgcagtcggttagtcgaccggaattacggcgtcactttgccatggtcttacaagatacatggctcttcacggggagtatctttgacaatattaagtatggccgagaagatgcaacggatgatgaggtttatgcggcagccaaggccgcccatgccgatacgttcattcgtcaattaccagaaggttatgagacggtcttgaatgaagcagcaaccaatatttcacaaggacaacgacagttattaaccattgcacgggcatttgtggccgatccagatgttttaattttggatgaggcgactagttcagttgatacgcggacggaaatgctgattcagcacgcgatgcaacgcttattagcgggtcggacaagctttgtcgtcgcacaccgcttatcaaccattcaaaatgctgaaaatattgtggtcatgaaccatgggcacatcgttgagacggggaatcatgatagcttgttagctgcaaatgggttctacgctgatttgtacaacagtcaattctctggaaacaacttagcataaaataaaaagattagccttgatcgcggatgacgtgatggctaatcttttttaatctcgcgagttgcatgggggcaagaaagatgggtacaatgggtgacaagtagaaaggggtgagggcgtgacttatccacaaacaaaactggcgttgcaccggctagtaacggacggcgtggttccgggcgtcagctatagctttattgatggtgatcgtgtagaaacgggggtcatcggtcaggcagcattggtgccccaaacggagccattacgtcccggaatgttatacgatgtagcgtccttaaccaaagtggtgggaaccttgagtgtcgtcttacagttgttagcacaaggacggctacatttgacagattcggtgtctgattggttaccccaatggcaagattcacgcgtcaccattcagcatctattaacccatacctccgggatcactgggtatattccccatcgcgatcagttagctgccccagaattaacggcggctttattgaagttacacgttggtcccacattcaatcggcagatggtttacgccgatgtgaactatatttttttaggctggattgtcgagcagattctccaacaacccattcaaacggttgcccagcaacgagttttgacgcctttgggcatgcagcacagcacgtttacaccaaccaatgctgaacagtgtgttcccacagcagtaacagctgagcggggcgtgattcgtgggatggttcatgatcccaaagggttggtgttacaacgccggtgtgggtcagcggggctgtttagtaccgttgccgatttgacccgattttgtcaggcctacttacgaccagaagcggccgcaacggtcttgccgccacagtgggttcaccacttactgagcgattggacaccgacccaccaggctggtcgctcattgggctgggcattaaccacagcgcagtggccaactgctcaccgggtcatttggcattcaggctttacgggaacgtatctggtcattgacccactgatgcaacaagccatggttttcttaacgaatcgtgtgcatccgatagcacctaacgagccttatttggatcaacggaatgcggtgattagcacttatttagctgagaaaagtcgacaataaactgataaaaaacgatgtctccacgagtagggtggacacatcgttttttatatctttagaaagttgccgggatcggaagtgcggcttgggttgtgaaatcagcctctgggtattttcggcgaagcgctgctaacaacaggtgtttggcaatctcaccgttgcgtgtcaagatggggccatggaagtaagaacaatagacgttcttgtaaatagcgccttcggtaccgtcttcaccgttattgcccttacccgtgatcacgtttcctaatggtcgttcacccttgcccaagaaagtccggccttgatgattctcaaagccatggtaaacttcaccagtttcggcattcttaatttcaatatcaccgataaatcggttattatcctgatcgagggtgtaatgatctaaggcaccaattccggggagcttttcaccattagcaccaatgtagtagtgacccaataattggaaaccaccgcaaatggctagtactggcccgtcatcttcgataaacttaatcaattcagcttttttagtttggatgtcttgggccacgatggtttgttcaaagtcctggccgccaccaaacaagaccatgtcgtaatctgctgccttgaagtcttcttctaagctgacaactttagcatctaaggtgacgtccatttgtttggcatagtaattaagcgccaaaatattgcctgcatcaccgtacgtattcatcagatcaccatagaggtgagcaatggttaaatgagtactcatgcgccaaatccctccttaatgtagcctttggtggctaaaatcttacgcaactgtaacatggcggtataagttgcaagaacatagacccgttccgttggtaagtccgtgatacggtcgacgactttttccaaatcgggttccacaatgtgctggtcgtcggggacgccggccacctttaagcggaaggtaatatctttataacgctcaccaccggtaatgaacgtgggaatgtcaagcgccgttaactgttcgaaatcgccgtcccaaatccaactggtatcaataccatccgcgtagtttgcattcaacagggcgacaaatgagaattgttctttatcggtgccaatcatgtgtaagacctgatcgaggcccactggattcttcactaaaataatggtgactcgtttgtcgcccacattgatgacttcctgccgaccgaagacccgttcatttgctgtaaaggcgtgagcaatttgttccggagccacgcccataaagcggccaacagcgtatgctgccagtgcattgtagatgttataggtaccaccaacctgaatggtgaatggatgaccatcaacatcaaagtgagatgaagtgggggtctgttcgcccagtgcggttaaccgataagtaagctctggacgagcaaagccacagttgggacagaagtactttccttgattactgtaggtcaaggagtggtaatgtaaaatatgctgacagacggggcataaaacgccatctgtattgggcttggctttcatgtcagtgtcaggttcattatcaaacccgtagtattgaattgggttcgggagttccttggagttgaaaatgggggaatcaccattggcaataatcgttgctttaggggccaaagccactccgtccaaaattttttggtaggttgtgtagatttcaccgtaacgatccatttgatcacggaaaatattggtgaagacaaaggctttaggttcaatgtaatgtgtgactttgattacgttggcttcatcgacttccaagacagccaacggacgacccgtcttgggattcttggcattcaaaaaggtggtaacgatcccttgttccatgttggacccagtggggttcgttaagatggctggatacttttcgtgaaggaccgaaacggtcagagccgttgttagcgtcttaccgttagtcccggtaataacgatgacatcgtatttggcacctagtgtgcgtaaaatattcggatcaagctttaacgtaatttttccgggaagagaacttcctccgtgaagaaaggtatggagaaaccagtaagaggatttccccgcgaaggtggcaacgccgcttctaaatgacatgaacttttcgctccttaattgcgacaatttttttaatgtcgggttccttaatattcaagccttaattttagcattttttcggccattaggggagtctagcgcttgaactttgccaaatcgctaagaaagtttgctggttggacggtcgaattttccggggcaatcagctataatagatagaaactgtcaaaaaggtgggagtaacgtggcgcagctattttttcggtatggtgcaatgaatagcgggaagaccattgaaatcttaaaggtcgcccataactatgaggaacaacataagcgagtgatcatcatgaccagtggactagatacccgtgatgaggtcggttacatcgccagtcgaattggactaaaacggcaagcacatcctatttttcaagacacggatctctttgaagaaattcaacgcattgatgcccaagcaaactgcgtattaatcgatgaagcgcagttcttgaccaaagcacatgtgttccagttggctaaggtagttgatgaactgaagattccggtcatgacgtttggcttaaagaacgattttcgcaacgaattattcgaaggttccaaatacctgttgctatacgcagataaaatagaagaaatgaagacgatttgctggttctgcaccaaaaaagcgattatgaatttgcgctttcacaatgaccaacccgtgtacgaaggcgaacaagtgcaaattggtggtaatgaagcctattaccccgtttgtcgtcgccactatttcaacccaccattagatcagattgggaaataacgaaacgaggttaagagaaaaatggatgaaatgtttgataagctgcaggcggtcgcagatcggtatgacgagctcaatgagttaatcagtgatccagaagtgattgcagatacgcagcgttttatggctctttctaaagaagaaggagaactacgagaaacggtcgataagtaccatcaatatcaagatgtcacccaacagattgcggacgatgacgagatgctccacgacaagctagacgccgatatggagtcaatgatcaaagacgaattgaaggagctaactgcgcaaaaagctgctttggaagaagacatcaaagttttactgttgcctaaggatcctaacgatgataagaacatcatcatggaaattcatggggctgctggtggcgacgaagccagcttatttgcggcagacctctttagcatgtattccaagtatgcagaacgtcagggctggcaaattgaagtggttgacgaaaatgcgactgaagtgggtggctttaaggaaattgttatgatgattactgggaataaagtttattccaagctgaagtacgaaaatggcgcgcaccgggttcaacgggttcccgtaacggaatcagcgggtcgggtgcataccagtacggcaacggtcggggttatgcctgaagaagaagacgtggatattgatattgatcctaaagatattcggacggatgtttaccggtcttccggtgctggtggacaacatattaacaagacgtcatcagccgtacggatgacccacttgccgactgggatcgttgtggccatgcaagacgaacggtcacaacagcaaaaccgggcgaaggccatgcaaattttacgggcccgggtctacgattactacaagcaacaagaagagagtgcttataacgctgaacggaagtcggcagtggggacaggggatcgttctgaacgaatccggacgtataactacccacaaaaccgggtaactgatcatcgaattggactgacactaaataagctggatcggatcatgaatggtgaattagatgatattattgatgccttgattgtgtctgaccaggccgctaagttggaagacttaaagaataatggctaagcaaacggtgttagcgatcttgcaagcggctaagcagcagttgcagatggccggacaagaccctgaactggcccagtatctgatgctggaaggtaatcagtggcgatttacggagttagtgcagcattaccgtgaagcactatcgccaactcagactcaagcgtttcaagcgcaacttgctcgcgtttgtgcgggggagccagcccagtacgtgttgggatacgcgcccttttatggtcgtgagtttcaagtaaccccggccactttgattccccgaccagaaacggaagagttggtagaatgggtgctacaggtggttcggcagcccgccgctaaggtcattgatgtgggcactggcagcggcgcgattgccgtgaccttgaaaaaagaacgccccatgtggctggtgacggcgactgatatttcggatgccgccatcgcagttgcgcaaaagaatgcgcaacgcctcaccgcacaactgatgtgggcgacaggggatctattggcgccagttacgggtcagcgctttgacgtcattgtgtctaatccaccatacattgatcgtactgaaatgccggagatggataccagtgtgaaacgttatgagccggagcaggcgttgtatgctgctgatcatggactagcgttttatcagcgctttgcgcaagtgctgacgacgtatttagtaccaaccggcgacttttttgccgaaattgggtaccatcagggcgcggcagtgaaacagatttttaaacaggcgttaccagatgcacaggtgaccgttaaatcagatattaatgggcatgatcgcatgatccatgtccacttagcatcaaagggataggagagttgagagataagatggaaaccaaaatatttaacactgatcaaattgctgaggcggcggctgccattcaggcaggtcagttagtggcctttccaacggagaccgtctatggcttgggggccgatgcaaccaatgaagcggccgttaaacaggtctacttagccaaaggccggccaagcgacaatccgttgattgtacatgttactggcgaagaaacggtaaaggcatttgcccaaccgttatcagataaggctgaagcgctgatcaaagcattttggccaggtccgttaaccttgatttttgcgctacagccagggaagctgtcttcagcggtaacgggcggactcaatacggctgctttccgtaatccggataacgcggccactttggcactgattaaggcagcgggagtaccattagttggaccgtcagcgaacacttcgggcaagcctagcccaacgttggctaagcacgtataccatgacttgaatggcaaaattgccggtattttggacgatggtccgaccaaggtcggtgttgaatcgacggtattggacatgtcgacggatattcccacgatcttacggccaggtggtgtgacggaggaacagttggctgccgtgattggaaccgttcaatccagtcaccataaagtgggcaaaactgaagttcctaaggcacctggcatgaagtacaaacattatgcccccaatgcgcaggtcaccatcgtggatcatgaagcggattggacggcggcgctacaatgggctagcgaacagtcagggacgattggtgtgatggccgtcgaccggattttacaggcccacaacctaccagataacgtcgaggctttctcacttggtcatgatttaaccagtgcgagtcaccggttatttgctgggctacggcattttgatttggaatcacccgtgacggggatcttggcccaagggttcacggctgagggcttaggcgcggcctacatgaaccggttgaataagtcggccggacaacagcatttcacaaattaaagatttgtaagcacggcggtcccacttgactggaaagtttggtaaaataataccaactacagtctaggagggatcgccgtttgaattttaaagaaaaagatccagcgttatggggcgctattgctgatgaagaacaacgtcaagaggaaaccattgagttgattgcctcagaaaatattgttagtcacgctgtgcgaacagctcaaggctccgtgttgaccaataagtacgccgaagggtatcccgggaagcgctactacggcggcacgcagtatattgacgtggtggaacaactagccattgatcgagcaaaaaaattatttggggcggaatatgccaatgttcaacctcactctggatcacaagccaatcaggctgtctatgcggccttcctcaaacctggagacacgattttagggatggggttggatgccggtggacatttgacccacggggccaaggtgaacttctcgggcaagttgtacaacagctatagctatgccttgaatccggaaactgagttgctggattatgatatgattcgggatcttgcacgaaaagtgaagccacagttgattgtggcaggggcttcggcctattcacggacgattgattggcaagctttccgatccattgccgatgaagtcggggcttatttaatggtggatatggcccatattgctggtttagtggcgactggtcttcatccaagtccagtaggaatcgctgacgtcgtaaccacgacaacacataagacattacggggaccacgtggcggtctgattctctctcaggcggagaatgcgaaaaagatcaattcggctgttttcccgggaactcaggggggacctttagaacatgtgattgcaggaaaggcagcggcattctttgaagatagccaaccggcttttaaggaatacgcgcaacaaattatcaccaatgcccaagccatggctgatgaatttagccagttaccaacagttcgggtcgtttccggtggcacagataatcacttaatgacgttagatttatcccagacggcattaaacggcaaacaagcacaagaattattagatagtgtcttgattaccacgaataaagaagcgattcctaatgaaacactcagtccatttaaaacatcgggtattcgcttaggaacgccagcgattacgactcgtgggttcaacgcagatgaatcacgtgaagtggctcggctgattgttaaaacgctcttaaatcccgaggatgaagcggtcttaaccggtgttcggcaacgggttaaggaactgaccagtgcccatcctttgtcgcaactggattaatttgtgaaaaaaacgttttcattttaaattaatcagtttgatagcgataatacatggtacaattgtaagaaatcataaaggagcgtttattcatggggaagtttcaagtacttgaccacccgttgattcaacacaaactgacgattattcggaacaaagactgcgggacccgcagtttccgtgaagttgtcaatgaaatctcgacgttaatggcttacgaggtctcacgcgacatgccattgcaagataaaacgatcgagacgccagtggctaagatgaccgctaaagaacttgctggtaagaaagtggctattgtcccaattttacgagcaggaattggtatggttgatgggattctcgaattaattccagcggccaaggttggtcatattgggatgtaccgggatgaagaaacgcttcaaccacatgaatacttcgttaaattgccatctgatattggtcaacggcaggtcttcgtggtcgacccaatgctagcaacgggtggatcagcgattatggcgattgatgctctgaagaagcgcggtgccagcaacattaagtttgtgtgtttggtatccgcaccagaaggggttaaagccctccgtgaaaaacatccagatattgacatctatacagccgctttagatgaccatcttaatgaagatggctatattgtgccaggtctcggggatgccggggaccgcttatttggaacgaaataaacgtcaaagagattcgaccaatttagggtcgaatctcttctttgttttgctgaaataaatttcgcttgacaatgttcacaaaatatgaggcaatttgcacacgcaattacaatttgaaaacgttctcgttgttgatatggcgatacttccctttaagtcgattagaatgtttagaccctgaaaaattgttttgttttttgtgtgaattggtggtatcatttccagtgtatttgaatggagcactcgcttcgtttgctattccgcttttcttaatggaaatacctgatttattgaggaaattaccttggggattgcgtccatatagtgttgaaaagaggtgatattcggtgaatgatggtccagtttcgaccttccaatttctgggactgacttttagtactgcgaacgttgtttccggcttggtggttttcttgctggtcgttgcggttatttttttcacttccagaaacttggccatgaagccaaccaaagggcaaaactttttggaatggctgattgattttaccaacggaattttgaagggttccattcctgctaaggaagttggcgggtttggtttgtatggattcacgttgttcttgttcctgttcttgtctaaccaattagggttatttatccaattggctaccagcggcggtgccacaatcgtccgaagtccaacgtctgatccaatcgtgacgttgactttctcattgatgacattgatgctggcccagtttgctggggtccgcaagttagggtacaagacccactttgcgaattacatgaaaccattcgtgttctggctaccaattagtatttttgaagagttcacgaacttcttgacgttgggccttcgtatcttcggggttatcttctctggtgaaatgctattgaagttgatctgggagctggcaatttcacacggcatcgcaacgatggtggtcgctgtaccaatcgaaatgatttggcaaggattctctgctttcttaggggcaatccaagcgttcgttttcgtgacgttgtcatctgtttacatttctcaaaagcttgaagttgaggaataaaggaattatttaattttaaggaggaaacacagattatgggagctattgcagctggtatcgctatggccggagccgctattggtggtggtgtaggtgatggtatcgttatttccaaaatgctagaaggtatggcccgtcagcctgaactatcaggtcaattacggacgaacatgtttatcggggttgggcttgttgaagccatgcctatcatcgccttcgttgtggctttgatggttatgaacaagtagtttaactgacgataatgtttctatctgatagtaaaaggaggtgtcaatagatgctctcacatttagtggttggtcaaggcctgtactatggtgattcgatcttttacgccgtgtgcttcttactattaatgtggattattaaagtcttggcttggaagccagtgactaagatgatgcaggaccgagctgacaaaatcagtaatgatattgactcagctgaaaagtcccgcaatgatgctgctgaattagttcaaaagcgtcaagctgcattagcaagctcacggtcagaagcccaaacgatcgttaacgatgccaaggccaatggccaacagcaacgggaacaaatcgtgacccaagcccaagcagacgtccaaacgttgaagcaaaatgcccaaaaggacatcgaacaagaacggcaagacgctttgtcaaatgctcggaactatgtggcggacttatctattgagattgcttccaagatcattcaacgagaattaaaggctgacgatcaaaaggcattaattgattcttatatcgaagggttggggaagcaacatgagtcttaatagggcaacggtagctaagcgctactcacaagcattatttgatttgttgtccgaaaaagaccaactggagtcaggctacacagagctacaagaacttcggcgtatcttccaggacaacccacagttgagcacgatgctctcagacgctagcctgcaggttgctgatcgcgaagcgttacttcaaccattgttgaagcaagcatcaccgtatatcaagaatctgattcaaatggtctatgattatggtcgcatggaaaatatggtcgatattatcgaccaattccaagtgctgtatgatgaactgcaccacacggtttatgctgaggtgaccacggcggttgaactgtccgcggaacaaaagtctcaaattgaagccgtttacgccaagcgcgttggggcagaaaaggtcgttttaagcagtaaagttgatcctgatgttattggtggggttattgttaaagctgcggacacgattcttgacggtagcttacgaactaaaattaatcgtttacggcagcaactgctcgcataacgaattcggtgataaagaggtgaaactttcatgagcattaaagctgaggaaatcagtgctctaattaaacaacaattagaaagctatcaagatgaaatctcagttgaagaaactggtacggttacttacgttggtgatggtgtcgctcgggcccacggtctgaacaatgccttacaaggtgagttactgttgtttgacaacggggtttatgggatggtccaaaacctcgaagccagtgacgttggtattgttatcttgggtgatttcactggaatcactgaaggcgatacggttaagcggactggccgaatcatggaagttcccgttggcgatcaactgattggccgggttgttaacccattgggtcaagcaattgacggtaaaggggacatttccacggataagacgcgtccaattgaacataaagcaccaggggttatggaccggcaaggggttagtgaacctctacaaaccgggatcaaggccattgatgccttagttccaattggtcgtggtcaacgtgaattgatcattggtgaccggaagactgggaagtcctccattgccattgatacgatcattaaccaaaaagaccaagatatgatttgtatctacgttgcaatcggtcagaaggcttcaacggtgcgggcgcaagtttcaacgctggaaaaattcggcgcgatggactacacgatcgtggttaccgctagtccttccgaaccagcacctatgctgtacatcgcaccatatgccggtgcagcgatgggtgaagagttcatgcacaatggcaagcatgtgttgattgtctatgatgatttaaccaagcaagccgatgcttatcgtgaactttctttgattttgcggcgtgcaccaggtcgtgaagcttaccctggtgatattttctacacccactctcgtttattggaacgggcagctaagttgaacgatgaacttggtggcggttcgatgacggctttgccagtcattgaaaccaaggccggtgacgtttctgcttacattccaaccaacgttatttccatcaccgatggtcaaatcttcctgaacagtgattccttctattcaggtgttcggccagccatggatgccgggacttccgtttctcgggttggcggggacgctcagatcaaggccatgaagaaggttgccgggactttgcggttggacttgtccgcctacaaggaactggaatcattcgcgcaatttggctctgatttggatgccgctacgcaagcacggttagcacgtggggaacggactgtggaagtcttgaagcaaggcttgcatgaatctgttccagttgctaaggaagttattatcttgtttgctttgactcatggtcatttggacaagttggaagttgctgacgttttacgttatcaaaacgaattgtttgattacatggacgctagtcacaaggaccttgaagattcgattacgacaactggaaacttgccagaaggcaacacactggaagacgcaatcaaggaattcgatgggatgttccaaccaactgccaaagcagatgatacggcagcccagacggctgattaagattacttgaaggaaggatggtgagaaataatggctgaatcaattcatgacgttcaacgtcgaattaattccacgaaagcaacccggcagattacgtcggcaatgcacatggtttcgacggcgaagttaaataagattcagaaacaagcagtcggctaccaagactatgtttctaaagttaaggctgtcgtcatgcatctttcgcagtctcatctgttggataattcctcaagtagcctacagtcgaaccgtccggtaaagaaaaccgcttatttggtaatcacctccgatcgtggtatggtgggaagctataatagcagcgttttacgggatacaaatgcgttcattaaagaacgcacacctaatccagacgactacatggtgttagccgttgggggaactggtgcggatttttacaagcaccggggtgttaatgtggcttatgaatatcgtggggtcagtgacgttccagaatttaatgaagttcgggaaattgttaagaccgttaccaccatgttcaacaacgaagttttcgatgaactcttcgtctgctacaaccactttgttaaccggatttcatcccgttttcgggctgaaaaaatgttgccagttgataaggaaacaatgtcaactgatgcggctaaggacacccaagcagcgccattgactgctgaatacgacacggaaccttctgaagaagaagtgttacaagtcgttctgccacagtacgcagaaagcttggtttatggtgcgatcttggacgcaaagactgccgaacatgcatcaagtaccaatgcgatgcagtccgccacggataatgctgatgatttgattgcaacgttgcaactgcactataaccgtgcacgacaagcagcgattacgactgaaatcaccgaaattactggtggtcaggaagccttaaataattaatgacgggaggaattaacgaataatgagtgctggtaaaattgttcaagttatcggacctgttgttgacgttgaattcccgttgaacgatgaattacctgacatcaatactgcccttaacatcaaaaaagatgatggtagtgtccttgtaaccgaagttgccttggaattaggtgacggggttatgcggaccattgccatggacggtaccgatggtcttcgccgaggattggaagtcgaaaacactggtgcttcgatttctgttccagtcggtgacgataccctcggtcgggtgttcaacgtgctcggggatccaattgacggcggtgccgaatttggaccagacgctgaacggatgccaattcaccgtgatgcaccaaagtatgacgaattaaaccctacaactgaaatcctagaaactgggattaaggtgattgacttactcgaaccttacgttcgtggtgggaagattgggttgttcggtggtgccggtgttggtaagaccgttttaattcaagaattaatccataacattgcccaaggccataacgggatttccgtcttcaccggtgttggtgaacggacccgtgaaggtaacgacatgtactgggaaatgaaaggctctggggttctaaagcagacggccatggtttatggtcaaatgaacgaacctcctggtgcccggatgcgagttgccttgactggtttgaccattgcggaatacttccgtgatgtgaagggccaagatgtgttgctctttatcgataacattttccggtttacgcaagccggttctgaagtttctgccctcttgggtcggattccttcagccgttggttaccaaccaacgttggctactgaaatgggtcagttacaggaacggattacgtcaacgaagaaggggtcaattacgtcaattcaggccgtttatgtgcctgctgatgactataccgaccctgctcctgcgacgacgttcgcccatttggatgcaacgaccaacttggaacgtgcgttgacacaacaagggatctacccagccgtggacccattggcatcaacgtcaacggccttggcccctgaaatcatcggtcaagaacactatgacgtggctaccgaagtgcaacgcgtgttgcaacggtatcatgaattgcaagatatcatctcaatccttgggatggatgaattatctgatgaagaacaaacgattgttcaacgggcgcggcggattcaattcttcttgtcacaaccattctctgtggcttcacagtttacgggtatggacgggaagtacgttaagcttgaagatacaatccggagttttaagggtatcttagatggtaagtacgatgacttaccagaagatgctttccggaactgcggtgctattgaagacgctgtagaaaaggctaagcaaatgaatgacgccgttgccaacaactagggagggattctaattggctgataatcaatcagtgttatctgttagtatcgttactcctgatggtcaagtctacaatgaacaaggcgatctgttaattgtgaccactaaaagtgggcaattagggattatgcctaatcacgttcccgtgattgcttcactcgaagtggaagaagcacggattaagcgtggggaaaatgaagatgaaattgccgttaatggtggtttcttggaattttctggcaatgtagcgaccattgttgcggatagtgcagaacgtcaagacgatattgacgttaaccgtgctgagaatgcacgggaacgggctgaagcaacgattaagaaggcacaagaggcacatgatgccgatacgcttgcccgggctgaagtggccttacggcgtgcggttaaccggattaacgttgccaagcattaaaaacgttctttgtttttaaccagcaattaacgaaaggatctcccacaatgggaggtcctttttacttataatgacaaagtgattggatagttaaattgattgaatataataattgtaatattacaaacgccgtttttaccgcattctcaaggacaagggaaaagaattatgctatagttagtgagaatgtttaggaaggattgagaaaatgagactcgttggactacaggggattctaaccatcattagtcatttgttctttattgccctcgcattttgggcgatttcagcgttacatattgaacgactgatgaccttttatccacgacaatcacgagtgttgattgtgatgttagcggttgctgttgggtttggctgtagctcattctttttggacttcattaataacgttcgtaacctgggctacctgttacggtagactcataaaatttttggaggtatcccatggaaaaaattatcgttcatggtgggaaccgcttatctggtgtggttcatatcgaaggggccaaaaatgccgtgttgccaattttagcagcaagtattttggctcaggatgggatcacccatttagcaaatgttccggttttgtctgatgtctatacgatgaataaggtcttacgcttcttgaatttaaaggttgactttgatgaagccaaacgagaagtgacgattgacgcaacgaagcaggtctcaagtgaagctccctttgagtacgtctcaaagatgcgggcctcaatcgttgtgatgggaccgttgttagcgcgcttgggtcatgctcgtgtggccttgcccggtggttgtgccattggaacacgaccaattgacttgcatttgaagggtctagaggcgctgggagcgcggattgaacagcatgatggctatatcgaagcctttgctgatcgtttgcaaggtgcacatatttatcttgattttccaagtgttggggctacgcaaaacattctgatggctgcttgtttggccaagggcacaacggtgattgataacgttgctcgcgaaccagaaattgttgatttggctaacatcttaaataagatgggggctaacgtacgtggtgctggcaccgaaaccattcgggttgatggtgttgatcagatgcatggtgcggaacatagtgtggttcaagatcgtattgaagcgggaaccttcatggttggcgctgcgttgacgcacggtaacgtcttgattcaggatggcattgtggaacacaacaagccactgatttctaagctccaagagatgggcgttcaagtgacggaagaagctgctggtatccgggttattggaccagatcgcttacaaccaacggatgtgaagacgctgccatatccgggctttccaaccgatatgcaaccgcagatgaccatcttacaattagccgctgaaggaaccagtacgatgaccgaaacggtgtttgaaaaccggttcatgcatcttgaggaacttcgacggatgaatgcccagtatcaagtaaatggtcggacggttgtgatgcacggaccaactgattttaatggtgctgaagttgccgcaactgatttacgggctgctgctgcattggttttagcggggctggttgctgacggttacacgcaagtgacgaatttaaaatacttagatcgaggctactatgacttccataagaagttggccgcgttaggagcagaagtgaaacgggtatctgcacctgacaacgatgccgtcgttttaaagaattcgcacatcaataattagcaaagctgaggtggcatgtactggccacctttttatttggtctagcgacgagctatttagagttgtggcagtttatggtataatgaaatgttgaaaattggcattaaaactcaggaggacacataagtatggcgaaagacattggcattgacctaggaacggcgaacgtattaatctacgtggtcggtaagggaatcgtattaaatgaaccatcagtcgtcgcaattgacacgaagactgataaggtattagcggtgggctctgaagcgtaccggatggttggtcggactcccggcaatattcgggcaattcgtcccttaaaggacggcgttatctccgatttcgatatcactgaagccatgctctcctatttcatcacgaaattaagcgtaaagggcttcttatctaagcctaatattatgatctgtgcaccaacgaacattactgaaatcgaacgaaaggccatcgttcaggctgctgaaaagtctggcggggccaaggtttatctggaagcagaacctaaggttgccgctttaggtgctgggatggatatcttcaagcctagtggtaacatggttatcgatatgggtggtggaaccagtgatattgctatcttatcgttaggtgatatcgtggccagtcggtcgattcgtgtggctggtgaccggatgaacacagaaattgttaattacttgaagcacaaacataacttaattattggggaacgaactgctgaaacggttaagattaagatcgggacggcttatccagaacctggtaacgaagaaaagacgatggaagttcggggtcgggattctgttagcggtatgccaaccacgactaccattaacgcggccgaagttgaagtggcgattcatgactctgtcgaacagattgtggcagcagcaatggctgttttggaaacgacgccgccagaattagcggctgacattattgaccggggaatcatgctgaccggtggtggtgccttgttagatggcattgataagctcttctctgaacggttgacggttccagtgatcatttctgaagatccattggataatgttgccaaaggtgccggtgtgttattggaacacatggataccaaaaatacccaagaaaataacgcctaagcataagtaaaaagggggggctggtcgtgcgacacatcctgatttggttcgttcgggggtatcagcggtttatttcgccgttgttcccgccaacttgtcggtattacccgacctgttcaacttacatggtccaggctttatcaaagcatggcgcgttgaaggggagcttaatgggattggcgcgtatcttacggtgccagccattcgttcgcggtgggattgatcccgtgccggatcactttaccctgaaacgaaatacggccgctgaggcagcgtatcggcaagcgatgcaactagatgaaattgagcgacacccccataaataaaggagagttggcatgagtaaacgagaaaaatccgtgcaagtaactattgatgaactaaaactcccagatggtcaaaaagcgtctattttaaaaattgggtctgatacaattggaacggtaacgccagttgaggatcgatttgaagcgcagttaaatgatggcgacgtttaccgggtgaaatctgtcgatgagggtgtagaactcttattgcgggattaccacctccatcgtggttaataaattttagtaaagttggccgaagcgaaacgtcgaatttcacttcggcctttataatgaagacaaatcttagttgagttaaggagcaattcattgtggcaaagaatgcaaccgaacaacgaagcgatgcagaatcacgaattgactggggcattatcttttgtgtcttaatgttagcattgattggtttggcttcgatttacgtggcggcaaaacacgatacaagtggaacgagtatcacgtcggccgtcgtttcgcagttggcgtggtatgtgattggtaccgtggcgattatcattattatgcaatttgattcagaacagttgtggaaggtagcgccggttttgtatgggcttggtattttcctgttactggcggtgttggtcttttatagccgagcgtattttgttaataccggggcgaagagctggtttgcaattggctcattgacttttcagccatcagaagtgatgaagccagcctttattttgatgctggcacgggtggtgacggaacacaataatgctaacccggtacacacggttcgctcggactggacgttgattggtaagctaattttgtggacgattccggtcgccgtgttattgaaattacaaaatgacttcgggaccatgttggtgttctttgccattgtgggtggggttattttggtttccgggatcacttggaaaatcattgcgccagcgtttgggcttatcgccgtcgttggtgggtcagcattagccttggtgacgacttccggtgggcaaaaactcctacagaccgttgggtttaaagcctatcaattttcccgggtaaatacgtggttgcatccatcacaggatacgaccgatagtggttaccaactgtggcaaagcatgaaagcagttgggtccggtggaattttcgggactggttttaatgtgtcgcatgtgtatgtaccagttcgagaatcggatatgattttctctgtcattggagagaactttggctttattggcggctgtgttttgatcttcctgtatttcttgttgatttaccaaatgatccgagtaacgtttgataccaagaatgtcttttatgcgtatatttcaactggggttatcatgatgattttattccacgtttttgaaaacatcgggatgagtatcgggctgttgccattgaccgggattccattgccatttgtcagtcaagggggatctgctttgatcgggaacttgattgggattggcttaatcatgtcaatgcggtatcattataagagttacatgtttagtcgaaatgagtcgttcaagtaaaggagatttttacatgagtggaatggtaaagtatttctggaccgaagcagttgacgatggtacacggattggcttaacaacagaaggccaagacgaattgggttcgattaagttcgctaagttgccaaccgtaggcgacaccgttaagcagggcgaaaacctgttgagtgtagaagccgacaaagcggtttcagatattcctagtccagtttctggacgggtaacagcagttaatccggccttagcgactgattttgacgctttgaatgggcaagacactgcggcagcatggtttgttgatgttcaagaagattaatagttaaggctcggattgcggctagttgtaatccgggcttttttagtggtcttgccgttatctagtggttttgggtggagtcgggtataatagagatattaataagaaacggggtgagtcacatgacggaaaaaccagttttccatatcaatggttatttaggactaattctggtattagtgattctaggattgggtgtttacttatcggtcgtgggatggggagtcttaggggttattttggtggtattggctgttttggcagctagtagcttaacgattattggacctaatcaatcgaaagttctcactttcttcggccgttacattggaacaattaaagaatcgggactgtatttaacggtgccactaacgacgaagaccacggtatcattacgggttcggaactttaatagtgccattttaaaggtgaatgatttacaaggaaatccagttgaaatcgctgcggtgatcgtgtttaaggttgtcgacacaagcaaggccttgtttgctgttgaggattacgaaaagtttgtggaaattcagagtgaatcagccattcgccacgtggcatcagagtacgcctacgataacttcggtgatcatcaggcactaacgctgcggagtaatccgacggaggtgtcgaatcacctgactgaggagttacaggctcggttggaggttgccggggttcagattattgagacccggttaacccatttggcctacgcgacggagattgcctcagcgatgctccagcggcaacagtcccaagccattctttcggcgcgtaagattattgttgaaggtgctgtatcgatcacggaaggggctattgagcagctggctgcggaaacggatttgcacttaacggataatcaaaagctgcagttaattaataatatgatggtctcaatcattaatgagcgaggttcacagccagtcattaatacaggtaaggtagaatagtggcacaatgaagatgttggaggtttttggatggacgaacagttagagcagctaatgcgccaattaagcggcctaaatgagcaagtaagaaatggggccgtgtaccagtcattaggaacgcgattggggaaactcatggatggtattcagcgacggcggcgaacggctgtggtgttaccagatgaccaggatggcgtgaaggatgttttagcagaacttcgccatcaattagaacaaaatgttccggtgacgctgactcacgaaaagttaacgttactaaccgcccatctatcttcaacggatatggccttgcgttatcaaggcattaactttaccttgtatgatgctttgcaacaggatgcattagactctgctcagatggcatttttgcttgatgaattgagtcggccagatgctctgtttagccatatcttagaaccagctaacacggctgtttttggtcgttctgctcgagtagccatgttagcagtcattctccattttgtgaccccggatgtgcagtcgcatacacctgatctgcgtcggatagttattttagcggcgatgtatctttgtttagaaacggacacgcgggggtttgttaaccagcacggctgggcccatgcttttacggccattaccgatttattaaccgttttggccggtactgaggcgcttccccgagctgataagttgttcttgatgatgaccttattagagcgggttaagcggctcaatacccctttgatttacggcgagaatgatcgaatggcgatgtatttgtccgaactggcaaatcgccatcagttatatgcagataccctcctattgtccctaaaacagtggcgacagcaagtggcgttacatcggcgtccggatacgattgctgggtggaatcgcttctttaatcgcaaacggttactggattcgctacggctacaatcggagttaccggcgtccttacaaaaatatttgaactcaactatcgattttttaggttaatttgattttcaaagaaatttagaaatggtatactaaaggctaaccgaaatatatacgataggatgagtggcaaaatggaaacgaaaacaaagttacacgtaggtctattattcggtggtaattcctcagagcatgatgtgtcgaagcgttcggcgcacaatatttacgatgcgatggacaaggatcgttacaacgttagtttattcttattaacgcgtgatggatttgtgcttagtgatgcggcttctcggcgagtatttgacggcgaagatgaagcaacagttgcggcagaggaacaagccaaagtagacgcttctaacccattggcacccatttggaatttatctcaggcaaaggacattgatgttttcttcccaattattcatggtaatttgggcgaagacggcaccatccaagggcttttccggttactgaaaaagcctttcgtggggagtggcgtcttagcatcagcggtgtcctttgataaggatatgacgaaacaggtcttaacggctcatggcattcggaataccaagtatgtcgtcttaacacccgataatcgggcagacttcgactacgcgacgattcagtcgcggcttggagataatgtcttcattaagcctgctaatcaaggatcatctgtgggaattcacaaggcaagtaatgtccaggagtatctggacggcgttgctgatgccttccggtacgactataaagtcctagtggaacaaaccattgatggtccgcaagaagttgagatttccattttggggaatgaacaaccgcaagcatccaagttaggagccattcgggtaccagaatctgatgtcttctacgactataacaacaagtttgttgatgctagtggtgtgacgtttgaagtgcccgtcaagctttcggatgagttgacccaagaaattacgcaaatgggtctacaaacgtatgcggcattaggactcaaaggaatggcccgaattgattacttggtttccaaggatggggtaccgtatgttggtgaagttaacaccttaccagggtttaccaacatcagtttgtatccacaattgtggcaagcaactggcattaactatgctgatttaattgatcgcttgattgagttagcgttgtcagagttccactatcaggatgaactggcttacgatttcattccgttggatgatcattcggcagcttcaacttacaaacctaaagcttaggttgttttaatggtcggttgtgaacggagacgttccaaccgactttttttgtggacaggagacgatctgatgaagatggagaaacagttggtaacagggtgggctggtgtcgttgtcctattaactagtttgcgattggtgggaactaatccgactacgtatgggtggtttggtggactcgctgtacttactgtggtgttagtcgcgtggcaaatcacacgcgtcttggcgagctggcgaggggataatttaacggtcaaagccacatggtggctggtgtggcggcattggtggcggtggggcttggcaatggcttggctgacactattaaccttaccctttggcctctgggggcttagtagccggttattggtccggttgcgattgccagtaacactgattaattttgtgggactccaccggcacgttcttggcggaattgccatcatgggttatctggtgttggctatcgctggcgggtactatttaccccgatttctccgccggattgcaccgtacccattacccccgtgccagaaagggtggtggcgctcaggatggtgggggattggtggcggattcttaggcctgttcactgcggaattgttggttggtgttgcctggtggagtggttctcgattaccggagtcattcggtcggccaatgacagtgggcttggcatttttgatttggaccgttttatcaacagttggcgtttggttattcattggcgtattacgcctagcaggtgggcaaccagccgcttttgggtcaccatggcggctgcctgattggcgcttgctcatcctgctgatactgacaggtggactaaatgcctggcaggcggttaatcagcaaccgcagtttatggcgacagcaattattagtcatcggggagtagacgcgggccatggtgttcagaacacgctgggggctctgcgacatgttagcaaacaacgaccagcctatgttgaaatggacctgcatgagaccaaagaccgtcactgggtcgtcttacatgatgaaaacctacagcaattaacgcaacgctcagtgacgccacatgacttaacgctaaagcaactacagcggctagtcgttcgcgagaacggttatcgggatcacttagttggctgggaaacgtacttaagagcggcagaagccaaacaccagcgactcttagtagagatgaaaacaacgccacaagatacgccccatatgattcaacggtttgccagtcaatatggtcagcgactgatccacgaccatgatgccgttcactcgctagactatcgggtagtcacacggttgaagcaaaaagttccgcggttgccagtcggttatattacaccatttaattgggtatcgccgcgttcggtgccagccgacttttattcatttcaacgaatctcattgagccaagaatttattttggcggcagctcagcaacgtatcaacacttatgtttggacgccggatacgtcagtggcaatggcgcggatgtgggctctagggactaatggtcagattaccaatgaggcctcgcggttacgttgggttgtccatcagccagttgcgacacagcgttgggcagtattgcagaattttgttttgagttacatttaattgctcatgaagatattgatccaggaataagcgaatactgagaacaattaaatggctaatgttcgataaaatattaatgaatttatatttgaatgaaagaatggactagacagattagagttccctcatgataacgtattttgcttgaaattcctgataaatcacttatgattgatattaatggtgaagccagtcgacgatattatttattttcaggggacatcagtggttgttagaacgtgaaaaggactaacgacctgattgtaatcaatgttcggcttttattataaattagcagcgcgatcataattcgtgagggagagagcagatgcgacttttagggagtaaggtcaaacaatatcggaaacagaaaaatttgtcgcagcaagaattagccgatggaatttgtacacaagcaacggttagtttgatggaaaaaaaggataagattcccagtattaagattattttacaggtgtgtcgccgattaaatgtctcactcggagatatcttagccggtgtgggaagtggcttggatgagcagtttgatgccatttgtttagatctacggcaggataagtatactgagatggcagcacgattggaccaagtggatgtttcaacggaggcggctagtgcttttgaccgtgagcgctatcattattatcggggatttgctgagctaacggttgaacagcgaccagatgaagcgatttttcacttcaatttggtgttgcggcggtcatttcatatggcttgggacctttatgcgattattggtaatgtggggatggcatcggcctacttaatgcgacaagatcgagatcaggcgcgatactatttaggtgaggcaaccagctatttgacgaattttgaatggcatgatgagagtagctttcagcgtctggtctgggcacgttatcagattgcgttgatgtacctaaagctggaacagccacaacaggcgcttaccaatgttgaagcggcgttacgggtcgttaaacaccgggcttcattatatttgattgatgtgttgtatgaggttaagggcttaggcgaacaggcactattggcgagaacggcagctaaacgtagcttgatgattgctaaaaccctagccttggtgacccacaatcaagcattgcaggaacggttaaatgttactactgatgacctaccggcttggagcgatcaagtgaacgggtttagttaaaggactgacgcggattagcgtaaataaaaatggacgagaagccaatttggtttctcgtccatttttaaatagttaaagcattagttagcaaatttattctgcggggtgcgctgctttggctggttgattatctaagtccgtccgtacgacgatcacatcacaaactgctgtccgtgtgacgtattccgttacagacccgattaatagccgttcaactgcgtttaacccggtagcaccaatcataatcaaatcggtgtcattatcccgaggaacatctctggcaatgatggtcttcggtgccccgtattcaatggcgtaatcaatcttgtcaagaccatctgccttggcatcagccacgtacttgtcgagggtcttcttggccgtttctgtgacttgttcaaccatgctggtatcaaagctagaaatgttttggaaagcccgtgtatcaacaacgtgaacgagatgtaaatcagcatcgttacgtttagccacagcgaccgctttcttgaaagctaattcggcttcataggaaccatcgactgggactaaaatgtgcttgtattgttgtaacataatattcacctctcattactttatactcttatcatacgttatttatctgcaaataaaaagcgatatggtaaaaaagctgcgagaaagtgtaaccgattacgccttagggaaccagtgtaatagaatcaattgaatactgataatcgcaataacgccgactaacaacatggttgaaatgaagaccatgttgttcatgatggtggcgactgccgacagcacaccaatcagtagcataacaacaccactgatcgtcaagacacgacttaattcgtgactactttcgggatgaaagactaagaaagcacgacgtcgatgagcataaaagtaccaaccaattcctaaagccagcagggtatagcaagccattaaaatggtgatgaccatgaagaaacctccttagtaaataataatgaataaatgatacggtacggtctattataccgaactcaccagtgaaaggaaatatgtggtaactggtcatttaagcaaaagaaaaagaccattcaatggaatggccttcaaagcaaagctttggcgatctaagtggtgccgttaattgtccagtcatgttgacccgcgatgacaatgcaggggggaaagctagccgaggcgcctgacttccaagtgaaaaggcatgtcatcttcctcagcatcttgcgatccctaaaatgaattacttgttcggcaacttgtagtgagacaacgcgtacaccttagaactacttgtatggtagcatataaatattaaaaattcaatttttcagtgtcggttagctgtgagaagtcgccggtattgttgcgctagttgagtttcaaagcgtccgttggttttagggtggtaatactcggcattttttagtgtgtcgggcaaatactgttgttttacccagtcattgggaaagttatgtggatacttataatcggtcccatgaccaagtttcttggcgccagcgtagtgagcatcctttaaatgatcgggcacagcaccgttgtgaccatttaatacgtcagctaaggcggcgtcaatggcgctaatccctgaatcagattttggcgatagacagagttcaataacggcatcagctaaaggaatacgtccttcgggtaagcccaattgctgggctgcttgcacggcttggacggtgcgggcagctgccgggagattggccatgccaatatcttcataggcaatcaccatcaagcgccggcaaatggctgggagatcgccagcagcaacaagttgggcgagatagtgtagcgcggcatcggtatcactgccgcggatggatttttgaaatgcggagatgacatcgtagtgagcatcgccatccttatcacccatgagcgcttttcgttgaaaacaagcttcagcaacggctaaagtgatatgaatgcggtcgtcattggccgctggagttgattgggcagctaattccaaaccgttcagcgcactacggagatcgccattggtggcaccggcgataaagttcaaggcctcagtgtttaagtcgatgggcagcttccccagaccattttcggtatccgtgagtgcgcgatgcaaagcgattttaatgtcatctggtgttagcggatgaacttcaaaaatctgagttcggctgcgaatggcaggattgatattgatataggggttctccgtagttgccccgattagaacgatgcgaccactttctaaatggggcaacagaaaatcttgtttagttttgtctaaacgatggatttcatccaataaaagaataaccgtcccactcattttggcttcctcggccacaatctggagatccttttttgaatcagtcgccgcatttagcttccgaaaggcgtattgtgtggacccggcaatagcgctggcgatactcgttttaccagtgccaggcggaccgtataaaatcattgatgaaagtaatttagctgccaccatgcgggcaatgatttttccaggggccacgaggtcttgttgaccgacgatgtcctccagacgttgcgggcgcatgcggtaagctaaaggttgttgtgccacgacggggactcctttcttaacgaccaagcaacttatcgaaccagctggtcttagttggtgatgaggttgtctcagctgatgatgctggatatttgtcacgtagtgtaatgggggactgattaatggcttgatcactagcaacaactaaccccaggtcactgtcgttaatgccgtagatggcttcttctcgaatggtgaatttgagattgtgctggccaactaacttcaagtaaggggccaaatcagcttggtcaatatggccgttaaaaatgacttgatagttaggatgatctgtaatttctgtaacaaagtcgctaatattatcacgattagtgacctcagcaatcgtcatggcaagagaaacacgttcacgaaaagtcccgagatatttgcgctgctcatcgggattgatttttggtgtgccatacatagcggtttgcaggtgttgttccatcggtgttttttcagacatgagtttcccttcttttcaagttagttctcctagtataacatggaactgaacgaacgtttagaaaggggatttggatatgtatcaagaccaagattttcaagtatttgaggatcaaacattggctggacgactcggaaaaatccagaaacaaattgatccgaaatttttgattaccgctggtgatttagagccggtgttagcggaattatctgtgcccatttatcagcacgtctcccaacatcgacggcgaacgaagaatccaccaactgatacgtggattgcctttagcacatccaaacgagggtacaaaatgttaccgcaccttgagattggtttttgggatgatcgcttctttatctggttggcggttttacaagaagccaaaaatcgccaaggattattggggcaagtccaattggctgatgtgttaaatctgccgagtacattcgaatgtggaaatgaccatgccgataaaaattgtggtcggccgctaacgttgaccaattatcaagcactgatgcgtgagcaggttaaccgacacgcggagtggcaacttggccgtaactttatgcgtggcagtgatctttttacgacaacgccagatgatcaggcggctatcattcgtgatacagtggcagcgttattaccgatataccgacaattgattgctgattaaattaaaaaaccacccggtctctttattgaccgggtggtttgtgactaatagttgttaaacaagctggcaatcattgaaccaatgaacacccaatataaaacaaaaatagcaattgcaataataaagttgaaaagaccggcacggttccaagtagcttggacagctttgaatgtttcaacgtcttgatagtcgcctttttgccaagcccattcattccccttaaagccaacaatgaaaatccatacaatattgaagattgggataatagtgagtagtggtagataggttttgttaccaataccccaaaatacattgtacataaaggctccccagttccagcccttgatttcttgtggagtgactttaccattttcttgcatgcgaactcctcctcgtttctgatcagctttttcagacatcagtacttggtcagataatccaggctagtttaaataatccactatcacagctaaacgtgtagcagcagataaataaaatagggggattactttaataggttagcataagaccagtaaatcgtgcaatgtcattcgtccaaaaacgttaaagagtggatgaaatacactgatgatcatgaaaaaaaacacccgccaaatgacgggtgtttttccaccagttaagattaatcttaacggttgtagtattcaacgattaatgaatcatcgagttctgcatcgagttcttcacgttgagggaagcgggtaagggaacctgccaacttgtcagcgtcgaattcaacgtattgtggacgaccaacaacggcttcaacagcgcccttgatgattgccatgtccttggacttttcacgaacagagatgacttggccaatcttcacttcgtatgaaggaatatcaacccgttggccatcaacggtgatgtgaccatggttaaccaattgacgagcttgacgacgagtcgttgccaaacctaaacggtaaaccatgttgtccagacgacgttcgagtaagatcatgaagttagtaccatgggtaccttccttgatcttgccggcacgtttgaacaagttgtagaattgacgttcagtcatgccgtaagtgaaccggagcttttgcttttcacgcaattgcgtaccgtattcagataacttttgacgacgaccttgaccatgatcaccaggtgcataaggacgacggtttaattctttaccagtgccggaaagggatacccctaaacgacgggaaatacgccagcttgggccagtgtaacgagacatagatagttcctccaataaataagttatttggagtaaaataagctgtttataagtttagtattcgtgcaggttgctttgcaagtttcaccgtatgcagccgcaggttacttcttgaaccaatgtaacggcaacaatctgttgacgagcttaccacttatcgctgcattattttacacaacgaccagtataaccggaaacgctaggctttgtcaatgtgtgacagcaaaacccgagcaaattcttctaagacctgttggtcagcggccgtaaaccggtctttagttggtgagtcaatgtctaagacgccaaatttcgtttcaccaatggttaacggaactacaatttcggcattgctagccgagtcacaagcgatgtgcccaggaaattgatgaacgtccgcgatccgctgtgtggtttgcgtggctaatgctgtgccgcagacaccgtggttattttcaatatgcacacaggcgacattaccttggaacggtcccagaattaaatcatccgtttcgggctgatagaggtaaaagccagcccaattgatgtctgataaggtttgattaagcaacgctgcggcattagataagttggccaccaggtttgtttctccatataatagggcatccaactgtttggtgatgattggatttagggattcactcattgtaaaggcctccaaagtttaatgtttgaatcattcaattacacataaaaacggatagagaatcgtgaaaacctagtgaagcctaggcgtgagttatgctataatcgaggttagattaaattgtaaattgaaccgggcgattttgcaactcggataaatgatgaaaagcgatgaaggatggggtcaattatgataggtgtgctaattggaatcgtgatactagcgattgtcatttacgttggcgtgctgatataccagcaacgtatccgacgacaagtggtagcgctaacgacaaaaaaagaatccatggtagccatcccgttaaaagacgagttggcattagttggacaattaagtctaaccggacagtccttagaacggtatcaaagtttacagaccgactatgcggacattaccacgaatcggtttccccgaattgatgaacagctcaatcaattgctcacggatgcccgtggggtaaatgtgctacaactaaagaaaaaccttgataaggtgaccttactcgttaaccagacagacgaactggttcaatccgtccaagaaaagttggctagtttgcaagaagttgataagcagcaccgagaggccgttcagcaattagagcataagtatcaagatttacgaaagactttgctggccaagaattttgcatttggccctagtattgatggtttagaggaacgcttgggtcagttagaaggaaactttgacacgtttacccagttgacccaagaaggcgatcatgaacgagcggctgatgttctgagccaattgcaagatgatacgaaacaattagatgacctaattgacacgattccaccgttgtataaagacctaactgtggtgttccccgatcaattgaaggagttaaaggccggttatcagcaattgagcgctgaacactttcacttcggcgatcaagacattttggcgcaagtcacagcaattgagcagcacatccaagagaacttggcaacgcttagtgaccttcgaccggcagatgcgcaggtggttaacgaacgaattgccaaacaaattgaccagatttatgatctgatgcaaacagaaattgacgctaaacaacccgttgaaaaaaacttagatgggattgctaagttcattgcacatgcccagaatcaaagtcatatgctattaaatgaactggatcgtctggggcaaaactacacgttagatcatcatgaattagaaacggctcgcgagcttaatgagcagttacgacacattgatggtatttatcaacaagatgtgcaaacgctaaccggaaaaacggcaacgtactctcagattttagcgcatcaacagcaacaagaaaaagacttggaacaaattgagaaacagcaagccgatattttgaagagtgtggcgggactcgctgatgaagaacgtcaggctcgtgacaccttgcaacaatttgattttgatctacatagcttaagacgtcaggtggaaaatttgaacttgccgggcattccgcaatcttacttggattatttcttcgtggttcgcgatgaggtggcacaattagcaacggatatggaccagccccaaattgacatggaacgcattacgaaacagctattgatcattcaaactgatttagacaccttacgtgagaagactgaagacttagtggacagttcccaactggcagaacaactgttgcagtatgccaaccgctatcaaacaagtcatgccaatgtggccgaagctagtcaaaaggcttcggatttgtttgaacatcagtaccagtacgcgcaagccctagaaacaattgcgaccgttttagatgaagttgagcctgggtcatacaagcggttagaagatgcttattatcagcgtaaaggaacggataaaccgcaccgtacaactaaagattaatggaaacgtgaaccgctcgttagagggttcgcgcttttttgtgtcgttaacattatgtgactcccccttgtggttcacgacgtttgtgtttataatgagaaagaatttctatcggagtcgaaccaatagaaaagagataagagggttcagcatgatttattttgataatagtgccacaactaaggcagcaccggcggttgtggatacttatgcgaaagtcagtgaacgatattggggtaacccatctagtttgcataactttggcgaacaggcatttaatctattggaacagtcgcgccaacagattgccgatttactaggtgtttcactcagtgagattctcttcacgagtgggggaaccgaaggcgataactgggccatcaaaggaacggcgattgcaaaacgtgaatttggtaatcacttgattacaaccgaagtcgagcaccccgccgtacacaattccatggagcagttgaaacaactaggctttgaggtgacttatttgcccgttgatgagaacggccgagtttcggcaagcgatttgcgatcggctattcggccaaccacgattttagtgtcaacgatggccgtcaacaacgaaatcggtgccgtacaacccttggctgaaattgcggatgtgatgcgggactttcctaaaattcactggcatattgatgccgttcaagggattggtaaaggactacacgatctgatctttaatgatcgggttgactttatcacgttctcgggacataaattccatgcgccacgtggcattggttttatgtataagcgccaaggtcggacgattgccccgttgatgacaggtggtggtcaggaacgggatctacgttccggaactgaaaacttacccgcaattgctgcaatggctaaagcattacggctgttgttagacgatgaagctgcaaaagtccagcgacaacaagaggtgcggttaacaattcttaaccacatcaagacattttcacatgtcacgattttttctaaagatttaccggtatttgcaccacacattctgtgttttgcgattgaaagtgttcggggcgaaactatcgtccatgcctttgaagaacacgggatttatatctcaaccacgagtgcctgctcctctaaaaaacacgttgaatccagtacattacaagccatgaagattgatgatggcattgcaaccagtgcggttcgcgtatcgttggatgaacataacacgttggctgaagctgaacaatttaaccaagtatttgacgaactctatcgtgggtttgccaagttacgctaaacgacgaaaggggtcgcgcaatggaatacagcgagattatggtgcggtatggcgagttgtcgacaaagggaaagaacaagaaagacttcatcaaacaactcggccaaaatacccgcaaagccttgcatcagtttgacgggattgaagtcaaagcgcagcatgaccgattacatgtgaccttaaatggtgctgattcaacagcagtgatggatcggttaaagggcgtcttcggtatcgagaacttttcaccttccgtgaaagttgagaaagatatcgcggctattaaagccacggctttagcgatggtgcaggaaatctttacaccggggatgactttcaagattaatacccggcggcaagataaacaatttgaatatgatacgaaccatttgaatgacctattgggcggttatattttggagaatgtccccggcattcaggttaagatgaagcaaccagacttaactttacgggtcgaagtccgtcttaatggggtcttcttgtccggccagacgattcaaggtgctggtggattaccagttgggactggcggcaaggcagtcatgatgctatctgggggaattgattcaccagtagcggcctattatggcatgcgccgtggtgttaagttggatatggttcatttcttcagtccgccatatacatctgaacaggcactcgccaaggccaaagaattaacggctcggctagcgggttactctgggagcatccagtttattcaagtgccgttcacgaagattcaagagacgattaaagaaaaggtgccagaaggctatctgatgacgattcaacggcggttaatgttgcgactagctgcggcagtggctgaacgtcggcatgctaaaggaatctttaatggggagtctctgggacaggtggcctcacaaacgttggaaagtatggcagctattaatgatgtcacatcgatgccaatcctgcggccgctattgtcgatggacaagacggagattatcaaagttgccgaaaacatcgacacttatgatctatcgatcttgccatacgaagattgctgtacgatctttacaccaccagcaccgaaaacccatccagatttagagaaatctcgtaaatatgaaaaatatattgacgtggatggtctgatgcaagaagcgttagacgggatgattatcacggatatccatccggacgataactatttgaatcaaaatgaagatgtttttgcagagttactttaatctgaaaggaagttgaccaatggttgacttcctttttttgtttttcccatcaaaacgcttgtttttcacccgttaaatgcgcgataattagggcaacgatcggtgaatgaccgattaattaatgtgaaggggttgatctgcgtggaagtttcagtgcgcggcgacaagatgtctctgtctggcgacctgccagaagtggggacacaattaccaaagtttaaattgtttgatcaaaacgataccaaggtgaagacggctaatttaatcggcaaagtagccttaattagtgtggtacctgacttggaaacgcctgtttgcaccatgcagacgcggaaatttattcaacaagcggatcattacccagcagcgaagttctacaccgtttctaacaacaccattgcccaacagacggggtggtgtgcagcagaaggtgttgaaaacattgatatgttgtcggatactgaattatcctttggttatgaaatggggttatacatccccaatgccggaaacttagcacgttcaatttggattattgatgataccggtaagattgtttaccgtcaggtcgtcgatgagcaaacggatgaacctaattatttagccgcaattgaagcactggaaaaactggttccacgagttgacgtttaggtcaatcttgagtacactaagtaaaactagcgttgaacaagtcagtagcgtgatgaccaaccaatagagagctgggaatgctggaaaccggtggtggtgatgacgtgaacgtagcttgcgagctgaaaggctgaactaatagtaggccttttccggagcactctccgttaacaaagaagttaagtggggcataaatgcccaatttaggtggtaccgcgaagactcttcgtcctaattgataggatggggagtttttttgtgccagcacacagcgcttctacatttagaaaggacttgatttttatggcagacaaacaaattgatatgccaaccaagtatgatccaaccgccgttgaagcgggacgataccaaacttggctagacgaagatgtctttaaacctagtggcgaccaaaaggccaaaccttattcgattgtgattccgccgccaaatgtgactggtaagctacatttaggccatgcttgggatacgacattgcaagatatgttaattcgtcagaaacggatgcaaggttacgatacgctgtggttacccggaatggaccacgcggggattgcgactcaagcaaaagtggaagccaagttacgtgaacaaggtatttctcgttatgacctcggtcgggagaaattcgttgaaaaggtttgggaatggaaagacgaatacgccgacaccattcacaagcagtgggctaagatggggctgtcactggattattctcgtgaacgctttacgttagatgatggtttatcagatgccgttaagaaggtctttgtcaccttgtacaagaagggccttatttaccgtggtgaatacatcattaactgggatccccaagcgcggacagctttgtctgatattgaagtgattcataaggacgataaaggtgcgttttatcacgttaaatacccatttgctaacccagatgatacgtttaacggtcagcattacattgaaattgccacgacccgtccagaaacaatgatgggtgatacggcggttgcggtgaacccgggtgatgaacgttacaaagaattggttggtaaaaaggtgatcttgccgttagctgaccgagaaattccaattattgccgatcaatacgttgatcctgagtttgggacagggatggtaaagattacgccagcacacgatcccaatgacttcttagttggtaatcggcataatttggaacggatcaataccatgaatgacgacgcctccatgaatgagaaggcgggcaagtatgcgggcatggatcggttcgatgcccgtaaagcgatggtcgctgatcttgatgaacaggggttattgctgaaagttgacccaatcgtgcattccgtagggcactctgaacggacagggatacaagttgaagcgcgcttatcaactcagtggtttgtgaaaatgaagccactagctgatgaagctatcaagaatcaacaaggtgacgatgccgttaactttgtaccagaacgatttgaaaatacttttacacaatggatggataacgtccatgattgggttatttcacgtcaactctggtggggtcaccggattccagcgtggtataacaagcagactggtgaggtctacgttgatacgaaggcgcctaaagatattgaaaactgggaacaagatccagatgtcttagacacgtggttctccagtgccttatggccattttcaacaatgggctggcctgatgaagatagcgctgatttcaaacgctacttcccaactagtactttagtaacgggctatgatatcatcttcttctgggtttcacggatgatgttccaaagtcttgaatttacggggaagcgaccattcaaaaatgttctccttcatggacttattcgtgatgaagagggccgcaagatgagcaagtccttgggtaatgggatcgatccgatggaagtgatcgataagtacggtgccgatgctttgcggtggttcttgtcaactggttcaacggctggccaggatgtacggttcagttacaccaagatggatgctgcttggaatttcattaataagatttggaatgccagccgctttgtcatcatgaatctgggcgataagacgcaacccgttttgccagctgctgaaacttgggatttaaccgacaaatggattttaagtcgattaaatgatacggttaagcacgttactgagatgtttgacaagttcgaatttggtgaagctggtcgcgctttgtataactttatctggaacgatttttgtgactggtatatcgaaatgagtaaggaagtcttaacgggtgatgatgaaacggctaaggccaacaagcaagacctgttggcttacgtcttggatcaaacgttacgcttactgcaaccaatcatgccgtttgtcacggaagcgatttggcaagcgatgccacatgatgggcaatcgttagtaacggcagcctatccagttgaccatcctgaatttacgaatccaacggcggaaagtgatatgacgagtctgatcgacttgattaaggctgtgcgaaacattcgagcggaagctaacgccccaatgtccacaccaattgaccttcagatcaagacgagtgatgcgaagctacaggcggtctttgaagccaacaaagactatatcgatcggtttgttcatcctaaggcgctggaaattggcgctgatttagtcgcaccaaagctggctatgacgtcagtgattacggatgctgaagtgtccgtacctctggctgaattggtcgatttgaatgacgaagccgctcggttggaaaaagaagttgcgaagttcacggcagaagtgcaacgggctgaaaagaagttgggcaatgaacgatttgttgccaacgctcccgaagcagtggttgctggtgaacgagaaaagcaagctgataaccaaaagaagttagaagcaacgcagcaacgattagctgaaattaagcgtcaactgtaagcttaaataaaactggattgggtcgtttccacatcggagacgggccaacccagttttattttgggcaaaatctgctacacttaaacacagtgattatgcgggaggggtagattttgataacgacgtatgctgaagcattacaatttattcatggacgggatcgcttcaaaaaaaagccgacactcgatcgaatgcgcgaatttatgcggcgactaggcaacccacaggaaaagttaaccatgattcatgtggcgggcaccaatggtaaagggtcgactgtcgcatttctacgtgacttattcatggcagaagggcagacagtggggacgtttacctcaccgttcatcacgcgctttaacgaacggattagtacggatggcactcccatcagtgatgatgacttagtggcgatgacgcaacaggttcagccggttgtcgcgcagttagatcaagaactggccgagaatggaccgactgaatttgaaattgatacagcactgatgttttgctactttgcccagcaccccgtggatatggtcattgttgaggttggcttgggtggcttgtatgattccaccaatatcatcacaccggcagtcagcgtgattaccacaattgggttagaccatatgaaaattttgggtgataccattcccgagattgccgcgcaaaaggccgggattattaaaccacaagtccccgttatctgtggtcgcttgacacccgaagcattagcggtgatggaccaaacggcggctgctaaatcagccatgatagttgcattaggtcgagactttcaggtgaccaatcaaccacatgaccagtggggcgagcgcttcggttttgcgtttaaaacgaatcgatggcaacatttgcaaatcgacttactggggcaatatcaaattgataatgccgcgacggctctaacggcttttctggtctatcaccagcaacgtcaattgccagtgagtgtgaccaccattcgacaggggctgagtcacacggcgtggcccggtcgttttgaacgggtgaatgagcaaccactgatggtgattgatggtgcccacaatgagccagcaatggtggaaatggcccaacttttgcgtcaacactttggtgatcgagaggtttatgtgattctggcaattttggccgataagcagtaccagcagatggtgaagactctcttacaggtccccaacgttcatgtggttgtgacgcagtttcaggggccgggtaaacggcaggctgccagtcctgatgccttagaacaagcagcgacgacacacgagcgattaagttcagcgccggattggccgagtgccttgaaacaagtcctggcaaccatgtctgctgaggatgttgtgctactcacgggctccttgtattttatttctgaagttcgacattattttaaggaaacagacgcgtcgtaagccaataagtgcggagctaagctgtaagaggtgaggcgcatgcaacgggtacaattaacgacacaaacagaaccgcaattggtcggccgagtattggtcagcttgggactagcacacgccagtgaaagacagcgcttttttcagtattttcacagtgtagccgctgtgcggtatgccagtcatcgccagcaacgggcttatattagtggaaatcgacaacgtcaggctttgttgacagccattgagttagggcggtgggccgaaaaagcaccccggcccattttaggtgaagttctggcaagcagtcagctgggacaagtcttgatggatgacttacgttacctattgcaggagcaactagaggtattggcgctggatgcccaacaccgaattatcgaacgacaaaccgtttttcaggggacgctcaatagttgtcccgtccatccccgagaaattttccgggttgcggtgatgagtggcgctgcaacagtaattgtggcccataatcatccgagtgggcagccacaaccatccactagtgatcgcgcgtttatgcaacggttagcggcctgcggacagttaatgggaattccgctattggatggctttgtggtgggactgcatagctattttagttttaaggaagccggaattttaccgaaaacggttgaaaaaaggatagaacctttaaaaactaattaaaatcacttttaggtatttctttctcattaaaagttcggtattcttgacattgacgacgtgttctcacgtagataggtatgttataatacgtctatcaatgaataagacaaaaatccattaaaattttgttgacaatgaagggatgaaacatagtgttcggattaggaacgaaaaatattggaatcgatttaggtaccgccaataccattgtttacgttgacggtaagggaatcgttcttcgtgaaccttctgttgtcgccaagaacacaaagtccggagaaattgtgtccgtcggtgaagacgcacgcgcaatgatcggccggacaccgggtagcattgtggctattcggccaatgaaagatggtgtgattgccgactacgatacaacggttgccatgatgaaatacttcatcgaaaaaacagttggtcgttcaagcggtaagccatatgtcatggtttgtgtgcctagcggtgtaacggaagttgaaaaacgagcagtgattgacgccactcgggttgccggtgcgcgcgatgcttatgtgattgaggaaccatttgctgcggcaattggcgctggcttgcccgtaatggacccaactggaagcatggttgttgatatgggtggtgggactaccgatgttgcaacgatttccctagggggcattgtgtctagccgttcgattcgggtagcgggtgataagttagatgatgcgattgcaacttatgtgcggtctaactttaacctgttaatcggtgaacggactgctgaaaagctgaagatggacattggttccgcatcagttgaggcagctgagaagattgagggtgcaacgattcgtggacgtgacttgattacaggtctgcccaaagccgttgaagtgtcggcggttgatgtcgctaaggcaattcaagagcccgtccaagatgtgattacagcaatcaaggaaacccttgaagaaacttcaccagaaatcgcagccgatgtgattgatcatgggattgtgttaactggtggcggtgcgctattgaaaaacttatcagaagtaattgcggaagcaaccaaagttccggtctccattgcaagtgacccattggattgtgtggctgctggtactggtgaatcattaaagagtatcgatgtcatgaagaaaaaatagggactagcgggaaggcagcttcccgcttctttattgtgacggtatgtcgttaagggcgtacccgaaaaatggaggtcaaacatgcagaaattttctttcaatcggcgactagtgattatcatcgtttgcttgattgtcagctttgctttgatgacagtgtctgttgctatccgtaacaagaaatcgacgccgccgttggtgcaacaatttggtaatgatattgttggtttagtcgatcgggttgtggcaattcctagtaatgggttgagtggttcagttagttccatttctgaattgttgaatacgtatcaagaaaaccaacaactgaaaaaacaagtcagcgagttggctcagactaaagtacgtgatcaaacactggccaaagaaaacaaacagctgaaaaaagaagttagtctaaataactcgttaacggattacacagcggtaacggcatcggttattacgcggacaccatcatcttggcaaaatcaagtggtgattaataaaggggcgtctgctggtgttcaaaagaacatgccggttatgtctggctctggtttaattggccgggttgccgaagttaataaaaccaactcgaaagtggaattaatcaccgataataatgactctgctaatcgctttgccgtttcaattacgacgaagtctggcaagacagttaatggtgttctaagtgggtataaggccgcaactggtcaaattaccatgaataacattacaaccaaagctaagatcagcaagggtgataaggtcgttaccagtggtttaggtgggctaacacccaagggcttgtatgtggggaaagttgccaagacaactggagatgactacgggttatccacgaaactctacattacaccagctactgatctcagtgacctaaatattgtgacggttgctgtgacgaagtcgtagagggggattagtcgtgtatcgattatcaaagttacgctttggcttccccatcggcttattcttttggttattgatagatgggactgttagccaagtttttagcgttcagttatttcgaacaccatcaaccatggttagtcatttagtggtgttgtggttagtgtgtggcgctatttttgaagcagatagtgctctttcgatgccgttggcgcgatgggcagcagtggcgggggccgtatttgatctctattacactgggatctttggtctatacgtctttatttttccgttggtcatctacatgacgcgtcgactagtgagttggattcgaccgaactttttgagtggtctcttggtctatttcattgacattacagtcgtggaagccttggggtacttagcgagccgggcgatgcacctcaatgatgcctcgggaaatgcctttttggtgaatactttagggccaacactggcgtttaatttggcaatgtttgtcatcttatatttccccattcgttgggtgtataattggttaaaataggtgaagggaacgaacactatgcaggctgccgtattacgcggaacgcaaaacggctatgacttggtcttaaagcaatcagcgagtctggaccagatcttggtcgatttaaaagcattactagaaaatctcaaggtagatccgcaggcgttagcagcgtcgaaagtctcgttggatgttttgacagaagatcgaattttgacggcggatgagaaggctcgaattgagcaattgatcgcccaatatccgcgatttgaaattcataaaattgccgcaaatgttatgacgatcgctgatgcggttcagctacgtgagcgtgaaaatgttcatctcctgagtaaagtgattcgtaatgggcaggaggttgccatgactggtgacgttctgttcttaggcaagattcatgaaggtggtaaactgcggacaacggggaatatcttctcaatgggggatgtcgccgggattttgcaagcggggtatcccgatgatgaatcaaaattgattatgggaaacttacaaaatgcccaacaggttcgaattgctgagcagtttgagattgttgaaccaggacaattgagcgactcacaacaaacaattgcccatgtcaatgacttacacgtgttgacgttcggtaaattagcgaacttgaagaaaatcaatccgaagttgtacaaccagattggaggaatttaataatgggaaaagcaattgtgatcacctccggtaagggtggcgttggtaaaacaacgacgagtgccaacattggcacggctttagccttaatgggtaagcgggtgtgcttaatggacctagacatcggtttacggaatttggacgtggttttagggctggataaccgaatcatttatgatattgtggatgtggcggaaggccgggctaaattaccgcaggcgttggttaaggataagcggtttgatgataagctttatttgttgccagctgctcaaaataccgataagacagctttggaacctgaacaggtcaaagaaattgtggatgaattaaagccagaatatgactatgttttgattgactgtccagcgggaatcgaacagggtttcatgaacgcagttgctggtgctgatgccgcgattgtcgtaacgacgccggaaatttcagctgtccgtgatgccgatcgagttgtgggattattggaacaacatcccctgacagaagcaccacggttgctgatcaaccgtattcgccgcaatatgatgcaagatgggtcaatgatggatattgatgaaatcacgcaccatttgggcattgaactcctgggaattatttttgatgacgatgctgtcatcacgacctccaaccaaggggaaccggttgtaatggaaactgaaaatccggctggtcaagggtatcggaatgttgcccgtcgcttggaaggcgagacggtgcctttaatgaagattgaagagcaagaagataccggtttttggcatcgggttagcagttggtttcaccgcggctaaaaaagcacttgacagtttccaataaaaatcgtaggatactgtcaacgaaagaaaaaagacagtgaacagaagagtagttgaattaagggtcatcagaaagcttcggttgatgggaagaagcggtcttaatttggcgaaacacatctgtgagttggccgtttgaatgaagtagaatggtccgggttagcccgttatcgctggagttgcttgcaactcgctgaggttgacgcagtgatgtgtcaacaaacagaggtggaaccacgatgtgatcgtcctcttaggtctttggacctaagaggacttttttatttcaccgatgaaatcacagtgagaaacggggaactccgtgagtcggcgtgacgtgagttcgtcgaaagcatgaggtggtaccgcgttcaaacgccctcttgagatttcaatctcaagggggcgttttttagttgttagaaggaggagaattagatgcactacgtaaatgagattttaccatcattggtttctggaacgggcatgacgttatccattttcttttggacgattattgtggcgattccattaggaattttagtcggcttgggaatgaccacgcggtttaaacccttgacttggttaattaatatctatgtgtggttgatgcgaggaacacccctgttattgcaattaatttttgttttttacgggttaccgatcattggggttgttttccagcgttatgatgcggcattatttgctttcatcttgaactatacggcgtactttgccgagatcttccggggtgggttacaggctattccagtgggacagtacgagagtgctcgagtgttacgactgactcggtggcaaacgttacggcgaattgtgattcctcaagtggtcaaaattgttttgccatcaattggaaatgaggttattaacttaatcaaggattcttcactggtttatgttattggcttgggtgatttattacgagcaggtaatgttgccatgtcgcgtgatgtgaccttggtaccgttggttctagttggtgtgatttacttgctactcacggcggtttgcacgattgttttgaaacggttggaaaaacactatagttactggcgttaatgaaaggatggtcgcagtatgttagagcttaaaggaattacaaaaaaatttggtagtaagaccattctggataatctgaacttgaccgtaacggatggtaaaatcttaaccattgtcgggccctcaggcgctggtaaaacaacgctactacggtgtatcagcgggcttgaaacggttgatagtggtcagttcttgctggatggacagccttttgatccagcaactaatcgggacaatgacgcagtaatcggggttgtttttcaggattatcaacttttccctaatttaacagtccgacaaaatgtgacgttggctcccactatggtgctcaaacagtcagcggctgaagccaatgaaacggctcaaactttattggcacaattgaatttagctgatcaggctgatttgtacccatatgaattgtccggtgggcagaagcaacgggttgccattgtacgggccttagcgatgcgacctaaattgttatgctatgatgaaccaacgtcggcgttagacccagatcttcgccgcgaagtgcaacagattattgttcaactgcgagatgagggaattacccagatcgtcgtgacccatgatatcccatttgccgaagcaattgcggatcagatgttacgggttgaagccaagagttaggagggtgcttaaatgaaaaaaggattacgaatttgggcactcttagccgtttgcattggactaagtggacttttggcgggctgtcgaaccgtgacccaacgagctaatacggcggatacttggtctaaagttaagcagcaaaagaaagtagttgttggattagatgatagcttcgtgccgatggggtttcggcagaagagtggtaagttagtcgggtatgatattgatttggcccgggctgtctttaaactgtatggcatcaaggttgattttcaaacgattgattggaacatgaatgtgacggagctccataatgggacgattgatttgatttggaacggtttttcaatcacaccgcaacgccagaaacaagcggctttctctgacacgtatttgtataacgatcaggtcttagtgacactgaagaaaaataagattaaatcctttgccgatatgcaaggcaaagtcttaggggctcagaccggatcgtcgggggccaatgatattgacacgtatccgaagttactgaagaatcggattaaaaatcacgaggcagttacttatgattcctttacgaatgccttcattgatttgaatgttggtcggattcaggggttgttgatagatagtacgtacgccaactattatattaagcaccaggctcaccctgaaaattatcgtgtcacaaccggcgcactacccaaggaaaagtttgcggtgggaatgcgtaaaggtgatgtgacaatgcggcacaagattaacgcggggttaaagcggttggcggctaacgggacgttaaagaaaattaatgaaaaatggtttggtagcaacgttgacacgccactattaaaatagatcaataaacacaatgatgcccagcttgttgggaaatcattgtgtttttctgtggtcggttgcttgtatttatgtcgtggttcccttaaaattaaacaccgattagtattttactagaggaggccatgacgcgtgcacgttcgcatacgagatggggtaacactggatttgttacccacgaaaaaatttaagacaattggcattaaagtggactttgtcgcacccttacaggcgacggccattacggctcgggcgttgctggcccaagtgttggaaaccagtacggccgagtatccaacccaaacagcattagcgcgtcagctctcacaattatacggtgccagttttgggctcagtgtggtgaagttggggactaagcacgtgattcgcttgacgtgttccgtcgttgatgaacagtatttagcacaatatcaggatacgatgcccttatttgaacgtggcatggcgctactaaaggccgttttattcgcgccgttattacccaacggtaactttgatcccacaacgtttacgcaacaacgccaaaatttgttgaccgctatcaagtcgttagacgatgataaacagtatctggccaatcgacggttgcaggaactcttatttacgggacaaccagcgcaagcaatgagtgctttgggtgatgtgacaacgttaggtgagttgactgcgaatgatattttggcgacttatcacgagatgttggcgcacgatgctgttcacgtggcggtcattggcgatgtaagtgagaaacgtgtgacaacggcattagcggcttggccattggcggagcgacttgaaccaacgactgagccctactatcgctggacggcccggtcacaggttcaggcgggagacgacgaggcaccagttgtgcaagctaagttaaatctggcttaccagttaccaatctatcggtcagacgctgacttcttaccggcagttgtctttaatgcggctttcggtggcacaccgctgtcgttgctgtttaccaatgttcgagaaaaagccagtctagcctattatgctagcagtgattacaatccatttactggcgcattgacggtgcagaccgggattcaggcacagaatcaagagcgggtgattgcgattgtgacggagcagttgcaagccattcaagctggtaaattgtcgaccgaacttttggccgaagttaaagcaagcttattgaatgcccgacttgccagtttagatagtccgcaacggcaattgacgggagccttaaacagtggtttaacgcatttgcaagagactttaacgcattggcaggaaaaattggcgcaagtgaccgtggctgacgtgcaacgtgtagcgcagcaagttagtctacaggcaacttattgtttacatggaaaggagaccggtgatgctaacgaaacacgcgtatagtcgtctaggcgagacggtgtatcaaaccacactcgaaaatggtctcaaagttatcttgattcctaaggccgattttcataagacttttgcggttatgacaacaaattatggtgccattgataatgaatttgtgccgcgtggtcagcagcaggcggtccggttccctgatggcattgcccattttctggaacataaattatttgaaaaagaggatcacgatgcgtttgatttatttggacaatatggcgcaagcgcgaatgcctttacgagttttacgcaaactagctatttattttcaaccacgaatcacgttcgagaaaacttagatattttgctagattttgtccaagaaccgtatttcaccgcggcaactgtgaacaaggaaaaagggattatcggtcaagaaattcaaatgtatgatgatgatccagggtggcaaagctactttggcatgatcggccagttatatccacgcgagccgctgcacattgatattgcgggaaccgttgagtcaattgcccaaatcacggcggatgatttgtatgcggcctatcagacattttatcatccgagcaatatgagcttggtaatcgttggtcaattggagccagaaactgtgctggcctggattacggctaatcaagcacgcaaaacgtttggacctaatgagcccattcagcgcgtagcatcaccgcaaacacccgcggctgaaattgtcccccaaacgacgcggcatctaacggtcacgcggccaaaggttagcattggactgcgggggtacgatgaggttcccgctggtcgcgctggattgcactatagtgccgctgtgtcattagcattggatctattattcaacgacacgggtgatcactatttacgcttatatgatgctaacattattgatgatagttttggctatgacttccaagtccaacggggcgcacattttgctcaactagcaggggacacggatcatccggagacctttgtgagtgaattaacggcaattttagatgatgcagcagcgcaactggttgcggctcaggaacaatttgatctcgtcaaacgcgaggcaattggccgtttgattggtgcaattaactcggttgaggcaattgccaatcagtatgatggccccttgttcggtggtacgacaatttttgatgaactgacgattttggagcagttgacctttgcagatgtgcaacaggccttagcggcatttttagcggctagtcagcggacggtctacacgattctgccgtaaacggaggttaagaaaccgttaaatcctgaattctaggtgctgtcgctgaaattgaggcggtgcctatgctatactgcatatagagaaattttgaacaggtggagaattaaatcatgagtgataacagcaaagtaactttgggaaagacgctgcgggatgcgcgaattgctaaggggtttaccttagatgatttgcaacaagcaactaagattcaaaagcgttatttgattgcgattgaagatcagaactttgatgagttacccggcgatttttatgttcgggcctttatcaagcagtatgctgatatggttgacttggatggtgctgagctgctgaaacaatttgacagtacgcttcctagtacacagacgcaagaatacgttgataaggtcaatgaaagtaatccagaaacccgatcacaacagcgtaaagttgatgatcgttatgttcagttacgccggacaattcccgtaattggcattgtcattgtggtgttagtggttttagtcggaatttgggtggcggccgcgcataatggtaattcaggcaccaaggataatgttgatagtagctcggttagcgtttcgggtagcagtaccaagacgagtagcagtagcagtcagtcatcttcttcaaagagctcttcgaaaaagaaggcggctaagacagcaacctttaagaaactgagttcaacgacgtctggctcaacttgggaactaaagaatgcgtcaagcaagccaaaggttagtttgtcagctacgagtagcgcttggatgtcagtaacaattagtggggcaacaacttggcaagggactttgtcgacatcaacctcacattcgttaacgattccaagctcagccacgagtgtgacctttaagtttggtaatgcaccggcaactaaggtaaagattgatggcaagagctttaacttcaactcatcaaccagtaccagtagtgcatctagttcaagtacaaccacgtcttctcaagtacaaactgtgacgttggaactgaagtaaccagaaagcgggtcggtccgttgcgaccggtacgcttttttatttataaggaggaattgttgtgaatttacccaatcgtctaactattgttcgaattattttgattcccatctttattttgttactggttttgcctttgaattggggaacggttacgtggctaggaacggcgattccggttgcgcaaatttggggcgccgttgtttttgcggcggcttcgattactgatttcttagatgggcagattgcacggcggcagcatctggtaacgaatttcggcaaatttgcagatccgctggcagataagatgattgttatgacggcttttattttgttagtctcgatgaacactgtgccagcgtggggagtggccattatcgtctgtcgcgaactagccgtcactggtttacggttaatcgtggttgaaacgggtggtcaagtcttagcagcagcttggccaggtaagataaaaaccacgactcaaatggtcgggattattttgctattattgaataacatcggctttagtacgctacacttcccaatggcgttgacattcttctacatttgcttattcttcacgatttactcgggaattgattactttgttcaaaaccgacaagtttttgcggaatcttcagcggaataaaaactaacgggaactttttgcggaagtaactaaggcatcatcgggagggattcaagtgcaagcagaaattattgcggttggtacagagattttactcgggcaaattgtggatacgaactctgccttcattgcgcgcgaactggcggaagctgggattgaggtgtattaccattctctagtaggtgataacgcaacccggttaacggctgttgttgaacaagcccgttcgcggagcgatttagtgattattagtgggggattaggaccgaccaaagatgatttgacaaaacaaacggtcgctcacttgttaggcgtaaagttggttgaagatgcgttggcaatggctaagattcgtcgccggtttgctatcaatggccgtgagatgacgcctaataatcgcctacaagctttatatccagcaggcagtcaacccttagcaaatcggacggggttagctgtgggagctttttatcaagatcctgatggtgcggacatcatgctattaccgggaccaccaagtgagactgaacccatgtttcgtgagcaagccttacccctgctgaagcaaacatatccacgaagtgagtacttgtcttcacgggtacttcggttctttggcatcggcgaaagtcaattggtcactcaactgagtgatctgattgaccagcagactaatccgaccatcgctccttatgctaaagttaatgaagtaacgttacgtttaaccgcacaggccccggatgagatgcaagggcaacgcctcttagatgacttaacggcgacgattaaggcccgcgtaggggattatctttatggttatggtgatgataattcattggcggcagtggtggttcagacactaattgaccgtcaattgaccattacggctgctgagagcttaacggccggtcaatttcaaagtaccttgggaagtgttcccggtgtttcggcggttttccctggtggttttgtcacctatgcggccagtgccaagcatgacttattgggagtctcgcaggccacgattgatcaagatggtgtggttagtgcggccacagctaaggaaatggcatcacgttctcgagaacggctggatactgatttttcgttgagcttcacaggagttgctggcccggacgccttggaaggccaaccggctggaacagtctggttaggtttagcgcaacggggacaacaaccacaggcaaaactgttacatttgacgggtacgcgatcggcaattcgggaacggagtgtcttgaccgggttggactggttgcgacgaacattgcaaaaagtaaaataaaaaaaggggaacttttgttctgcttttgcttgctttttagttagtaaacccgtatagtattacttgaatattgatccattaaggaggttctcaatggctgacgaacggcaagcggcgctggataaagcgctgaagaagattgaaaaagactttggtaaaggctcgattatgcgattaggggacaatagtaacctcgaagttgagaccgtaccatcaggctcgttagcacttgacgttgccttgggtgtcggcggttaccctcgcggacggattgtagaaatttatggtccagaatcttctgggaagacgaccgttgctctgcacgcagttgccgaggtccaaaaacgtggtggaacagccgcctatattgatgctgaaaatgcgttggatccagcctatgcaacggcattaggggttaacattgatgatttattgctgtcacagccagatactggggaacaaggcttgcaaatcgctgatgccttgatttccagtggtgcgattgacattgtcgtggttgattccgtggcagccttagtgccacgtgctgaaattgaaggcgaaatgggtgatgctcacgtgggtctgcaagcccggttgatgtcacaagccttacggaagctatctgggactatcaataaaacgaagacaatcgcgttatttatcaatcagattcgggaaaaagttggtgtgatgtttggtaatccagagaccacaccaggtggccgggcactgaaattctatgcgacagtgcggttagaggtacgacgggccgaacagattaaagatggcacggatgttatcggtaaccggacgcgaatcaaggtcgttaagaacaaggttgcgccgccatttaaacgggccgaggttgatatcatgtacgggcaaggaatctcacaaaccggtgaattgctcgacatggcggttgaaaaagatatcgttgataaaagcggttcttggtattcttatggtgaagaccgaattggtcagggtcgagagaatgctaaacagtacttggcagatcatccagatatgatggccgaagttaatcaacgtgtccgggctgcttacggtgttggcgatgaagaagccgcagcgactaaagcaactgagacgaagactgatgcgcctaaagacaaggataaagggaagacaaaggctaaagataaaccggccgatgttactcctggtcagattgagttagcaccagacaaatcaactaaataatcatgaccagaacctctaagaccgactaatcgatcttagaggtttttgacaatcttttaaatttaacgtttttaatgccgctgatattgttcaaaaacaaaatcatacggatttttttcattacgaatccctggttgttggtcaattagcgtaaattgactgtaatcgatcactggcatccatgtatcgccgtcaaatccagcatcaatccgggttcgatacaggaaatcaacgtcatccagcaggccggcaaataattgcgccccaccgaccacaaatattttttcttgtgggcgagctgctgcgtaggcccgcaccgctggcaatgaatgcagcacgctgacattttctgggaaagccgttgctggttgatgagaaaccacgatatttttacggttaggtagcggtcgtggaaatgaagcaaaggttttgcttccggccacaattgtatgacccgtcgtcaccgttttgaagtaatgcatgtcggccggtaaatgccatggtaagccgccctgcagcccgataactcgtccctggctctctgcccataaaaagattagcatccgtctcagcccctctctaaacggccacaggggccttaatcgctggttcagggtcatatcccgtcaccttaatgtcactcatctcataatcgaagatactcgacttatcaggatttaaccacaactgtggcgcagcatgtggtgtccgcgctagctgggttttgatttgctcaacgtgattactgtaaatgtgtgcgtcacccagcgtatggacgaaatcgcccacctctaagcccacttccttagcaatcaacgatgtcaacaacgcgtagctggcaatgttgaagggcacacccagaaagatatcggcacttctctggtaaagctgacagcttaatttgccatcattgacgtaaaattgaaagagcgtgtggcaaggtggcaaagccattgatggcacatcagccggattccacgctgaaacgatcatccgccgagagtctgggtgcgtccgcaacgtctcaatcacattggccaattgatcaatggtttcaccttgatgaccttgccaagcccgccactgactaccataaactagacccaaatcaccaaagtggtcaccaaaagcttgatccgttacgattcgatcacaaaatgcctttttttctgcttgatattgctgattaaagtctgcatccaccaaggaacggcgaccaaagtcggtcatatctggtccatgatattcgggactatcaacgtagcgttgaaaagcccactcgtcccaaatatggttgtgatgttgcaataaaaaccgaatattagtatccccacgaaggaaccacaagagttcagatttaatgagaccaaagggcacctttttagtagtcaatagcgggaagccctcttgcaaattaaaccgcatttggtagccaaataagctaatcgttccggttcccgtacggtccgttttttcgtgacccgtcgtcaagacagtcttagctaaatctaaatatgcctcttctaacaccgtttttccccctattctgcgtactcactgagatattcccaacgcgccatcttgtcatccaactggtggtctaagtcatcgagttgggcctgtaggtcggctagtttatcataattggcaccattggcattcatggcctcttgaaccgctgatttttgcgattcaagatcgtcaatgacactctcgatcccctcccattccttttgttcagcatacgtcagcttcaccttttgtttgggcttagcaggtgccgattcctttggcgctgctggttttgacttcgccttagttgcctgcctcgtctgtgcctgttgtgctgccaagtaactactaaattggcccgagtaacgttcaatctgaccatttcccgtaaagattaacagacgatcggcaactttatccaagaaataccggtcatgagagaccgtaatgacggtaccagaaaattgggaaatatagtcttccaatacggtcagcgtactaatatccaaatcgttagttggttcgtccaggagtaacacattaggttgttccatcaatagctttaacagatacaagcgccgtttttcaccaccggacagtttacgaatcaatgtaccatgcataaaccgtgggaagaggaactgttccaacaactcagtcacactcaccgaattcccttgcttatccgtaaccgtctgaccaacttccgatagatagttaatcatacgcttattttctggaatcggttcaatttgctgagtatagtaggccattttgaccgtttcaccaaccgttacaatccctgaatccagtggcagtcgttgggcaatgacgttcaacaaactggatttaccggccccattttcaccactgatcccaatccgttcgccggcctgaatcaaatcactaaagtcattgagaatggtatgaccacccaagctgaggttagcatcctttaattcgataacctttttccccagccgttgttgacctaaggaaatcgccacgtgatgctcgacttgtcgggtaccgacgttgctggcaatatcgttgaaccggttgattcgagcttgttgtttagtggagcgtgctttagcccctgccttcatccaagccaattcttgttgatagagccgttgctgcttttgttcggcttcagcttccaaatttacccgttcagctttttcttgaacgtaagcctgatagttaccggggtattgataaagtttaccgaaatctaattcccagatttggttagccacttgatccaagaagtaccgatcatgggttaccactaggagggcccctttataactcgtcaaatactgttgtaaccaagcaattgaatcgaagtccaagtggttggtcggttcgtctaagagaagtaagtcaggtgactgaattaacacttgggccagtccgacccgtttgacttgtcccccagacatggttttaatttcttgggatagatccgtaatttttaactgtgtcaggatcgttttaacatcactttcggctgtccaagcatcctcttcgttcatttgtgcttccgcatctaaataccgcttttgggcctgttcgtcatcaggatgcgcaccataagctgccagtgcggcttcataccgacggatcgtgacaaataccttctgatcaccagagaaaaccgcatccatcacggttaagttttcatccagatctggcttttgagtcaaatatccaatggtgtagtctttgggcgttgctaattcccccgtctgttcgttactgatgcccgctaaagtattcaacagcgacgttttaccactaccgttgaccccaatcaggccaattcggtcatgctcattgataataaaattcagattatcaaacagtgttttttcaccgtaagtccgatgtaaattttctgctcgtaacgtttgcataatatcttcactctcttatttttcaaattcaatcggtgacagcagccactaatgccgatttctcattgggcagtttacccgtgacaacttgatactccaagtcgcccaaaatagcccctaactgtggaccgggttgcacaccagcttgcatgagatctcgtccagtgacagccaaagctttcttcgtttgaattggtaaattttgccattgcgctaccagttcacgtgatcgattcgtagcacctagtacgactgccgtttcattagcgatcattagttgagcctcaccacattggtagacctgccaagtagacaagggcccttgcagtaagtgttgtgccgtcttagtcgtcatctgtacggcggaaatcgtctgattagccgttttccagtgttttagaaatgtggtaatagcgttagtttctaagccaaaactggtggttaacaatgtccacgcggtcaagtcggtgctagcaccttgatgtagttgcgctgttagccgctctaagtcagccttgtggtcggcaaagtcaggacagtactgccacagtccggtcgtcaacagatccgtgagtccttgttggggcgcctgtcccgttaatagtttgagtagctcgacttgcgttcgctcaacggcaattttacgcagtaactcagcatgactggtcatggccgccagggtttctggcacaattgtaaagttcaattgactagcaaatcgaaccgcccgcatcatccgtagcgcatcctcatggaaccgttcttgtggatcacccacggcgcggatctgccgatgccttaaatcagctagaccgtcaaatagatcaatgacggtaccatcttccttcattgccaaggcgttgatggtaaagtcccgccgttttaaatcctcagccagtgagcgcacaaaggttacttggtccggccggcgaaaatcggtataggttgattcagaccgaaatgttgttgtttcatatcccgttccatgatcgaggatcatgacggtaccatgctcaatccccgtatccaccgttcgcttgaagaggtgtttaatctcatctggataggcacttgtcgcaatatccacatcatgaatctctttacccaaaatggtatcccggacactgccaccgacaaagtaagcctcataaccggcctgttcgatcgtttggaggactggccgggccatttcaaattcttctggtaagtgttctagctgcataattgtcacccttctgccagttactttctgttattgtctcactatgtcagtctaacagattacccgctagaattgaattcaaactcctgcaattccgccatagataatcgccagttttctagaggactgtgctatgattgagtttatcaagttattttttcagatgggagtgataatggtgacacagcagccagatgaatcgattcgctttattgacttacttatgattggaattgggtgtgccatgtttgcctttggactagtctttttcaatattgccaatcatttagcagacggtggtatctcaggaattacactgatttttcgggcccttttccatatcgatccggcctattcaaccattctgattaatgttcccttaattattattggctggcgatttttgggccgccaatcattaatctataccatctatggaacgggtatgctgtctttgtgtctgtgggtatggcagcgggtcccattgaccattgctttgcatggtgacttactactatccgccctaggcgctggtattattggtggttttggttccggtctgctataccgctatggtggcactactggtggtactgacattatcgcccgaatttttgaacggtttcggggagtgcccatgggacggaccctcctttacttagacgttgtcgttttattaatctcgctggtttacattgatattcaacatatggcttacaccttaatctattcttacgtcttcgcaagaattgtgaatttcactcaagaaggcgcttatgccgcgcgtggtgtgatcgttgtttccgagaattatcaacaaattacggatgaaattatgacggaattggaacgtggcgttagtctcgtcaatggtgaaggtggtttctcccatcaagaacgcaagatgatttacgtagtagtggctcccagcgagttgtatcggttgcggcagattattcagcgtaatgattcacgggcattcatctcagttatcaatgtgaatgaagcattaggtgaaggtttctcatttggactgccggataagggttggttaaatcggtttagacactagttttttgcgaccgcgggtttggcggtcgctttttttgagtgttataagttaaagtaatttttgtgttatttgattaataaaaaaacacccttcaaaattgaagcgtgcctttccccattaatcagtatacccctctaacattaacgccatttcgctgtcatctggtacttgcttcaagtaagcttgtaacagccgaaccacttcttcacgggcgccctcttcacgataaaagtaaatagctgaccgtaagaaatcggcctgatccataaagaatggcgttgccgcatcataatactttcgggcagttgcatagtcttcttcatgttctgccgccaccgctaggttccagtatagttgcgggtcagcatcatcgttttgaacataaggcgtcgccaattcttgcgtttcagcccagcgctcctgcttaacgtacaggttacttaactgaatgaccgcactcagatcgtcactgtctagctcatgtccgcgctttaggtactgctcagctaaggcctcgtcgtccagtcgcgtcgccacatgggcggcctgtaaccacagcttctcgttatattggtcaacgcctagaccttcctgcaaggctgttaaggcttccggtaaacggttctcctcttccagcgcttgtcccaaataaggatacagagacgtgtagtgctcgtcactatccttcaattcgttaaacaaccgaatggcctcagtgcgctcttttagctgcaagtaagtgaacgccgtttcaaacttaacatccggcgtcatgtcccccgaatgaatttgcttcaggtaaccaatggcttgttcaaaccgcccagcgttggcgtaagcaacccctaatcgttcaacaaggttgacccgtgacatatcagtcgtcccggccgtgattagttccagatagaggggaattgccttacgaaattcacgcattgtaaaatacaattcggcgagggcaaacgtaatcacgggctcctcaggtgctaactggcgagcggttaacaacttttgttcgctgacctcaaagagttcttgggtctgatacagatcggcggcaaccatcaatgattcaatataagccgacgaatcaggccgaacttgatttaaatagtccagtgcttcatcatttttgtcttcatcaatcgcaatatctgctagatttgtgcgtaattcatcttcatctggatacttcttgagtaatttttcataaattcggcgtgactgattcaaaaatcccagtgaatacaattcttctgctaggctaaagagcgtatcgtcatcatcatggcgcagagctaacgcatactgcttcttaaatgcgtctaactggcccttttctaattgatcaagtgctgtttgtgcgtaactcataacccgcctccagttgcttatctgtgtcacttttcacgggtagcaaaaagccagcccggcattcaccgtactggccttttctacccgctaaataattgataccaattacttaacagcatcctttaaggctttacctggcttgaatgcaggtactttgcttgcaggaatttggatttcttgtccagtttgtgggttacggcccttacgagctgcacgttcacgaacttcaaagttaccaaagccgatcaattgaaccttttcgccttttgctaacgttgcttggacagaatcgaagactgcatcaactgcagccgttgcgtcctttttagttaagccagttgcagttgcaacatcgctaaccaattgtgctttgtttgccattgtgaattcacctcctgaaagaagattagatgaatgacatctatgtcatttttgagtggtccaaaaatgatgaaacaaatacggtcaaccgcatcatttctttatcaaagatagcacaggaatccttatatgacaagggataacgcgattttttagcaataaagtggtgagaagaccccattttcctaaaaaaacgttaaaatcacgctaaaatactgctatcatcagtcttaatctacttacgagcccgctcgattaaatggatcggtgtcccttcaaaatcaaaatgttctcgaatctgattctctaggaaccgttcataagagaaatgcatcatcttcggatcgttcacgaaaacaacaaaggtcggtggtgcgattgcaacctgggttgcgtaataaacccgcagccgttttccattatccgatggcgtggggttcaaggcgatagcatccatcaccacatcattaagggttgctgactgaacccgtttgttatggttgtcagccacccgcttaatcatctccggtaactgttccaatcgttgccccgtcttcgctgaaacgaagataatcggtgcataactgagatattggaactcgatgcgaatcaagttttggaagtcggttaaggtgtggttatccttcttcaaggtatcccacttgttgaccaagataataataccgcgaccagcctcatgggcataccccgccacacgcttatcttgttcccgaatgccttcttcggcgttcagaaccaccaataccacgtccgaatcatcgatggcccgcatggcccgcataacgctgtaacgttccgtattctcataaaccttaccacgcttacgaattccggccgtatcaaccatcgtaaatttcgtgtcatcagccacaaacttagtgtcaatggcatcacgggtggtccccgcaatattcgagacaatcacccgttcctcgcctaacatcgcattgaccaacgatgatttcccaacgttgggccggccgattaaactaaatcgaatggaatcatccttaggcgcgccatccttttcaggaaattctttaaccactgcatcaagcaaatcccccaggcctaagccatgaaccccagaaacggggtatggatcgccaaagccaagtgagtagaaatcgtaaattgattcacgaacctctggattatccgccttattgacagccaaaataacgggtttatcagcccgatacaagattttagcaaccttttcgtccgcatcggtaattccttccggtgcactaacgataaagacaatcacgtcggcctcatcaattgcgatttccgcctgctgtgtgatttgggtcaaaaagggttcatcacccatatcaatcccaccggtatcaatcatccggaattcggttcctaaccattccgcacgtgaataaattcgatcacgtgtaacccctggcgtatcttccacaattgagattcgttcaccggcaattcggttaaacagcgttgattttccaacgttgggtcggccaacaatggcaactactggataagccatagttaatccctcctttttccgtttgacacgaaaagggtccgcaacgaaaccaacaaaagttccgttccagaccccttcaaccaaacgtattagttgttttcgttatcttccatgtccttcttcaggctgtccccaatcaggtcacctaaagagaaaccagtgctttcttctggggcgttagccgttgaagtttcagcattgttccggttgctacgacgacggttgttgttaccgccattgttgttgctccggctacggttaatgttacggttttcgttgtcatcgtcaccagattgtggcttttcttccaaagccttgatggacaatgccaaacggtggtcttctggacgaacatccaagaccttaaccttgatttcttgaccaaccttcaaaacgtcagcaggcgttgcgatgtgttggtgagaaatttgggaaatgtgaaccaagccttcaacaccagggaagacttcaacaaaggccccgaagctcgtcaaacgcttaacagttccgtctaacgtgctaccttgaggtgccttgtcttcaatcccatcccatggttctggtaaggtttgcttgatggaaagggaaatccgatcgcgatcagcatcaactgataagaccttaaccttaacatcttggccgaccttcaaaacatcgctaggcttttcaacccgttcaaaggcgatttcggaaacgtggaccaacccatcaacgccgccaaggtcaacaaaggccccgaagttcgtcaaacgagcaactttaccgtcgacaacgtcgccagcggttaacttcgccatgatttcttccttttgagcagcgcgttgcttttcaacaatcgcacggtgggacaagatcaagcggttttcacttggttcgatttcaacgatcttgaattccaaagtttggcccttgaattgtgccaaatcttcaacgaagtgatcagaaaccatggatgcaggaacaaagccccgtacaccagcatcaacgactaaaccacccttaaccacctgggtaacgggtgctgttaacgtgttaccagcttcgaattccttttggatgtcgtcccaaaccttacgggcttccaaacgacgttgtgacagcaagtaactgccgccttccttatcggaaccgatccgagaaattacgacgaggtctaagacatccccgactttaattacagatttaatatcatcaactggtttagtggataattccttcttgggaacaaccccttcaaccccagtatcagcaatcccaacgattgcttgttggtcatcatcgattgctaagatttcacccttaacaacgtcaccaactttaacggtgtcgatgctgtttaaagcatctaatagatcgttattttcattgttttgactcgtgccattttcactcatgcgaatttttcctccttgcgacaactctacatactattttagctgattatgccagtaaaagctagtaaaatgcccatttctagtgggattctttttcttttatgatttcagcaatcttatcggccacttgttcaatgctcattgacgttgtatctaaccgaatggcatcggctgcttgcgtcaatggtgacacttttcgcgtggaatccttacgatcacgttcctcaatttcatgcttcaatgtggccaatggcgttgtaattcccttagccgcattatccttcaaacgacgttgcgcccgttcgtcaacgctagccaccaagaaaatcttaacttcagcatggggcaacaccgttgaaccgatatcacgaccatccatcacgatccccccggcttcggcaatttgtcgttgccgttccgttaattctgaccggaccgctggtaacgctgaaacagccgacaccgaattggtcacgtcaggttgacgaatggctaacgtcacttccgtatcatcaacaaacaccttttggacgggggtgcctggttcaaaccgaatcgttatttggtccagcaatgccttaactgccgtttcatcagtcaaggcaacgcctgcctgcaagaccttccaagtaatcgcgcggtacatcgcacccgtatcacaatatatgtagtgaaaacgttgggcaactatcttagcaaccgtacttttaccggcagatgctggtccatcaatggctacttgtaatccctgcttctccatgaaaaccaaactccctatatttaaattctatcgaacccgcaacttttgtccggggtgtaacgaggcgccagaagacagcccatttagctctaataatttttgcaccgagatcccagcgttagtcgctacccgatagacaccctgtccggactctaccgttgcgtatttagaccctgtcgctgctgacgagctagaactgctggcgacatgactagaactcgtcgtgctggtcgcagtcgaagaactgctagtcgtagttgccgaactagcagttgttgtggacgttgctgattgatggctgctagacgcagtcgaagacgtcttcttagctgtcttctttttgtgactactggatgctttagctgaatgactggatgagctggaagaactagccgccaccttttctgtattttgaggccgattcacggcactttgccgtgctaacccgtaaaccagtgaagccgctgcaatcacaacgatgattgcaattaaaatgacggtaaccatcgtgttgctatgattttgccgccgcattttagttcgtgacaggttaccctgatcatcgcgatcgtcggcaaatgacgaatcccacggatgggactcttgttcctttgacgttggatcgtcctgcttttgactcatcatctaacctccctgaaaaactttcacccgttattgtaccatactgcccccacaaattctctaaaatcttcttaaaatagccggtgtaaccgttcctgccaactaaccgtcgtcacggtaggcacttccgtggtagtcctagttaagtgcaaagccgcagcatctaatgatgaagtcgctggtgaacagcagttggccccgtgcgccggcgcgacttcgtcaaatgcctgcaaccattggtgccgtaaacaggtctcctcacggacataagctaacatctgtgccaaagcgcgggtgcgttcgcgctgccgtcgttgaaacaaccgcaccacggcggcctcactaatgccgtgttgataataaaactgtaggagctgaatgaccggttcatcagttgcaaagttggtggggtgttgataatatcgctgaattaattcggcatctggccggttagtttcacccagcgccaaaggcagacgctcatccccaccggcatacagcaaaattgccacactttgctgaccatcccggcccgcgcgcccgatttcttgggcataactttcgaggtccgcgggcaagtggtaatgaatcacgtaccggacatcgtttttatcaattcccatcccaaacgcgctcgtcgcacagatcacgtctagttgccccgccatgaactgttgttgaatcttaaatcggtcctcagccgccagacccgcatggtacgccgccgcttgaacgtttgccgtttgttgcagccatagggcagtgtcactagcctgttgtttactggaaaaatacaccactccaggacgctttaacgtggttaccaactgttgcagtcgttcttgcttttcagcttcgtcggccacgtattccacatccaagaatatattgggccgatcgaccgattccgtcaccacctgtggcgtacaccgcagctgcttggcaatttcttgtcgcgtttgctgcccagcggttgcggttaaggctagtgtcaacggttgtcctagtcgatcccgaatggctcctaatagcaggtactccggccgaaaatccggcccccactgcacaatacaatgggcctcatcaatcactagcaagctaagcgttaactgctgcactcgggcaagcatcgtcggctgagccaacatctctggtgataaaaataagaactgaatctgatcgagttgtcgtaaaatctgttgtcgttccgtgaagctggtctgtgaagtaatcgccgccacccttttaaacccgctcatccgcatccgatcaacctgatcattcatcaatgataataagggtgacaccaccaacacacatcctggatggcggtatccatagagctggtaaatcagtgttttacccgcaccggtcggcaaaacggctaacgtatcatgccctgtttcaagggccgttagtgccgccaattggccttggcgaaactgatcaaaaccaaaaactgcttgtagactctctactaatgtttcccgcacatccttatgcctcctgtttaccacaccaaatggcaaataatctaaaatcgaaaaaatcgtattgattctgtacagtctccggtaagtcgccatattgccactcatcaatcggccccgaaacgaccgtctgaaaatcctgacgagtggttgccggtaataattgtgcgtacggaaaatccgtcaatgatagcattatcgccgcttctaacaaatgttctcgcaccgtgcttaacttgacatgccgggtcgccgcaatttgtgtcagcgtttgccccgcttgaacggctgctaaagtcacctgggcactacgggccactggtggttgccacaaagctgccactaacgaatgtaacgggtgggtgggttggcgcgcgtccagcgccacttgcgtaagaccatccagctgcatcagatataactcccaggtcgttttacccgttaactgagcctgctgttcactcgttacaccgggctgattaaacccggtaaactgagcagttaacacatctgctgccatagttggaattttcgtcaaactcgcagttaaagcggcggaaatggttgcagccaaggtgggggccttcatcgtgtgaaaccaccgccgcacggcttgacgggcggctaagtccacttgtaacggatagtattgtgcctgactatgcgcatactgtgagacaacctgaattgctaaaaacaaccgcgctcgtaacgcttggtgatccaagtagggccactgctcggccgttaccggttgatagtagactttggcgtcacgctgagctgctccggcagcagttagctggaccgtttctttttcggcatcaatttgcgcccaaccgtgagccaccaaaacggccgcagtgtcatcgagcccgccacgtgccaaggtcttattcagattcagtaaggataagaggtggtatcgctgcccccagtacaacgtcgaaaccgttcgccgtccccgcaataggttctcgacaacccgtaaccgccgcggttgactttcacttaataaaggtaataaatcgactggttccacgtgttgacctcctgactgattagtttccagtttaccatacaaaaaatgggtcaccactatcggtaacccacttttcagtgacggacgcttcaccgcaccgaatgcttcgcaatccacggtgccattcgtcggcttaaaataataaataaactccccagcacgatgcccttaatcaagttaaacggaataacccccaacaagattagttgattaaccggcaagccgagggacatatgccagacctttaaatacaatggcgtgatgacccaccaattagccagtgacaagatgatggtcaaactcaaagttcccgtgatcaccgctaagacctgacgttttaaagacggcatgggccgctttagcaaggctccaatgggcaagaccagggccaaatcagcaataaatgccgttaacacaccgataaagttcacaatatctaatcccgtggcgaccaaatacaataattccttaactgccgcaattaaaatagctcccccgggtccaaacaagctcatgcctaacagaaccaccagatcacttaaatctaatttcatgtagggaactagtgggataatggggacggaaatgaacatgaggacgaaggccacccctgaaaataaggccatctccaccattgaacgaacggctaagccatgacgactgttttccataatacgtgttcctccttgcggccatctcgtggcgatccccactaaaaaaggtctcaccacagaagggcaagaccttgggttttacgcgcaccaatatgctcacgcaaaaagcaacgtctcatcttctgcataccagactttactgtcggtttcggagttacaccgaatcaaccgctcacgcgggtcgcggactttaccgccggtcgggaattccaccctgccctgaagatgaaccagatttaattacacacttaatatactaagagatccttgacctgtcaaccatttggttctaagccaaatgggtcaaccgccgaagttctttgacttcttctggtttcagctgacgtgcttccccagcattcaatccctttaacgtcaagaagccatattgttctcgttttaatttttcaactgggcagcccaccgctgccagcattttcttaacttgatgattttttccctcgtggatcgtcaatgaaataatcgccgttttacgatcatcagcagcgcttaagaccttcgacttggccggtgcgtaagtttccccatcaacggtgatgccttgccgtaattgtttcatcgcatcattcgtgggcacgcccgtcacgcgggcaatatacgtcttctcaacttcataacggggatgggtcaatcgattggccaactcaccatcattagttaataataacaaccccgacgtatcataatctagtcgaccgactgggtaaacccgctggctcacattttccaccaaatctacgactgtcttacgccctttgtcatcattcgctgtagacacgacaccacgcggcttatataacatgatataaattggtgcttcactagagattggtacaccatccactaaaatttggtcatgcacgcccaccttagtccccagctcggtcactgccgcaccattaactttaactcggccactcataattaacttttctgattgacgccgcgaagcaacgcccgcgtgagccaagactttttgtaatcgttccattaagcttcatctcctgattgattgagttgctgattaaaggcctgcaggaataaatcaccggtcgcctcatcagctgttgtctcacttggttgggccgctgcgggtaacggcggcaactctgccaattgttcaagtccaaagtaatcgagaaagtaatcactggtttgatataacttggggcgaccgggttcatctaaacgccccgcatcttcaactaaccggcgcaacaccaatttctgaaccgttgaggcactctgaactccccgaatttcatcaatttcaattcgcgtgatgggttgtcgataagcgatgatcgccaagacttctaacgaagctggcgacaaacttgtacttaagggattctcaaaatagcgtttaaccagatcactcgcagcttccttggtcactaaccgatatgtggtatcgttgaccattaactccaaggcagaggcttcatcagccgcatatttttgagccaaccgttccaaggtcgctaacactgcgggacgcatgaggccggttgctgccgacaaatccgcaaccgaaattccttcgtcaccgctgacaaacagcaaactttcaatctgtgctagaggtgacatccgtgctaaacctaccttccatttgtaaaaagttaacttgcagaggcgccaagcgtcccgcctgttggagctgaacctgccgttggcgcgccagctctaacaccgctagaaacgtggtcaccacttcttccatcacgggatgggtcaccagcaattgttcaaacgctaccggtgccgtcgttccctttagccgttgtaaaatcgtcgtcatttgccgtttgatcgtaaagtgttcttggtgcacactttgcgtcaccggcttggctaacgttgctcgctgcatcagccgaaccaaagcggtctgtaaatcaactggtttgatccctggtgccactgtcaattcgaccgactccggaaccgccatggccggacgggtaaagtgctgctggcgttctagcgcccgttgtttcaatgcttgggcagcctgtttatatcgctgatattctaagagttgattgaccaactcttcacggggatcagcaggttcatcctcatcgacggggaccactgactgtggcttgggtaataagagtttggctttaatcgccatcagatttgccgccatgacaaagtattccccggcaacatctaaccggacgagctgcatttgatgtaaatacgtcaagtattggctcgtaatcgtactaattcgaatatcatagatatccatttcattggttttaatgaggtgtaatagtaaatccaacggaccttcaaaatcactgacctgaatcagcggttgtccgttcactgtggttttgtccatgatgatactcccactttgcaataatcttcgctgttgttagggttcccattaatcgtttgttcggcacagcagtcgtcaattgatccaacatttgccaggtactagctgtaaccggtttgtctggcatcagcgtaaccaagcgcacaatcagaaattgatcatgaacctctgttcctaaagccccggcaaaatcatcgttttcatctttccacaaataaagcgtccggtcatcgccaccttggtaccaactaagttcgcgctgaagccgatcccaatctttaaacgtgggcaacaggctgagtaggcccatcgcaatcttttgataatcactccgatattttaataacatggtcctcctccattccaacgacctcttactttatcacactaagctcgcgggtggtattgatcgtagacctttaccaatcgtttcttagaaatatgcgtatagatttgagttgtcgtaatatccgcatgccccagcaactcttgcacaacccgcaaatcggcaccattttccagaatatgggtcgcaaatgaatgtcgtaacgtatgcggcgtcacgtccttattaatctgcgcgaccgcaacgtattgcttaattttttgccaaatggcctgacgactcaggccgccgccgtgcgcatttaaaaataaatagggactcgttcgttgcttcaacagcaccggccggctggtttgtaaataccggttaatccagtctgtcgccacgtcaccaatggggatgatgcgttctttatcccccttacccaaagtctgaataagacccatttccaaatgaagatcagccagtttcaaatgaacaagttcgctgacccggaggcccgtggcgtacatcacctcaagaatagcccggtcacgcaatccgtacttagtcgttgtatccggcgcggctagtaatcgatctacttctgccaccgtcaaaacggccggtaaatgctcagcatgtttaggtgcagccacattggccatcggattagtagtcatctgatgggtttgtaccagataacggtaaaactttcgtaaagcggacacggcatgaatcactgaattacgcgatttccccgttgccgtcaagttacttaaataagccattatcgtcaaccgatcagcatccttaaaactagtcaggtgctgttgcgctaaataagtgcccagattacgcaattcttgcgtgtaactcgttaccgaattggcggctaagccctgttcaactgtcaagtaatggccaaaatctgccacttgggttgccaattcagccattcaatcactccttaatcctgcggtgtatccggatcagtcactagccacaattgaccatcatgttgcgtaatctttcgtgcttttagcaaatgcccaattgcccgcttaaactggcctttactaatgccaaagtaagccttaatcgcagccgggtcgctcttatcactaaagtctagatgaccgtcatcactgtgctctaaagcggctagtaacatcgacgcatcatcatcaatcgcttcaaaagtccggggacgaagcgataaattcaacgtcccgtcatcatgcaccccaatgacccgcgcatgtaattcttcacctaaacggggttccgtttcccgttcatttgggtgaataaatcccaattcataatggtccgtcataacccgcgttcctactaatttaagctgataagcccgcgcgataacgttggcattttgcattcgtttgttagcaggctgggcaatggcttgatagatatccccatctgccagaacgccccacaaccggtgcttgttatcttcacgcaaagcaatcattagttgatccccttgttgtggccatagttccatcatagctggtaggtcatccaaggaaacgacaatatccttgttgggtaatccgatatccacaaagacccccaatgtccgctgattccgtacaaccgttcccatgccataatgatcaacttgcacctgaggcgcgtcccgggtaatttgaagatcatgatcttcattttcataagcaaagcctttgaaattcgagccgagttttagcggcttcttgatctccgccttatctaaataaaaagtggttcctgcaacctgcacgaaatacgctgtttcattttcgtcagtaaccttccccgcgatgatgcggcctaataaatctgccataatttctcctcaattctaccagtctgactggtttaccgttcaaaagtgtctattctttattttacacggaatcccctcaactagcgacccttttcctgaattttgcgtacaaaaaaacggtcccccgacagaggggccgtttccataacaggtttatctctcattaaagtgcgttagaagcaccgtggtaaacgataccgcgacgtgagtcaactgtaatcaattcaccatcagaaatcttatcactagcgccaacggcaccaacgataactggaattcccatggaaattccaacaactgcagcatgagaagtcaatccaccgttttcaacgatgacagcacttgacttttcaatagctggcaagtagtccttgtcggtgttcttagcaattaagataccaccttcaacaactttagcatttgcttcagcagccgtgttcgcaatgatggccttaccaatcaccgtgtcgtcaccaacgccttggccttgtaccaactttgaaccgatcaattggatcttcatcaagttagtcgtgccgcgttcgccaactggtacaccagcggtgattaagatcaagtcgccttccttagctaagcccgtttcaacggccttagcagcagctaaatcaaacatttcatccgtgtttgatggcttttcggtaacgattgggtagacaccccagttaaccatcaagccgcgacgagtccggtcgtcaaaggtaactgccaagatatcagcatttggccggtacttggagatcatctttgccgtgtagcctgtttccgtagcagcaacgatggtcttaacgcccaattcgttagcaactcgcgcaacagaagcaccaatagattccgtaacgtcaccgttgtcgaagtctaagttatcacgaccaaagtccttcaaagcattttcagccttgatatcgatccggttcatcgttgcaacggattctactgggtattcaccgttagcactttcaccagaaagcattgttgcgtcagtaccatcaaagacggcgttagcaacgtcagaagcttcggcacgtgtcggacgtgggttttcttgcattgagtctaacatttgcgtagccgtgataactggcttgcccaaaatgttacacttcttgatcaaagctttttgaaccaaaggtacgttttccgttggaatttcaacacccatgtcaccacgagcaaccattaaaccatcggaaaccttgatgatatcatcaaagttgttgataccttcttgagattcaatcttagggaagatttgaacgtgttccatgtgcttttcttcgaggagttcacggatgtccatgacatcttgtggcttccgaacgaatgaagcagcaatgaagttaatttcgtggtccaaaccaaaacgaatatcgtcagaatccttttcagtgatcccaggtaagttaatggaaacaccaggtgcgttaacacccttacgagaacctaagacaccatcgttttgagccgttacgattaattccttagttgcatcgtctttcttatcaacgaccgtgtccaacaaaccatcatcaaataagacgtggccgccttcgtggacatcatcgtacaaaccagggtaagtcacagcgatcttttccttggtcccttcgagtgaatcgtccatagagatccggaattggtcacccgtcttgaattggagcttgccgcccttttcaaccgtggtccgaatttcggcacccttcgtatctaacatgataccaacggtcttaccggtaatcttttcagccttgtggacattttccaaccggcctaagtgttcttcgtggtcaccatgtgaaaagttgaaccggaagatgttggcgccagattcgattaacttaacaatcgtatcaacgtcagtacttgcaggaccaagggtacttacgatcttggttttcttcataagaaaaatctctcctttaaaattggcacggaccagtctgtcatttggctaaaaaccgcaacacaaaagtccggcacaaatttgattccaaaatcattctatcacttttgaatttcgatgtcgcctttgtttgttaattttttagcgtttgtttgaattttctcaaagtaagcgttttccgtcaagacttcttcccagatttacgcaaaaacctgctgattcaataattagcaggttatagttgttagttttttattgtttttcagccgccggaactggaatactgaatcccaaggcagcaatatcctgatcgaatgttttcactgtatctagtgaaactgtttcagcatcagtgccaaatttctgcaattttgccaaaatcttgggtggcaccgtaataatgtcacagccagtttgatcggcctgaacaatgttgaagacttcccgggtgctagcccacaaaagttcaacttgggcctttgtatgacaaatcgctgccgcctgccgcatcaatggtaacggatcaacacctgtatcggcgatccgaccagcaaagacggacacaatgccacccgtcgtctcctctaaggcagcaactgctaatttcacttgggctaaagtggtgatcgccgtcacatttacttggacgccagccattgacagttcatgaatcactgccgtattgtcttcaccagttgcacgaataatgggcactttgacggcgacatgttcgcccaatccggctaacaccttggcctccgctaacattctctctggtgtattgccaaagacttcaaaactaattgatcggtctggaaaagtcgctacggcctcacgagcaaaggccagatagtctgtgattcccgctgccttcatcaagctggggttagtagtaaagccctgaatattctcctgttcggcgatggctttcatggcagataattctgcgccatccgagtagactttcacgtttaattgcattaaaaaatacctccagataagacttcttgtgattggtacaatcatactaaagccttgaacaatagtccagaggtatttttatctaaattggtctatccatttttaaaaatagcatttcctgttcccatcaaggcttctaaagtcaccttcagttgtgcatccgcctgcaaccactgggttttcggcaaaattcgcttctcatcggtctgcggttgatatacgataactggtactggtcctcgatgcgccgttagaaattgtgccagttgctgggcaattgcccgatcagtatgctgctggtcgactcgaatgaaccaccgcgcaccagccggtaacgttggcgttgtgtgctggtcggcaaccggcttaacgggaatctgatcagccagactgacttgatcggccacaatttgtaatccccgctgctgctcaaccttaccgcgcaccacaatcacttgatccgttgctaaccactcgcttatctgccgaaactggttaggaaaaatcgtgacactcacatcggcagtctcatcgctgccagttacaaacaccattggttctccccgtttcgttcgaatctgccgaatcttaatcacataaagcaaaaccgtcacgcgagtattggccgtcaattcactcacggcttgggcctgcaactgtcgacccagttgttggtattgctcaaccggatgccccgacaaataggcccccaaaaccgcttcttcttgactcagctttgtcatcaaatctaaatcaggctgtgatttgattttcggagccagcgccgcaattagttccacattgtctcctgacaactcaacactgctgatgaattccggcaacgccgcaattaattccgctcgattatgaccaaaatggtcaaatgcccccgcatacaccaaagcattaagtagatcggccttccggtatttcgatgcgatccgttcgaggaactgatgcagatccttaaatggcccgtgctcatgccgctcagctaagacttcacgcaagaaatcacggcgaacccccttgatgctacttaaaccaaagataattgccgagtgatacaggttaaaataagctgttgagcggttaatatccggcggtaagaccgttacgccatgtcgtttagcttcggtcagatagaccttcgtcttagcaccaacattaatgacagagttcatcaaggacgcgtaaaaggcggctgggtaatgggccttcaagtaagctaactgaaaggctaacttactataggcaaccgcgtgtgagcgattaaaaccatagtttgcaaaccggtcaatataggcaaagacccgttgtgccaccgctagctcatagccccgttgttgggcacccgccacgaattgtttttgcatggcgtccatcgtttgttttttctttttactcattgcccgccgcaataagtcggcttggcccagcgtgaagccgcccatcacagaagcaacttgcatgacttgttcttggtaaaccaagacaccatacgttgggcctaagattggcgctaaagcatcagccggataagtgaccggttcctgcccgtttttccggcgaataaacgtatcgatattttccataggtcccggtcggtagagcgcattaaccgcggccaccagctcaaagctatccggctggagttggcgtaagacccgtttaatcccagaagattcaaactgaaaaaccccgtttgtctcaccggttgcaaacagctttagtgttgctggatcatttaaatcaatctgattaaggtccacgatttttccagtttgttttttcaccaatgccagggcgttggcaagaatgctcaaattacgtaaccctaagaagtccatttttagcagaccaactgcttcaacggtgtctttggggtattgcgtcatcagtagttcttcgcttccgggctgtaacggcaccaaatcacgcagtggtccctgacttaaaacaataccagccgcatgggttgaatagtgccgcggcaatccctctaacttctgtgccgtcgcaaacaacaattgattacgcgagctatcagcaactaaattacgtaaccgttgtgactgatcataggcccgctgcaaagtgatgtgtagctcggctggaatggccgcactccagtcgctaagctcgtaaggcgccatccccaaaacccggccgacatcccgcaatgcggccttagccgctagtgtcccaaaggtaataatctgagccacccgttcatgaccatatttatcatgaacgtattgcaaaacctgttcccgccgattatctggaatatccagatcaatatcgggcatttgggcccgctcttcatttaaaaaccgttcaaacaacagatcataagccagcgggtccacttcagtaatggctagaacataggccaccaatgaccctgcagctgatcctcgaccgggcccggtttgaatatttgcttgatgggcaaagttcatcacatcccaaataattaggaaataatcatcgaagcccatccggtgaataaccccaagttcatgatccaagcgttgctgataaggcatcgcatcggtaatgtggttagctgttagtcgacgctttagacccgccacgcagcgctcacgcaaataatcgcgggagttctcctgattgggggtcggaaattgtggcaactgcggttgctgaaattgtaacgtcaccgtgctagcagcagcaattgacgccgtcatcgtcacagcagccgtcaatcccacgttagcaaaccgctgggtttcctcggcggccggccgtaaccaatgagtcccttgaacttgctgttcagtcgtcggatcactgatcgtttcaccggcatcgatcgctcgtaacaccgtgaccgcaaaatgatcgtctcgattcaaatacgcgaccggtgataacgccactaacggcgttgtcgttgcctgactgaggctttgtaagtggtcacgactcacagcagtcaaatccggtgacacgccgatggccagttggcccaccgaccagtcatttagctgatggagaatctgctgggccggcgctagttggtcattggctaccaacgtatggatttcactatctaatggggcaatcatagtcagctgactaaggtttttggtcaactgggtcaagtcaactggcccaccgccaacctgatacgccgtcgataattgcatgagttgttggtagcccgtaaaattttgcgctaaaaagacccaatcgtaggcctgcgtggcatcgttcagcccctgtgccgttagcgttagtcctaaaagtggcttaatgtcggcttgtcgacacgcattataaaaagctacggcaccgtacatcacattcttatccgccaatgccagtgcagtgtacccccgcttcttagccgtttggacgagatcatcaatccggttggtgctctgtaataaactataggtgctgaacacctgtaacggtacaaacatgcctgcagctcctttcgtcttcaaaatcgttagtcccattataccagaaaaggcccagtaaacacgctagatgaacaaatgttcgttggcacttgaaaagctcccccagaatcatcaaagattctggaagagcttgtaccgataatctcaaaataactagtaaccggttattgtttccctacttcactttactgtgcatcagctgctgcttgcggggcatgggtgaacgttaactggtcgtcagcaacatcaatcgtaatcagactattggctggaattgtgccagcgatcaattcacgagccaatggtgtttcaacatgggtcgtgataaaccgttgtaatggccgggccccataagctggcaggtagccggccttcgcaatccacgtttgtgcagctggcgtaatggtcaagtctaactgctgttcgtgtaggcgagtggcaaggtgatcaatcagtttaactacaatttgttcaacatccgctaaggacagtggggtaaacataatcgtttcatcaatccggtttaagaattctggccggaaatgactttggagcaattgggcgacttgtttcttagcgtcctcactaatccgaccctggtcgtcagttccttgtaacagcaactccgatcccagattagatgtcatgatcaaaatcgtattcttaaagtctacagtccgcccctgactatccgtcaaccggccatcatctaagacctgcagtaacaagttaaagacgtctgggtgcgccttttccacttcatcaaacaaaacaatcgtgtacggattacgccgaacggcttccgttagctggccgccttcttcatagccgacgtatcctggcgccgcgccgaccaatcgtgagaccgattccttttccatgtactcactcatgtcgattcggaccatgtgatcttcactgtcaaataagttttcagctaaggctttcgctaattctgttttcccaaccccggtcggtcccagaaacaagaacgaccctaacggtttggttggatcttgtaagcctgctcgtgaccgcaagaccgcatcagccaccgccgaaacggcttggtcttgaccaaccacccgttcatgcagatgatcggccaatttcaacagtttctcacgttcaccttggaccagtttcgtcacgggaataccggtcatccgacttactactgcggcaatctcgttttcagtcactgactcggagaccaaccaatcttgttgctgatcggtttgctccaaatcggctaattccttttccaattggggaatcgttccgtgttgcaattcggctgcccggtttaagtcataagccgattcagcattttccaattcacgtttagcctggtctaattccgttttcttgtcacctaattgcttaatcgccgacttttcttgattccaccgcgcactcaggtgatcgaccctttccttcgtatcggctaattctttctgtaggtcactgagtcgttgtttcgaggcctcgtccgtttcttgcttcaatgccgtttgctcaacttgcatccgcatcaactgccgccgagcctgatccaattccgttggcgccgaattcatttcaacacgaatcgaagcggaggcctcgtcgacgaggtcgattgccttatcgggtaagaagcggtctgtcagataccgatcggataatttagcggccgcaatcaaggcattatcatgaatcttaacgccatggtgaatttcaaagcgttcccgcaatccccgtaaaatggtaaccgtgtcagctacgctcggttcgttgaccaatacccgctggaagcgccgttccaatgccttatcctgttccaaatattgacgatattcgtctaacgtggtggccccaatcaagtgaagctcaccgcgggccaacatcggcttcaacaaattaccagcatccatgctgccttctgtcttaccggcacccacaatgttatgaatttcatcaataaacatgataatctgaccatcactcttggtaacttctttgagaactgcctttaatcgttcctcaaattcaccacggtacttcgccccggcaattaaagcccccatatctagagagaaaatcgtcttatctttcaaattatccggtacgtctccacgcacaattcgttgcgccaagccttcaacaatcgccgttttaccaacacccggttcaccaattaaaaccggattattcttggtcttacgcgaaagaatccgaatgactgaaagaatttcatcatcgcgaccgataatcggatcaatcttaccactacgcatagctttgactaaatcagtaccgtacttttctaatgctttatattgatcttcttgattcttagacgtcacccgttcacctccacgtaagtcatcaactgctgcccggagtttcttttccgtcaacccctgttgtttgagataatccgtcagcgcttcaccgttcaattgcatgacggccagaaccaccgtatccaaagccataaaatcatcgtgataggcgtcacgaatctgatcggccttttggagtaattcggttaaatttctagagaactcctgaccatactgcacgccactacccgtgaccgtgctaatactatcgagttcccgatcgagttcgtgatcgagtgccgtcacatcaacacccgcgtcttgaaaaagttgccgggctaattcgccgggctgaacaagaaatttaaacaagtgagccacggtcactgcttgatgctgacgtgtgaccgcaatccgctgtgcttcggctaaagcacttgttaaagcttctgtcattttttctggattcatatcgagtccccctcagttagtttttcgttaattttaagagtcataaaaagaggtaaccaacaccggcaacctccttcttcatgattcattctaactgatttaaacgagaaatccaaataatttgaccttttttgaccaaataatttaagcccgctgttccgccaattccgcgatcttaataatcacatcggtcgcttgttccatggtttgttcagacacatattcgaaccgaccgtgcatgttctcgccaccggcaaataagttcggtgttggcaagcccataaaggagatcttggacccatctgttccaccacggacggggaaaattaacggtttgatgttaagagcctcgagtgcatccttagccaagtcaaccaccgtcatatccttttcgatcacttcacgcatgttgtagtactggtccttgatcgtgacctggacccgttttgacccatattgttggtttaattggtcggcaacgccttggaagagttgcttgcggtcctcgaaaatttgccggtcatgatcacgaataatatagctgagatgggccgtatcaacgtctcctgtcatgctatataagtggaagaagccttcacgaccttccgtatattctggacgatcgtgttctggcaatgcagcatggaagtccatggctacctgcgatgcattaaccatgacgcccttggcctcggctgggtgaacattggtccccgtgatctcaacctgagcatccgcggcattaaaggtttcatattcaagctgtcccaagggaccaccatcaactgtataggcaatgtctgccccaaaatcggccacatcaaagtgatcagcccctgtcccaatttcttcgtcaggccctaaaccaatcttaatctcgccatgcttgatttcaggatgagccaataagtattcggccgctgccatgatttcagctaccccagatttatcatcggcccctaatagcgtttgaccatcagtggtaatcaacgtatgcccagcgtaattctttaaattaggaaaaacagctggatctaacgtatacttaccagcttcatccagtttgatgaccgattggccgtcatagttttcaacgatttgtgggttaatatgctcactgttaaaatctgctgtatcaaaatgagaaatgaatcccaattttttaactgccttatctgtattagccggtaaggtcgcaaaaacataagcggattgggcattgatgtgtacatcagttaatccgattgcctgtaaatccgttacaagcccttctgcaaatgctgtcaatcggggcgttgatggaattgtcgtcgactgcggatcagaccgcgtattaatttttacatacttcaagaagcggggaatcaagttgtcatactttgccaaaataaatcactcctcaatatttaagctacttacttccaatcagtttacctgttttgccctttaaagaaaagtaaacgggtcggtgtttaactgcgaagcctgcaccgttatcgcccagttattttcctgcgcccattgctggaacatggccgttaaatgtggcttacaaatgctttcaatatggtgaccgggatcaatgacattcaacccagccgcaatcatatcgtgaccgggatgataggaaacatcgcccgtcacataaacatcagcgcccttagccagcgctgctgggtaaaattgtccaccactaccaccgagaatagcgactcgcttaactggcgcttctggcgtgtgggtaatcagccgtaacccgtcaacgtgaaagtatcgtttgcaagctagggcaaactcacggacggtcgtcgtttccgacaaatcaccaatccgccccatcataatttcggacgttgccccaaccccattactaggaactaaacccacgcattgttgtaagcctaaagcagcggctagccaatcattcatccccccgggtgcactgtctaagttcgtatgggcaccgtataccgtgatgtgatgttgtaaaagcgtcgcatacatctggttttggggaatcgccaagtctaaatttttagctggtcgaaacatcatcggatgatgagcaaaaataaagtctgccccgatctcaatggcttcggccaccacttctggccgcacgtccaaggtgaccaagactttgtggaccggtgcatctaatcgccctaactgaaggccaaccggatcgccgggctctgcccatgactttggggcgaactgctcaaaccgtgacactaactcacgcaccaacacgttgcaagacctccttaatttcagccaattctgcttctaaagccgtcaccttttcaaccggaaccgccttagctgaacgtacctgttgaaggactgcttctgtccgggcaagttctcgttgccatttcgccataaacgtcgcattgtgttcagctagtagatacggtccaaagcgtagttgttcagccgtatattgttgtggttgggcctgtctatcggctaccaagatttcataatcatgcccatcttcactgacaatttcttccgcgacaagttgaaaaccgtgcgtcatcaagaattgccgaacgtgccattcccccacattcggttgcaagatgaggcgctgcaccccggccaagcgctcaaagtcttgcgtcaaaatttgcgtgatgagcgttcctcccattccagcaatcgcgactgtatcgatctggtcatccgcctcaatggcctgtagcccattcgccaagcgcgccgtaatctgatgagccacgccctcacgttcaatctcatgcgcggcattttcaaagggacccttaacgacctcgccagccacaccgccagcaatcaacccccgttgtgcgagattaacgggcaagtaggcgtggtcggtcccgatatcagctaaccgactgccttgcggaacgtatttggcgaccgttgcgagtcggactgatagatgttgtgcatccataaattttcttcccttctgtttttctcattaccttttagtataagctagtcacgtaaaattggatagcggaaccactaaaaaagccagcaccaattggcactgacttctttaacttagcttatttttgctgacgacgcgtttgcggttgatcatcatccgttgacgccgttgcttgccccatcttagagtaaggataagggtacgtaatcttcataacggctggcatgacaatcggtaaaagaataatcaacaagacaatccccaaaatcacggccaaggcaatttgaatcaaggtcatcaccccagatggaatcaatgcagcgaatgtcccactcaaaataatcccggctgaaatgaccaccgtaccaataaccgttgccgcatgtaacattttatcactcgtcgcacccggttcatgaagactttcacgatacttacgcatcaagaagatcgagtaatcaacccccagagaaatcaacatcacgaatgtgaagaatggcgtgttccatgtcaacatattggtccccaaaattggctttactagccagtgcactaacgttaaggcaccagagtaagcgactagcaagattccttcgatcacaattggttgaaccagagaacgggtaaccaccatcaaggccacaaagattccagctaacatgataatcacagtccgcgtaaagtcactagaggccatcgcagacgtgtcgttagtttgcgacgtattgccgccaaaggcaaccttagcaccgctcaagctggttccttgcaggcttccattgacaattttttccagcttaggtagccgcgccatggctgccgctgaacttggatcgtccttcaagacaaccgtcagcttcgttagcttgtggttcggtgacatgtaggtgtccatcgattgcttaaatgacccgctgttgatcgacttcttcggaatgtagaacgtttccgccgcagccgacttctgtaagcccttaaggtaggtattggctgtcccgacaccggaagaaaccgaactcaaaccggttgttgcagcagataaacgactccgcattttcgttaacttcttattcattgaggccagctgctctgccattgtttggttaccagcggcaacttggctggcaccactcaccagtgcaggcatcttgttgttaatcgtgaacatcgccccagacaacgaacccagtttagaagatagctcacttgtctgtgaactagcagatgacaaggccgttgctgcacccggcaacaccacgttagatttttgcgccaacgtcgccactgatgactgcaattgtgacgtcgtaccttgcaaggtttgtagttgactagccacgtttgtcgttgacgtcccaatattagacgtatccgtagccacctgtgataacgatgacttcacggaagctaataaactagcttgggcagatgcctgttgcttcataactgactgtaaaactgctttttgtgtcgctgataatggtgctccagcggaactaaaagcttgaaccgctgttgcgtacccattaccagaactggctgacgcactagcgaccaagtcttgaaccttttggagttgtgacttgatatcctgagcggaactcccaatgttagttaagccgctcgtcacaccactggtactgcctgacgcactgctgttaacttgcgcactaagctcttgaatagctgcgttcaattgtggtagcgctgcctccagttgtgctaatttagcttgttgtgaggaactcgtcgcaccagccacgctggtattcatttgactaacacccgttgtgacttgtgaaattcctgtctgtaaggtcttcgtcccatcactgacttgtttggcacctgtcgccagcttctgggcctttttcactgatccagagacatcttctttgcttaactgactattggctgactttagccctttgttaaccttattgacacctttttgggccttaactaatcctgtagttactgaactcatttggttccgaacatacaattgcttaatggctttcccaccaggctgcgtgacggacgccaccgtcttaaccccatctgcattttgcagttgtttggtcagacgatcaatgagtagtaaggatttttcgttatttaacttatgatcactttggatgtaaattgtcgttggttccgcggttcctttggagaagtgcttttgcaccacgcgtaacccttgcttagccggcacattattgccaatttccactgtatcatcgtaatccaacgtcccgtgagacgccagtgcaagtggaataaagacaattccggcaacgatcaacgtaatcaccggccgaatcatcgcgtgcttagccataccatgccagagacgactgtcgccttcaccagagaatttcttcactggccagaacatgtgtggcccacagattgccataaaaaacggattcaatgtcagaagcacggccaacaagaccacaaccccaacggcaataccaacggctgaccgatacaaggagaagttggcaaaacccaacacactcatcccaattaacacggacaacccggaataaagaaccgtacgaccaccaatcttgatggcctctttggtcgctgagtagcggtcttgcccgttggctaaccgctccctaaactcgttgtagaggagaatattatagtcagtcccaatcccaaacagaacaatcacaataaagacttgggtgaagttagagaatgggaagttgaagcggtcaactaagtttgccacaacagaaatcgatgtaatcacggatacgccaaccgttaacaacgagaagagcggtgtcactggcgatctgaatactaaccacaatactaagaaaataaaaattgccgcaataatttcagtcttttgcaccccggcttgcgtggcatccgagaagtcttgatttaaaacatcggcccccgttagatacgtcttcaccccatcagtcttagctaattgagtgatttggtcacgaatcgaagtgattgaatggcttgacgacttacgcacgttcaactgtaatagttgcgtactcttatctttagagattagttgggaagcagcagttgaactatcactagctgccgtcattgaccggatttgataccgatcctcatgattcttgatccgtttaatggtcttatcaatttgcttattttgatcactggtcaacgcggtattaccgttgctaaaggccactacaacagccgtggttccccgttgtgaacggccccacttcttttgcatattggttgcttcggtgctttgataattgctgggaaccgtaatctgacccttatcagccaccaatttactcatgtttggaatcgtcaggatggctagcaaaacgatcaccaaccagccaatcacattccagatgtaatgtttgttcatccagcgcacaggaaaatacctcctaaataattaattaaactaacttctattctactgtttatcgagttaaccaggttgtccaatcaagttctaggggttggttcccatttgatggcagaatgtcaccaatggacaacgtcgctagctgctgtcgatattgcttctccgccgcaccaaacgttgacagcacgttggcgaccgactgttcaccgtggagattctttaacccgtacatccgcataaactgatcacgctgttcaaaatcaaatagtcgtttaaccagtccagtatttttcacaaaggactgcggtccctcaatcgcatcaaaaatgtctaataacgtaatctcatttggattacgggtcaggacaattcccccaactcgaccagatacagtcttaacaatttttcctgcggccaatcgttggacgattttcttcaaatagctggttgagatacccaatcgttccgccaccaatgaactatgtaacgggatttgacgatcctgaatccccaaaaaagtcacaatacaaagtgcttgttcaagactcggttttgctttcaaagggcccctcctttcccaaacatgacgaaccttgccaatttcttaaacgagatacattatatcccctttagataatttttcaagacttctgacgcaataaattaatgcaatcacggttatttttttgtgtaagcgatttcacttcttttgacgcttcctcatctatttctggcttagccgtcaccagtaataaaaaaaagcagccaccctagcggtagctgcttttacaaatctattccaaaaagtctttcagttgtttactgcgtgatgggtgccgtaatttccgcaaagctttagcttcaatttggcgaatccgttcccgggtaaccccgaagactttacccacttcttccaacgtccgcgtccgaccatcatctaggccaaaccgtagccgtaaaacattttcttcccgatcagttaacgtatccaaaacgctctccaattgttctttcaacaattcgtaagcggcatggtcagctggactggtggcatcttggtcttcaataaaatcacccaagtgagaatcatcttcttcaccaattggcgtttccaaagaaactggttcttgcgcaatctttaagatttcgcgaaccttttccgttggcatatccatttcggccccaatttcttctggcgttggttcacgtccaagatcttgaagcaattgccgttgaatccgaattaacttgttaatggtttccaccatatgaacgggaatccgaatcgtccgagcttggtcagcaatggcccgtgtaatcgcttgacgaatccaccaagttgcgtaagttgagaacttaaaccctttgcggtagtcaaacttttcaacggccttcatcagccccatgttaccttcttgaatcaaatccaagaactgcattccccgacccacgtaacgcttagcgatagaaaccactaaccgtaagttggcttccgctagttcttgcttagcggcttcttcaccgttttcaatccgtaaagccaatgcgacttcttcgtcggcagtcaagaggttgacgcgcccaatttcctttagatacatccgcactggatcgttaatcttaacgcccgttgtcgtcgaagcatcttttaattctttcttagaaacggccttttgagctttaaccgcccgtgcgtctggctcacccttagcatcaaccacgctgattccggcatcggaaatggtttcaagtaacttgtccatttgcttagcatccagtgtgtacggtgttgccaccttatcagttaagtcatcatacgtgatgtgacccgcctttttggtgtccttgattaaggcacgtaccgtcttgttgtatgctttttggtcaaacattggttgatccgtggttttttttgccattaaaataccccctagactaaagttgcttgttcgcttggcgttgtcgctccaattgaacaatctcaatgactaactgccgttgttgctcggcatcacccaatcgtgaggcctccgccagttgatttttcttctggcggagttgttcatcgacgggcgcttcattcataatcaccgctaaatagtcatcgatctcacgtggggtagccgccgcatgagtggttgtttctaactcgatgactaattgctgtagccggtcttcttgaatgaagtccgtaaactgcgcggtttgatacgtttgatgcgtttggaaataaccttgggccaaggtataaatcacttgataatcatcgtgaacgaagcaaaagtcagcaacactgctgactttcgcccacacatttcgatcgtggagcaaatgatacagcaagttccgttctgcccgttctaagcgggttaacggccgctgttgctggtaaaccgttactggcggagccacaggtgccttttctggctcccgtggtcggtcacgctcagcttgcgctgctacatcccgctgagtttgttttaactgtgccaatagggctgacttatcaatcttaaactctgtcgccaattggttcaggtaaaggtccaattcgaccggttcttgcacctgtgccaaaagtggcatgacctgattcacataatccaagcgctccgcgtccgtatcgagggccttatttcgccgcaagaatcgtagttgaaacttaattggcgtctctttggcggtggtcatcatttgcttaaaagccacatccccatgcgcttgtcgatattcatcgggatcttgaccctctggtagttgaatcacacttaactgcaagtgactgtgctgatttaacaggcccaaagcccgtgagatggcccgttgaccgggctcatccccatcataacaaacatttaacttgtcagtcgtccgctcgattgcgtaaatctgttctgtcgtcaagcttgttcccatcgaggcaatcccgttacgaacccctgcttgagtcgcagaaataacgtccatgtatccttcaaacaacgtcacttcacccgcctcacgaatagcgggacgcgctaaatcaaaattaaataataagcgactcttattaaataacgtggtttcaggactgttcaggtacttgggctgattgtcggctggttgcattagccgcccagaaaaggccgtaacgtgtccactcgcattgcgtaacggaaacatcacgcgttcagtaaaccgatcccgtagttccccctgcgcattttcaataaagagtcccgattgccttaacagctggtagtcactgttacgctggtcaaaaaacggtttgagtagccgctgacccggcgcaaagcctaactgatatgtttcaatcgtctcatcagtcagtccccgttggtgcaaataatctaaagcgggctgccccacctccgtattcaccaaaatatggtgatacagcttagcagcttgctcctgtaatgcaatcaattgactggttttggaatcgactgccggtccctgggcatcctgacgatattcactatcaaggtccacatgactaaaatcagctaccttcaccaccgcttcagggaacgtcacgtgttccaattccatgagaaacttgaacacattaccaccacgaccgcaactaaagcaatggaagatttgtttgtcttctgcaacggaaaatgacggtgttcgttcctcgtgaaaggggcataacccaaacaggttcttccccgactttttgagttgaacatattgaccgaccacatccgcaatgttcgtggccgttcgcaccgtttcaatcacgtcttcgggtatcttcgccaagccatcactccctttaccgtggatctcatcgcgcccttagccttgaaaagtcgcaccccgggaacccgaaaagtgcgactctttaattggaattcgtgcacaaaaatacaagttatatgatagcacataaatcccgattgtccaattaaaagctctcggttttacttcacaaccagttgatccaaatcccccaatgccaatgctaggtcagctaaccgactcaattccgccaaacggttattccgaacagcatcatcttttgccattaccatcgtggcgtcaaagtaagccgcaatgactggttggatatcagctaaggctgtatataaggccgttaacccgtccttcgctgccgtggccactgttgcgacaccttgatgtaattgcccttcactgtcattttcaaacaatgctggatcaactgtcgtggcggccacttcagcgggtgccttttgggccaaacgaatcacccgcgtcaaggattcaatcacatccttaaagttggcatcgtcagcatgactcgccaaaatatcggctgccgtaaagatctgtaagacatcactactgctaccggccgtcacggcatcaataatatcgtgacgttgcttagcagaacggagaatcttccgaatccgatccttgataaagttaaccagcgcgtcaatttgtccagcttgatcgagctttggtgcaacattggccgtcgtctcggctgcaacaaaggcctgtgccaagtcagctactggtaaggaccactgttggtcctgagcaatccgcacaatcccagttgcttgtcgccgcaatgcgtaaggatcatttgaaccgctcggaatcatgccagcggcaaagaacgttaagatgctatcgaatttatcggctaaggctaatacggcaccggggacagacgctggtaaagcgccatcggcagagattggctcgtaatgttcacgaatcgcttgagccacagcgggatcttcaccttgaagtaaggcgtatttttcacccatgacaccttgtaattcagcaaattcgccgaccattccggtaaccaggtcaaatttatagatttcactggcccgcaatacggccttagtctgggcatcgtttaacccaacgtgcttggccaaaaccccagcaattgctttaacccggctcatcttctcagccatcgtactgatcttatcatggaagctaacagtcttcagccggtcaacgtaatcagcaatcgtcttcttctgatcttccgtatagaagaacatggcatcttctagtcgcgcagtcaggaccttttcgtttcctgaaaccacgttttgtaagtcatgatcgttcccattacggaccgaaatgaacgttggcaataattgcccttgtgcatcccgtgcatagaagaaccgctggtgatcacgcattgaggtaatcaggacttcttctggaatcgtcaaatacttttcatcgaagctgccggcaaaagcagttggccactctaccaagttgttaacttcttctaacaagcccgcatcaacgttaaccgtccaaccatgatcggcggccagcttgtcaatttgagttttaatcatcgacttacgcttatccgcatcagcaatcacaaactcactggtcaagtcaccttcgtagtcagcggccgttgcaatcgatatgtctttgcctaagaagcggtgaccacgggtattacgatccgttgtcacatccaagatactaaacggaatgacgtcggcatctaacaaggctaccagccaacggattggtcgaatatattggaaatgatgggtgctccacttcatcatcgtcgggaaagtcatggctgtgatgacgtccttgagtccagccaaaacggtagccaccggttcaccggcaataaatttatcgacgtaaacgtactcggtacccttaatttccttaaaggtaatgtcatcggtggtcaaaccttgaccacgagtaaacccaattgcggccttgctccaattaccctcagcgtcttgggcaatctttttagctggtcctttgacggattcgctaatatcgcgttgcttgtcggcaagtcccgtaattaagaccgctaaacgccggggcgttgagaatggtttgatctcatcataatcgacgcgttcttcttttaggtaatccgccgtccgcttgaccaactgcttaatggctggtgtcacgacgtgtgcgggcatttcttccagcccgatttctagtaaaaatgtgtgtgccattatttggcctcctcatccgctaataattgttggcgtagcttttcatccttaaccagtgggaagccgcgcttctttcgttcagcaacgaaagcccgcgcaattgaacgtgccatattccggattcgtgataagtagccggcccgttcagtcactgaaaccgccccgcgggcatccagcaggttaaatgtatgactgcacttcagcacatagtcataggctggatgtaccaaaccattggcgatttgctttttggcttcatcttcaaattcatcgaaatgccgcaataacatgtcttggttactttcttcaaaactatacttagaatgttcgtattctggttccttgaagatatcaccatacttgacaccatcggcccattccaaatcaaagacggagttaacgtcttgaatgtatgaggctaatcgttctaggccgtaagtcacttcggacgtgacggggtcaacttccatgcccccaacaacttggaagtaagtgaactgggtgatttccatcccgtccaaccaaacttcccaaccaacaccggcacagcccatggatgggttttcccagttatcttcgacgaaccgaatatcatgttccaacggatcaatgcccaattccttcaaactattcaagtaaagctcttgaatgttgtcgggagagggtttcataattacttggaattggtgatgttggtataaccggttcgggttttccccgtaacggccatcggctggacgccgggaaggttcaacgtaagcggcgttccagggttctggaccgatcgcccgtaaaaatgtgtaaggactcatcgtcccggcacctttttctgtatcgtaagcttgcatcagcatgcagccctgagcggaccaatactgttgtaacttcaaaatgattgcttgcatggacagtttttctgtcataggtgcagttcctccttatttaacaaataagcgcaaaaaaatccctacgagaattcaccgaggcaaattcacgtagggacgaagttttaatttcgcggttccaccctacttctaatcgatcaccgattagcagcttacttggaaacgactccgaatgtgccaacccacagcaccaattattcggctcccactctcccgaactcgctaagaatcaacactatgtttctcattcatcataatcgacttatttaactgagttttatgatagtcgttccccacagggttgtcaatggtcagtcggtggttttaaccgtgcagaccacgattgcatttggtccaagaaacgcttgctcttgggatgaaccccaatctggctgtcatagatttcatccatcaattgccgcaaagcatgttcagtctgcggtttgaccttaatcgtatgcagccgatctaaatctaagaccaagaactgacgaagatagtagatggtccgctggctgacatgcaaccgtcgcgggtctagcgtccagtgcgcctgacataaaagaccgccatagctttctgagtagtcaaagggcaaatcattacgcccacagacggcacaaccttgcaattgtggcgccactccaaaggccggcattaattgaatttccatgatattggtaacaatcgcggcattgacgccatcatcaattaacgtcaatgcccgttgcacccggtggtaccagtctggtagcggctgactatccggaaaagccgtatccaccaagctcatgatatacgtagcgtaagcattcttaaaaatatccgcgctaatatcttgaaattgccgcgtttcacgggccgttcgaatgtaggacaacccgtcatccgcaatatcgccaacgtagctaccaaccgtaaacggcaagatatccgccaccatcttgaagccccgtttcttagctcctcgaaccaaaaacatcttcttgccaaactcttgcgtaaaaaacttgattaaaaaatcacgttcagcataatcacgtcgaaacaacaggatgccgtgaaaatccgttacatttcgtgccacccgtcatccccactttcttgtcttacagatcgtcacgccgatagccgtaagacttcagcaacgtggatttgtcccgccagttgggctgaactttcacccacaattgcagatagactttgctacccaacaggtgctcaatatcctgacgggctaatgtgccgatctttttaagcatgctaccgcctttaccaatcatgatacctttttgagttggccgttcaacgataatcgttgcctcaatatgcacgtgatcctcatctttttgcttcatgctttcaatctcaacggcaactgaatggggcacctcttcacgcgtcaacataaaaattttctcgcgaatcagctcactcacgacaaaccgttcgggatgatctgtcacttgatcggctggataatattgcggtccatttggcatttgttcaactaatcccgttaacaattcatcaacgttattaccttccaacgctgaaatcgggtacaccgctttccaaggaagtgccgtttggtattgctccatgaccggcaataaatcatccggtttaacttgatcgatcttgttaattaagagataaactggggcttttacgttctttagccgatcgatgataaagttgtcaccggcaccccgcttttcagccgcgttcaccataaatagcaccgcgtcaacttcgtttaaagcagacatggctgactgcaccatataatcccctagcttactcttcggcttatgcacccctggcgtatcaataaacacaatctgggcttcatccgtcgtataaataccttgaatcttgttacgggtcgtttgggccgtatttgacatgatcgcaatcttttggccaattacccggtttaaaaacgttgatttccccacattgggccgacccacaatggccacaaaacctgatttgtaatctggattatccataatttcctcctagaaccagcggcctagcgctggtaacatcacgagcgccccaactatgaccgcaaaaagagccgccaataagacgccacctgcggccacatccttggcccgcttcgctaactcatgatacgtttgaccgacaactaggtctaccaccgcttccacaatggtattcaatgtctccgcaatcagaaccaagaagatggccagcattaaccacagccattcattaatcgttaattgcaggcttaagcccgctatcacggccaaactgccaaacaagaggtgcttgcgaaaattacgctcgtagtgaaagagcgcctgtaacccttctaacgcgtgccctaatgattggcgaaaagcacggtttttaccggtttgccggtgcttatcgcttgaggccataagcatctaaaatatcggcttgcaacttaaacatgaccttctcgtcttccggttccatgtgatcatatccgttcaagtgcaagaaaccgtggaccactaagaagcccagttcccgttcgtaagagtgtcccaaatagtcagcctgttcggccactttatccatcgacacaaaaatatccccgatgttttctggaatttcggctgccaattcatcatccataaccaacggaaaatccgcagcttcctcgtcatcatcctcaatcgcaaaactaatgacgtcagtagcgcgatcaactccccggtattgttgattaatccgatgaatatcttcattgttcatcaacgtcacggacatttcagtattgtccgctaatttcaagtattttccagcatactgcaaaacatcttgaatcaggtttacgtgctcagccggcacgccatcttgggtcttatcgtaaatctctaaatccattattttttagctccatttggtttagtttcgtttgcttcgtaagcgttaatgatgctggcaaccactggatggcgaaccacatcatcggcgctaaaggtgacaaagttaatatgtgccacgttttgtaagatatgttgggcttgaaccaaccccgaacgcgtattgtgcggcaaatctatctgtgagatatccccgttgacgatcattttagaaccaaaacctaaccgcgttaagaacattttcatttgcatattcgtggtgttttgggcttcgtctaagataacaaaggccgactccaacgtccgtccacgcatataagccaatggggcaatttcaatgaccccacgatccatcaatcgcgtcgtatgttctgcacctaagatggcgtacaacgcgtcgtagattggtcggagatagggatcaactttttctttcaaatctcctggtaaaaatcccaaactttcaccggcttcgactgctggccgggtaataatcagcttctccacatcgccgtgttttaaagcagagaccgccatcactacggccagataggtcttcccggttccggcggggccaatgccaaaggtcacatcgttatgtttaattgaatcaatatattgtcgttgaccaaagttcttcacccgtaccggacgacccttggcgtcattgattaacgtctccgtgtacagatccttgaaatacgtcaaggttccccgatcggccatcttcatggcactgacgacgtctgcgctgttgagtttgattcccttagccaacaaatcactcatattccgtagaatattcagcgtttggtcaacagcttcggctgcaccggcgactttgattgaattaccaaagggcttaaccgtcacattgagtccttcctcaagtaaggtcacaaattgatcctgaacgccgagtaaggccacttcatcttcaggccgttccagaatgtattctttttcaatcgttgtgttttcagtcaaatacggtggctcctttatcgttatatttaaagttattgatagtcaaattttagcataccaccggggattgtaaaagcattcggcgcgaaaagctggccgaacaaactaaatcgagacactttacctcataaagacaccctattgaccagccccgactcatggactttctctttttcaatcccaccactgcaatgaggttcatctcatttaaaaacaccacagccagttagccgtggtgttttcggttattgatttaattgtgctttaacggtttggttgacgagattaccatcagccttccccttaacttggggcataacagcgcccatgaccttgccaaagtcacccatgccgctagcgttcaccttagcaatgctatccttgacaatttgagtgatttcatcggcacttaattgcttaggcgcataggcctcaacgatcttgatctcggcttcgacaccatcaaccaagtcttgccgaccacccttttgaaattcagctaaggattccttgcgttgcttaagctcacgcgataccacggttagttcttcgtctgccgttaaatcatggccttgcttaaccttttcgttggttaaagcggccttcatcatccgaataacgtttaacgataatttgtcgtgggccttcatagcagtcttcaaatctgtattgagttggctttctaaactcatgtgtcttcctcctaaaaaattcaacttattattcagtctacaccttattttcctgagcgtcaggtaaagttacctgctccatttgcaagtgattataatattgtccccagtgttccatcgcttcaatcacgggtcgcagcgtttgaccaaactccgtcagccgatactccgtcttgggcggaatctgcgcataaatttgctttgtcacaacgccgtcggccaccaattcttgtagttgacgagccaacatccgtgatgaaatcgtgggtaaccagcgttcaaaatcgctgtaacgggctacttgttcctgaaataaccggtacaaaatgacacttttccatttaccagaaataatttgcagcgtgctttctactgggcaaccagcgacacagtcgtaaaccttacgttgcatgctcatctcatttcctctctttatcgtgaatgtgttcatcatacgccgttttccagctaaagacgaccgttaacccttacttacatcagtgttagttactccctaaaactgcaggattgtttttagccatcaattgggctacgctagcaccatgtttagaaatgaaaggatgatttttatgacgatgatgcacgcaattggttttgaccgccatttaccaattgaagacaatcatagtttcttcgacgtcacggtaccgcgaccggagcctaccggacatgacttactcgtccagattatcgcaacttcagttaatcccgttgatacggctgttcgccggaacacggtgggcatccttgagcaccccaaagtgattggttgggatgcttacggaatcgtcacggcagtcggaaacgacgttcatgactttcaatctggtgatcgggtcttttacgccggatcgttcaaacgatccggtacggacagcgactatcaactagtcgacgagcgaatcgtggggcatgtacccacgtcactctcaccggccgaaattgccgcaatgccgttaacctcattgacggcctgggaagcactctttgaacaaatgcatctggacattgatcaccctgccgacaatgccggtcgaacgttactggtgattaatggcgctgggggcgtaggctctgttgccacgcaattggccaaattagctggactcaccgtcatcgctacggcctcgcgcccagagacaattgcctggactaagcagcacggtgccgaccatgttgtcaatcatcgacaagatgtggtcgaacaagttcacgcactgggactcgatacggtcgattatattttggaacttagtaatctcaaccaacattggtccgaaatcgttgacctcattgcccccagcggaacgattgtctccattaccggtagtaacactcccattgatctgcgcgccttaaaacaaaagcgggccacctttgcttgggaatggatgtataccaagtcattttatgaaacacccgacatgcagagccaacacgccatcttggaacgagtacggggtttgctagatgccggtcgcttgcaatcaacgttgaccaagacattgacgcctatcactgcagctaatctacgccaagcccatgctttggtcgaatctaaccgaatgattggtaaagtggtgcttactaatcagtaattcaccacaaaaaagcctcaaggccaatgaccttgaggttttttcatacttgcaaaaagagcttagaaacgcttcttcttggctttacgcttacgcgcagcttctgattttaactttttcttcacacttggtttttcgtaaaattcacgtttacggtattcttgtaaagtaccgctacgggaaaccgtacgtttgaagcgccgaagagcgtcgtcaaaagactcgtttttgcgaacgactgtctttgccatataaaattccctccctccgagcacaaataataacgccggttaaacattgtccaccggcgtaacggttcttaactattatacataaacacacaaacctcgtcaataacgcaggcaaataaaatttgaaccgttttatctctcggggtaaactagaggaaaagaccagaggagttactcgctatgcagcaaatgactattttcgtcatctccgattcttccggagagaccgccctaaccgtcgctcagacggccgtttcgcagtacccgaccattcaagtgagttaccaacgtttcccattcatccaaacagattcaattctggatggtattttaaatttagctaaaaaacaacgggcgatgatttttcacaccttagttagccccaaacttagccaacatgtccgtgaatttgctgtaacgaatcatctgcagcagtttgactgtatccaaccggccatggatgtgatgcaccaagcaaccggactagaacccgagggagttcccggactcgtccacaatctcaatgacacgtatttcgaccgaattgccgccatggagtttgccgtaacctacgatgatggtaaagaccccactggtctgttaaaagcggatatcgtcattttaggggtctcacggacgtctaagacgccgctatccttattcctagccaaccggaacttacgggttgctaatctcccgctgtcgcccaaaacgcaactcccagacgagttgtggcaggtcgatcccaaacggatctttggcctaaccaatcggccggaaattctgcgtaaaattcggcaagagcgcatgttatcctatggtcttcctgctgacagtgcttattctgacactgccaaaattacagaagaattagcctacgcgcaaaaattgtataaaaagattggctgtttggtgattgacgtgtctaataaatcaattgaggaaaccgctacgctcattatggaaagtgtcgattacgacctcattccccactccttacaagactaattggtttcaatacattagcaggcagtatcaaataagcacgactttcaaactggcagtttgccttgaaagtcgtgcttattttaattaacaatcgcttttaacgttgaagataagcgtcaaccggaacccccgccaacacatctgcttccaggtctgggttaaactgttgatgcttgagcattgctacttcatagccatgcggattcacaccgtgcttacgatctgggccgataactggcgtttccataattttcggtaccgttgttaactgaggatgatgggccaccgcattcaaaacgtcaaaacctaacgtccctaagccaatattggtatgccgatccttgtgactgccctgtggattcttggaatcattcaaatgtaccactttcaggcgatctagtccgattacatgatcgaactcattgagcaccccatcaaaatctgtggcaatcgcataccccgcatcgctcgtgtgacaggtatcaaagcagactgatagccgttcattatggggagtggcatcaataatcgctgccaactcttcaaacgaccggccaacttcagtccccttacccgccatcgtctctagggcaatctggactggcgactcggccgccgtcaaaatagtatccagtccctgagcaatctgggcaattgccgccggtgccccggcgccaacatgggcaccaggatgaagaacaatttgcttagcgcccaatgccgctgcccgttggacctcagccgtcaagaacgaaatggcaaattgaaaattggccggttttaccgtattacctagattcaccacgtaaggcgcatggaccacaatttctcgctgttcatgggccgccatgaaagtcttagccgcgggaatgtttaggtcttcaattgacttacgccgtgtattttgtggtgcaccggtataaatcatgaagacattctcaccgtactgagcagcctcttgggccgaccccagcagcatctctttccctttcatactcacatgcgacccaattaaaaatggtgtcattttatctcatcctttccgtgcaacatgacctgaacaacctgacggctagccgttccattttcccatgagcaaaatttctcataaaaagcggcctgccgtgcttggtagtcgtgaaaggccccgtcttggcgccaacgatctaactgcgcataaaaagcactcgccgtcgtcaccaatggacccggaatttcttgttcatagtcaaagtaaaaaccacgtaattgatcccgataatgggccaaatcatacgcaaaaaatagttgcggtcgctgcaaattcgcaaagtcaaacatcactgacgagtaatcggtaattaataagtcagaaatcaaatacaagtccgtaatgtctgtctcagccaacacgtggacccgctcttcaaacccgtgaatatcaatggcgtccttcactaaatagtgcggtcgaatgattaactgcgtatttgcaggaacatgctggaagaattccgccaaatcaaacggcagatcaaactgataaacgccaggtcgaactgccatatcatcacgccaggtcggcgcgtaagtcaccacgggacccttagttgatcccaaaagttgctgtttcagatccgtaatctcagccggcagcgtcgtatataaccgatcgttacggggatatccaaccgataagaattgatgatggaatccaaacgctgacttaaaaatcgtctgcgagtattggttaggggcaattaaatattgccaacgactagccgccgtcttaaactcttgatgatacgcagccgtcgtggttccgggaatcgccacatgttcaatgtctgcccccagttttttaagtggcgtcccgtgccacgtttgaatcaccgttgttcgccggttctgatgccaccaatttggcagtcgtgagttgagtacccaaaattcagcccgtgccatcagccacacccagcgtggtgtgaaccgtttgaccagttgaatctggggatactttttatgtagcgcggcaaattcacgtggtttgacactaaaataagccgttgtccggtattccggcgctgtagccactaattcacgataaattgcggctggattatcattaacatccttgccattaaagctttcaaaaacgacttgtcgctgtttgatcggtaaacaaataagcccatcgttcatcacgatgagcccatagcgagcaaccagcttcaatgaccgaatgagtcgttgcaaaccgttagccatttgacgttgctcctttcaattaaattaaatcaacaaaacgtgaacggaacttgtagtgcaagtgagaccccaccagcaaaacaaagaacacaaataaccagaattccaaggtcaacattggatgttgccagaaccagccgctcccaatgaaggattcccgaaaaccattaacaatgtaataatacgggttcaattccaacaaatgcacaaatggtgcggggaatgacgttgtgacaaagttaaacagcacgccagaaacgtaaaataacatccgcatcacagactgtaagaggatatggtaatctcgcacgagcacactgatacaggaatttaagacccctaaagcgactaacaagcaaatcatagcgaagaaatagtaaatccattgcaaccacgctaccttaggataaacgccattcaatagaccaatgaagatggaaaaaaccatcattgtccaaaaggagctaagattgctgacgactttaatcgtgggcaaagcggatactgggaacttcatcttagccaccatattgacccgctgatagatactcttagatgcatccagtgtggcccggttcatgaagaaccacggggtaatcccaatcaccatccatgggaggtagctaacgccattcaacggttgaccgtgttttaaacccacaccgaagactaaccagtaaatcccaatttgaatcaatggatataagtattcccacgctaaacctaaataatgactctgataactcgcttggtcctcatatcgagaaatccgaaaaataattcccaagcttgaaatttgctctttaaataaggtcatgacctctttcaaggcactgcactcctttaattaattggttaacaatgcgacataccggtcaatcacccgctgggtggcttgcccgtcattagcactgttccaatgttgattgaatttggtgaaatctgtcgcggtatccgcgtgaatcgcagcggccagttcagccgccgtttgtaaagctggactcggcaaccactcgaataagtcggcctgaacacctggatcttgcgtgtagaccggcaaatcaaacaagtaaaacaacaagctgtgtgcattggacaataagctatagtcaaacgcaactgacgagtaatccgtaatcagagtttccgtaacggttaacagttcagtggtactcaggtgttgggcaaccaccacctgagtacccagttcttgttggagcctagctgtttgatctgccagtgccggatgcaacttaacaataaccttcgcagctgggtcttgctgtaaggctgttacgagaccttccggtggtctgaaggtgacgccatcccgatacgtgggtgcatacaagatcacccgctggtcttgtaattccggtgctaagcggtacacccgctggcgagttttcgccaaccaagtagcgttaactaaccgatcggatcgaggatagcccaaaatctgcatccgctcaaaagggacgcgataactattggcaaacacctggcccattgctgatgaccccaccacgtagtcatcaaattggttataaactgcttgaaaacggcgctggtcgctcttagggcgccgactcgttgtcggatcatcccagccaaaccgtttaattgctcccgcagcatgccacatttgcacaattcgcatatttttcgggtgccacaacccgcccagaaaggcataataattatcacaaaacaagagacgtgcttgcatcaggctgggaatcccccgccaaacgaagtgcagatcatctcgaaagacacgtgtggtaatcccagcggcggccaagtgggtggctgccgcttcatgctctggtcggtaaaacacaagtaagtcaacatcggcgggtaaagctgctgccaatgctttgatgaatggcaagttatcactaaaactcagtaaataaaccactttatttcggtgacgccttgcacacagtagcgacattagtcgtactaaccacaaataaatctctttcacgttaatcaccaatatcactaaatttcgctgcccataacatcgagaattataccacatctcccgagataacctagcgaaatttaagaacctttaacattccaccataaaattcataatgttgggcctatttataaaaaaagtggcgggcaattagcgcccaaccacttttgacttaccatttcggctcatagaaatgtcccaacacttttaccgtatctgagatactaacaaaggccttaggatctgattcctccatagccgtttctaacgcatccatttcataccgggtaatcaccgtaaataggatcgtcttttcatcatgtcggtaagccccttcggccccatgaacgatcgtgatgcctcgccgcatgtgattttgaatactgtcaatcaccgtcttaggccggtccgtaatcaccatgacctgcatgcgctgttgccgcgtaaacgtaatgtccatgactttagcatttacgtaaagccctaatgctgaatacagcgcgtaaggccacccgtaaacaaacccggcactaatcacgatcaaactgttaaacgcgatgttaatggtaccgatgctgcgcccagtcttacgacgaacgacgatcccaataatatctaatccaccggtcgaaatcccgttctttaaagcaaagccggtcccgaatccattgacggctcccccaaagatggcgcagataatgggatcattggttaagtgaatcggctgaatccagcgaatcatcaccgacgcaaacaagacacagataaaggtaaaaatggtaaaggatttcccaatttgtttccaagccaagaaaaacatgggaatattaatcagaaacagccctaaacccgttccaatgtgaaagactcctagaccacccgttaaggtgttcaccaactgtgctaacccggtcacaccggacgaataaatatgtccgggtgtccagaaaaaattcaccgcgattgacaccaagacaccgtaaaaaaaagcaacggaaatctttgccgtataggtatgccgtttgaacaactgctgcacatcatccatgatttaaaaaccgacctcacttatctcgtttcttctcatcttttatactatgctcggcttagtatagcatttaatcttggaaacaaccacggaatctaccagctcttagcgagttttaattttcctgccaatggcgggcaataaatgcagcgcgcccacccgcttcttcttggtcaaagcgatccggatttttccgataaaattgttgatggcgttcttcagccacaaagaacggctggaccacttggatctgcgtcacgattggttgatcaaactgctcgcgagcttgtaatgccgctcgcgaggctaccgcaatttcggcctgctgacggctattcacgaagatcaccggccgatagttacttccgcgatcttgaaactgccccgccgcgtccgtggggtccgtttgttgccaatacaactcaactaattgctggtaactgacaacggccggatcaaaccaaattttaacagcttccgtatgacccgtagtttgacttttaacctgctcatatgtcggattggtcacggtgccacccgtatagcccgacaatacccgtttgatgcccggtaacgtgtcaaagggtcgcaccatacaccaaaaacagccaccagcaaacgttgccgtttcaatttcgctcatcataatcactccattttctaatgtttctattaaacggctttttcacagtcacgtcaagcaccactacctaatcgacaaaaaacgagcccagaaaaaattcgtaagaactttattgattagtttaacgactaacggaaatatcgtcaatgtctgcgaccaaaagttggatcttgttgtatgatgaaaggcaacataggattcaggaggcagacaatgaaattagaacagcaacgcgtattaattgtcggtggaacgtcagggtttggtaaagcagtagcgcgacaggcactacaggctggtgcccaagtgcatattattggccaccagcaagcacatgtcgataccaccattgctcaattacgaagtttaggggccattaaaggaacggcattagatgcacaatctgaggcagctttaacggctttttttgagcaacagtcggcattcaatcacgtcttatcgtttttgggtggggcaatgggtggtggcttcttggataattcagtcgcggctattcgccaagcgattgaagataaattctttgccaatttacagttgtcaaagatggcagccacccatcttattgatggtggttcattgatcctaacatcaggtgctggcgggcacccggccgacgcgtctggagccattattggtaaccaggcgatcaatacgttagtcgccggtttagcggtggaaatggcgccgcactatcgggtcaatgcggtggccccgacttggacgccaacaggattgtggcggcagttgaccccgcaggcaattcagaaacaatcagctgcgtttgcaaaaggggtgcccctacagcgagtcgccactaaagacgaggttgcttcggcctatctgtacttaatgagcaatgatttcgtaacgggccaggtgcttcatgttgatggcggtgtggatttgggtgtcagataacgaatgggccaaaaagggcttagcgccccttggcccacattttagtactagatacattatatacaaagcatttttaaaaattaataactggtccagccgccatcaacggggacgacggtcccattaacgtaactagctgcatcggaacagaggaacaaagcggtctgcgcgatttcggcactcgtaccgggttcaggggatagtggcatccccacattttgacgggccatgccttcctgatcgacacccgtcatggattcggcaatgttcgtcttgataccaccgggggcaattgcgttggttcggatgcccatgttttcatacatgtaggcggtatttttggtaaggccaacgacggcgtgctttgacgcggtataggctgcgccggcccgcccgccacctaaaccaccgacagaagcaatgttcaaaataacgccagacttttgcttagtgaaaatctttaggacttctcgggttgccagcatgacgctagtggtattaaccgtcatgaccttatcccacaattcattagtgagtgtgccaactggagccatattatccatgatcccggcattgttgaccaaaatatcgagacggccgaaatgatcaaccgcgctttgaaccatagcgaccacgtcagcctctttggtcacattggttacactggcaattgcctgaccaccagctgtggtaatggccgtcacaacctcatttaagcggtcctgattaatgtcagcggcaacgatcttggcgccttctttggcaaataattcggccattgatcgacccataccagagccagcccccgtaataattgccactttatcgactaattgttgaaccatccaactcactcctatcggttattgatttagcatctaattgcttaagtttattatagtcttatttactaaagaaagcgcttgatagaccagaggtcactatagttgacgtcaaacggctttcatgtaacaataaaagtaacaaaaggagcgatgaacgatgaaatatgttattaccggggcgactggtcatcttggccgtcaaattacccgccagttagcgcagcgagtagcacctgaagagataacgttaggggtgcacacgcccagtaaagccactgaatttgttcagcaggggatgacggttctaccattggattaccaagatgtgaccagtttggtagccagtttgcgtcaggctgatgtggcgatttatgtgcccagcaagagtcatgatagttttagtcgcgtgagtgaatttgaaaatgtcgtgacggcagcagaacaggcgcaggtcaaacacttactggtgatgggttttattgccgatcaagtgaataatccgtttgatctatcggcgttttatggctatgttccccgtcgtttagcagccagtacgttggactatacagtcgtccgcaacgcgctgtatgctgatccgctagtcccttatctaccagaactgattgcgcgtggtaatgttatctatccgatgggcgatgcgtcactaagctttattagtctggcggaaagcgcagcggcattcgcgcaattagcggtgacgccgacgttatggcgtcagcctatttacaccttgactcaggaacgttcgtatacgatgcccgctttggctgaggttttgagtactgctagtgaggctaagattgggtatgcaccggtaacgttgccccagtttgccgcgttatataacgaaggaaatgagggtcatatgttagcgtcaatgtatgccggtggtgcgcaagggttattggcgacggttagcacggactttcggcagatcatggggcgtccagcgcagagcttaccagactttttaagcgcgacacttgcgaagtaaggcgggatcggtataattattcggtaaagatatttaggggggactcatgatgcgctattcacataagcttagtgatgcagttcatatcttggcctatattgttatttaccgggatcatgatttatctagtgcggccattgcggcgagtgttacgtctaatccggcgctggttcgtcgattgatgggcgctttgcgacgggctaacctgttagccacgacgcaaggtgcagcggcaccaaaactggcacgtgatcctgccttgataacgttgctggatatttatcgagcggtggaaaatccgggggatctgctacacgttgatgaggagaccaatccaaaatgcattgttggtggcaatattcaagccactttggagacggcctatagtgaggtgcaacaggcagcggagcggcagatgcagcagataacgttagcaagtctaattacggatatttggacgcgtgaacgagaaaaaagtagcacacactaaaaaggtcgcgacgattgtcgggaccttttttggtggcaattaatgatgaagttcatcagcgaagaaagtatcaacgacgcgctgactggcatgaccatcttcccaagcgttaaagcgttggctaaatcgttggtaagccgcagcgtattgttgcgtaacggctggtaaatcatgtagggcggccaaaacgtcgtcgttagtcttgagtaggggccccggcagatcagtctccatgttgaggtaaaatccccggaggacacttccatacttttcgtagtcataaacaaagtacagaatgggccgttttaaaatggcgtagtcgaaaaagacactggaataatcggtaattaagacatcggcaattaagtataattcgctaatatcatcgtaactagattcgttgtaaacaaaatcaccaaagccggttgtgtctaagtgttcagtgataaagtaatgcgtgcggagaactaaaacatactcgtcaccgagttctcgttttagtcgatcaatatctagctttaacgtgaatttgtaatccccaacgccgtagtaatcatcatcacgccaagtcggggcgtagagaataatttttttgttgaggggaatccccaacttacgtttgatttgttgggcctgctcgtccttatctggcgcactcaaaatatcgttgcgcggataccctgatggtaacatttggtcggtggggtacatgaaggcatgttcaaaaacgtcgacggagaattggttagccgtgacgagatagtcccactgacgcgattgttggtaaaaaatcgatttgtacagcgggttggcactggcaatgttatccatgtcaaacaccaagtgtttcaaaggtgtgccatgccaagtcgctagaaatttagtgcctggtcgtttgatgaaccacttcggttggcgcatgttaatgacttgaaatttggcggtggctaagtaatacatgtaacgccaaccgaagcgcttgacgaccttggtattgggccgaccggccggcgtttcactaacccctgggttcatcacccaaacgtggtggaagcgaccagggtagttcctttcaagatagttataaatggctttagggctatcagaaaagttgcgaccgagaaaagactcatacaaaatggttcggggtttaatgggcaacttggtgaaccaccagttgtaggccaagcgggtaatacctcgcccccggtgacggatcacacgattcaactgtcgtaagcgaaccaatacgttgatctgaaattgaggaacgcgtggttggcgacgaatcgcgcgtaagatttgacggctattgtggggtaactcgcgtaaggtatcaggatcaacgagctgtaaatagtcgtgcaactggtccattaacgcaggactatcagcaacggtagtttcggagctggtcgctaacgcttgatagagatagcggtgtaaccgatccaaagtgaatcgactgaaggccacatgtaacggaccgaccggtaagtccaccagagccaactgccaagcagcaagccggtggtgccagcgatgggggtcctctaattggtgaatggacggttgattgatgggatcattgtgtttaacacgtacatataggggatcggctagtcgcagataggtcggcgttgccagcattgcctgcgttaggaagtggtaatcggggtagagcgcgttggtctcatcaaattgccaatgatgttgctgaaccggttggcgattgagtatcttgcccgttattttagcctgacgaccaaattgctcaaatcgatcttcgccggtgaataacaaatacttgtgggtgagccagttttgaaccacggcaggaattggtgtggtagtcggtagctcagtcagtaagtcggcggataaattaagtggtcgattccgcaaacgttggcgtttaggaccaccccacttgggcagtgtatcagttgccgaggtctgcgtgagactgttgacaaaagaaacgtgtggttcataggtcgggtattgatttaagtcgataaaggttgtggattttaggccttccagcgcagtaaccgttgctaacgccgttggaagcaggtaatcatcactatcaacaaagaccaaccagtcgccctgagcaacagccatggcggcgttgcgggcggcgccaacggttgaagctttggggtgtacctgacgaatggtaaatggtgcttgccattccgtctggtccaagtcaatcggtaaggtacctgcaatcaaccattcaaaatcagtggtcgtttgggccattaagttggtttttaatgccaataattggtcatattcgctgggtaagtacggtgtaatcaaactaaatttcatgagaaccccctagtagaataactgatgagccactcgaggtgacaacatccgcagcaaacctaagcgtgaccaccgatggattgggggcgtctgagtttgtttaatttgcgtcagtaactgaagatgtacaggctttgataactgctgacgaccagcaacattcaggatttgattaagctgatgttgttggtactgagcgataagggggccccagcccaaggccagatggtccaaatcaattgcctgcaggttggtgagccacgttaagggcgtagtaaccacccatgactgtcttgcgatggtgggaacgtgcagtcggatgacttcagttgctgattgtagaattggtaaagtttgttgtagcgatgctaatggtaggttaggggataactgcgtactgggtagtaataacccggttggtcgtaatcgttgatcgaggtacttcaagctttgcagatttgtttgaacactgtaattttgaagaccccaaagtgctagctggcgggcgttagtggtcgttaatttagagtcagctagttgctgtaaggtgagatggagtcgactatcagcgtgctgatcaagataatcttggacttgtggggctagcggttgaccgctgtcaaaagcggctagaccgatcaagcgattgggatgttgctggatcacctgttgccactgtttaaaggcacccggcaataatcgatctgtttcacgtagattaattaaataggtttgttcgcttggtgtgatcgttgggcgaccgatggttaatgaccatgcggccgcttgtcgttgttgtgcctgggtcagtgcttggcccttaggtaactgcaagcttaaagaaacgtccgtaacatgttggccgttggcttccccgacgagcgtagtaagttgcgcccagtccaactgtgcctgtgggacgatattaagataaataggcatgttttttccttctccgataagtaaattagattaaaaaataataatttcaaggtttattatacccgcttatggatgggttaccagccatttttacgccaattgtcgacaatgataataaccgataaacgattcttagggtttcttttttgatctgagtcatgttatcgcataattggcacacaaaaacacctgctagacgggataatctggcaggtgtgatgaataagatttatcgagaaatcttgttgaatttagacgtcatcgcggctcagcaaggtaatggcctctccttgtgcttgccggcgatcgatgttttgctcgccccaaacacagagttcgtgcaggataccggacagactctggccgtagtcggttaaggtatagtcgactttaggtggtacttgcttataaacgtgacgttcgacaatattggcggcttccaactcccgtagttgttgcgttaacattttttgtgaaatttgggggatggcccgcgccagttcaccagttcgcatggtttgatgacgtaggtggcataaaataatggatttccatttaccgccaataatttccatcgttgcttcaacaccaatatgataggtttttgtgctcatcaaagcgcctcctaattaattattaccttttggtgggtatcgcactttaaagtgggttcttgttctggatatcttaaccagtataatcataactcatacaacagacaactggtatctagaggaggttcctatgacaaaaaagatttcaccaacgttaactttattggcacttgctgtaagtgcatttgcaattggatcaacggagtttattagtgtgggattaattcccatgctcattcaaagtttccatgtgagcttggcacaagccggcttaacggtttctgtctatgccttgggcattatgattggtgcgccgctgatgacgttactaaccggtcaaatgaatcggcacaccttaatgttgatgattatgggattgtttattgctggtaatttactggccgctttggcaccgacatttagtatcctattagctggtcgcgtggttgcggctttagctcatggcattttcatgacggtggcgtccgtcattgctgcggatgttgtggccccggctaaacgggcatcggcgattgcagttatgtttaccgggctgacggtggccactgtaacgggtgtgccattggggactatgattgggcaactgggcggttggcggtggtcctttatctttatcagcgtgattggcgtgatcggactggttgccgactacatcttaattccacgccagttaccgttaccaagtcgtgcaacagctaaagggattttgcgggtcttaaagacaccacaactattattggccttattagtgacggcgttgggttatggtggaacttttgtggcttacacctatctgtcgccattattagaaacgaagatgggttggtcagctcaggcggtcgttgtgattctcgttgtttacggggcgatggtggcgttaggaaatacactaggtggtcgctgggctaatgcccatcccttaccagccttattgaagatgttcgttggtttaatggtgaccttgttggtattaacggtaacgttacacagtcagtggctgggtctcttaactgtgctagtcatggggttctttgcctttatgaatgttccgggactacaactctacatcgtacaggtggccgaacaacagacgccacaagatatcacgatggcttccgcattaaatatttcagccttcaatgtggggatcgcattggggtccgcgattggcggtcaagtgaccagtcaatttggcttagcatggacaccactttttggagcactaatggtaggacttagtattgttgcaacgatgggattgattcggctggctcgaccggctcgacggttaatcaacaaattcaatcatctttaaaatgaaaaggacgcccataatcggacgtcctttttgcttttacagcattaagtttgagaccagtttaaggcaaatcattaccagcagcgaagtaaatatcgtaccattcctgcttggttaaggtaacatcagcaccggccgcactatccttgatgtgtgtcggattcatggtaccaagcaacacttgaatgttggcggggtggcgaagaatccaggcaattgcgataccgtttttagaaacaccatatttgtcagccaattcctgcaacttttggttgagttcagggtatttcgggtcattaatgaacataccttcaaataacccatactggaacggtgaccacgcttgaatggtcacatggtggcgccgagaaaattcaagaattcccccgtcatggtcaacagaacggctgtcggtcatgttgacgtgaagtccggcatcaatcatacccgtatgagcggcactgaattggagttggttgaacattaacttttgatcaacgacatcttgcagcattaagtattgttgcacgttgaagttggagaccccaaagtgccgaaccttgccagatcgttgcaaggtgtcaaatgcatcggcaatctcggccggttccatcagtggatcgggacggtgtaagagaaaggcatccaggtaatcaatattcatccgttccaaaataccatcgacggcatcgatcaaatgttgcttagaaaagtcataacgcttcccaaagactaggtcatcatggctccgttgcgggtcaacgataatgccacccttggattgaatatagaagtcatcgcgcttcagaccagaggccttcaacgctgcgccaaaggtcttttcagattgaccattgacataaatgtcagccgaatcaatataattaatcccggcctcgtgagctgcctgtaaagccttgacggcgtctgcttgttctaagacgcccatccgcatgattcctaatgcaactgctgaggcttgccagttagtattgccaagttgtcgttgtttcatcagaaaaactccttcgttttcagattagtcacgtacatccttaagtgtacaccgtccggctaattttttcgcgctagatgacttttggggaaaaaggttgactttttgccagcaaccgttatagttaattacacaagtaactaaccaacaaacgagtgggggattttaacatgacaacgaaagcagtcgtcagtgtcagcaatttagagaaaacgtatggcaaacctaatgaacgtcagtatacagccttaaagggccttaattttacggtggacgccggggagttcgtcggcatcatgggcgcatctggttcggggaagaccaccttgctgaacatgctatccacactggatacgccgactaaaggtgacgtcgtggttaatggtcatgatgtgaccaaaatgcgtggcaaccagttggcggatttccgggccgaagaagtcggcttcatcttccaagactttaatctactagaaagtttaacggcggaagaaaatattggcttgccgttagcattaaaaggaacatcgtcgaaagtgatggatcaagctattcacgaggtcgcagccactttgtcgatttccgatttgttaacgaaatatccggctgaactttctggtgggcaaaaacaacgggtagcggcggctcgggccattgttcatcaccccgcaattttgatgggtgatgagccaaccggtgctttagactcaaccagtgcccgggaacttttggacttgatgacgaccatcaatgaacaacagaaaatgtccgtcctattagtgacgcatgatcccttctcagcaagcttctgtcaacggatcttattcattaaagacggtcagattggttcagagttacggcgtggggaacaagatcggcgagcattttaccaacaaattttaaatgagctcggaacgttcaacgagtaggggggcgcaacatgttagcaaaattagcacttgctgggattaaaaatcggcggcgagattatctggtcttattggcggggttaaccatgtcagcggccatcttctatatgtttgccaacttggcaaccaacaaggctttcatttcggccaatgcggtggtgtcacaagctgttattatctttggctttggggccgtgttattaatcttgattagtctggtctacattatgtatgcgaacagctttttattgagtatgcggcagcatgactatggtgttttcatgatgctgggtgctaagcggcgccgaattggccaactggtctttttggaaaccttgattttggggacgatcgcgaccgccatcgggattggtttagggttagcgatgagtaagttcctagtgggcttcttattgaatctattaggccttcacttggcccacttacaagcagtttatgtaccagcaattattgcgaccgcagtcctttacgtagggttattcgtcttggcatcgctctttaacttactgcatttaacccgttccacggttttaaaattacttcacagtgatgaccaggccgaccagcctaaggtcaatccagggaaacaaatcggtcaggcattgctgggcattgttttgttagcgattggttattgggccttagccgcgatcaaattgctacaagtcatggctattccaattgcgctaatgaccatcacctgtggcacctatttattattccgggcaaccttactagtggttattcgggcgttacggcacaccagttgggcaaaaaagcatctgaacgggttcttattgggccaactaaacttccgggtgtataactacacgcgaatgttaaccattgtttcattactgtttgcgatggccttgggggccattaccgttggttcgggataccatcggcaattgccacaaatggcggggagttttgatgcttataccctggcggtccacaacgtgacccccaagcagcaaaagttgattaatcaactgcacgttagccatcaagcaacctatacgcaaaaacggcaaggcaaagtagtttattacaatgcgactgaactgcgccaacaaccgtttgaacaattgcgtacgacgggaaagagcttaggtaaaaaccagtactatacagaaagtttgtcagcctttcaaaagaagggattggctggcatggacttccagaacttggctatccgcggagcctatacgttctacacaccgaagattctgaaagctcagcaatttagtcgtcaagccggcaagaccatgacagtgacgaccttacgtgtaaaaaacatgcaacaggatcaacgagtcttaaaacagttaaatcaaagtgagcttgaccgttatccgctaccgacaaatatgacggtcggtagttatcaaagttttaccatgatgaatgccttctttggtggacttgagttcatggggtatttcttggggattgcctttctagctatgctggcatcttgtttgatgttcaagatcctttctggcgccccaggcgaccaacgtcgttaccggatgctgtacaaggttggtgttcgccaaggactgatgcgtgcgggtattgcaaaagaaattgggattttattcctcattcctggtatcatgggtatagttgacgttttgtttggtttacaaatgtttaaaccgttgatgcaagcaccgatgagtccatatctggggattgggagcacgttcttaattttcattggactgtacgcaatctattatgtcgtaacgttggcactgtattggcgaattgtattaccaaagcaagtagattagtcgataaaatgagtttaaaaaagaatgtgggataagccatgaaatttaattttgatagcccggaacccatttacctgcaggtagccgaacaattagaagaggccatctttaccggtatctaccgggctggcgaacaggttccgtctacgacagagatgtcgaaagaatttcatatcaacccggcgacggcgcttaaaggcatgaatcggttagtggcggcccagatcattgaaaagcggcgcggtgtgggcatgtttgtcaccgccacagcagctgaaacgattcgtcagaaacggcgggcgcagttctatgaacgttatgtcaaccggtttacggctgaagccaagaagttaaatctgtctgaaactgaattgattgctctggtaacacgaagttaccatgatgcttagcaaatgagtggtccccctatgagtctgatggggtgaccactttttggggtaagcaagttgatttacaaatagagctaactgcggtataactaattgtgcacaattgagtgggcataatcttcggaaagagggatttgatgatgaaaatcacaatgacagcagcagctaaggattttttgcgtaaccatgttcaaccagacactgtattgttactcacgctagatgatgggtctaaccgttattcgaccctcggtgggagctgtgcgattggtgacaagtttcaatttgtcgcgctgacggaaaaagatccggcttatgccattccggtagagaacgatgcgggcatccagttgtggaccaacgctgatacggaactttatttaaacaatgggttgacgctagatcgggttttcaatcaattggcattacgtgatgatacaggcattttggacagcgcagtcggactgattacgtactcagctgaagagaaatcaaaattagacttgaagaaagaaatgcaaactttagggacacgcatttgctagtttccagtttgtcggcatgggccaaatggcgcatgcttttttttatgcatcccatggctagcggtcttgtttaaaaaatgaattattcaaacagtgaataaaaatggtctctgtctattgtcaggtgataggtggcacgcgtatactgatagtatgcaaagttctgggaggggatttatttggaaaagattcatcaaggttggcgaatactaatcggcttaattggtttgctgggcattctgattattagccagtgggcagtaccagcccacgccgccactaattatgatggcgcgaacttcacgacagcggctaaggtcactaacgggccagatttcaagcacgctgatacaattgatatccaataccatttggattttggcacgacacctttacataatggcgacacgattacgttagattttcctgagaatttacgagggaaaacacctggtgatacattcgatgtaacggatgagtccggtgaggtgattggtaaagccgttgtctcagataccggtgtggtaatcaccatgaacgatgcattcgaagggaaaaccaatgcaaagttaaccctgaatttggcaaccaagtatcggtacgacgatacgggcgagaaagatgtggtcttcccactagaaaataacggcagtagcacttcaaccattaatatggttgctaacgaagccaatctgtctaagagtggaacgattcaagacgatggcaccatcaagtggaccattttagtgaatcggaaaaatttacatttaaagaatgttgagatcagtgacacaatcggggatcatcaagaaatgattcacggggtcacagtcagcaaggcttattggaccagcgcaactggctacaagcgtgaaaagccagcaatgacggctgatgattatcaggtgacctatcacgatcaaggatttgatttgacttttaacgatgatttagatcaaatggttgcgattgattactataccaagatcaccgacccatcattgattgattcgggctacaagttccgtaacaacgccgaaatgacttggggtggtggcacctccggcacgaagcagtctgaacaggctaatgggaaggtttcttcttcaaagggcaatagtggttctggtagtggcgatgtcaacgaaaacacggaagaacctgaagacaaggatactggaacgattgataccgacaacggtaccgagactgatgccgaagaagccgctcgtgaagaggctgaggataaagaagaggctgctaaagaggccgaagcagcggccgcaaagaaacaagcggctaaagccaaacagacagcagctaaggctaagcagacaacggccaagccaaagacaaccgcaaaagcaaccgccacacaatcggctggtcgaacggttaatcataaccggaaattaccgcagactgatgaggcaccggtggcttgggccacattaagtggtttgggattgctactggctgtaggaagtgttcgggtcttacgtcgtcattaatgatagttttaaaaagcgattggtccgttgcggatcagtcgctttttattcatgatgactgaaaccgtcatgtgttaaagatcacaataattgttataatgaagtgacttaaaagtattattttgggggtaccgtgatgggaaaattacaggaatacaaacgattttggtttgtggtgagtctaggtgtgatcgctttaggcctgcagtttttggcacaccaagcagggctagcacaattattagtcagtgcccttggcatttgtttagccctgcttatgtttgtagacatggtgaagaccttacgctccggcaaattcggtgtggatctattggcgattaccgctgttgtggcgactttagccgtgggtgagtattgggcggcgttaattgtcttactcatgttgacggggggcgatgcactggaagactttgcggcgcggcgagccaatagtgagctacaaacgctacttgaccaatcgccgcagacggcccacgtggttgagggtgagacggttacggatgttgcggtcaatacagttacggtgggcgcccgactgctggtcaagcccggcgaggtcatgcctgttgatgggacgttgattacggggccgacgacagttaatgaggcgtcactgacgggtgaagcacggcccattgaaaaagcaattggcgatatggtcatgtctgggagtatcaatggtgaagcggcggtgtatcttcgtgcggagcagactgctgagaatagtcagtatcaaaatatcgttcgcttggtaaagcaagcagaagcgcaacctgcgaagtttgtacgaatggcggatcgctacgctgtaccgtttacgattctggcttacatcattgcggggattgcctgggcaatttcacagacgccagtccggtttgctgaggttttagtcgtagcatcaccgtgtccgttaattctcgcggctccgattgcgttaatctcggggatgagtcgggctagtcgcaacggaatcattgtcaaaactgggacgacactagagaaattggcacaggtcaagacagtggcctttgataaaacgggaacgattacgcagggaaaattagtggtggatcaggtggtaccgcaagggtcacagtcggccgatcggctattacaactggcagccagcgcggaacagcattctagccacgttttggcccagtcgttagttgctgctaatcgtttgccattgttaacggcaaccaatgtgacggaaacgacggcgcaaggggtagtggcgactatcaacggccagcaggtccgtgcgggtaaagcggcatttgtcacgtcagagtcgatcaccaaaccggatcaaacggctgtttatgtggcggtcgatgacgtctatcagggatacgtcagctttaatgatcgcgtacgaccagaagcagctacaacgatgacgcgactacgccaagcgggagtcgcgcacttgatgatgatttctggggatcgccagccaattgcagaacaaattgcccaagaggtggggttagaccaagttcacgcggaatgtttgcccgccggtaagatcgcggtattggatcagctagctgcgaaccaacggccggtagcgatggtcggtgacgggattaatgatgcaccatctttggcaaccgctgacgttgggatcgcaatgggggcccatggggcaacggctgccagtgaatcagctgatgccgtggtgctcaaggatgaccttacgcgagtcagtacggcgcgggtcattgcgcaagacaccatgcgggttgcccggcagtccgtattgattgggatttttatttgtaccggcttaatgctgattgccacgactgggattattccggccattattggcgcggtcttccaagaagtggtcgacactgtgacgatcctatacgcgttacgggcccgatcagatcggtcttcgttagagaactaataaaaggtacgggtactgctggatttgtccggcaagtatccgtaccttttgacgtcagggccactagtcagcctgtgctttacgccgttgatcgcggcgaataatttcatacaatcccactaataagaggactaagaccacggctaagataacggtcttaatgttaccagataacagttcatcgccaccaaaagcgtagagaaacgatacaggcagagaccccattacaatacagctgagggtggtagtaaacgagggtcgtaattctagcgccgtgtagttgaccagtacggtcggtaacatcggaatggcatagccaatgcttagtcctaatcgcggatggcgcatagtctttaacttgtcagtgaggtattgaaagcgactgggtttcgagcgcttaggaaactggctcatgaggtaaatggccagcaggttgcccagtgtaataccagttaggttaatcacgaacccgggccagcgaccaaagaagataccagataagatagcaattgctgaaattggcaccccaggaatggctgaaccaatggcaatagccgcaacgaggataatggcgttatgtcgtccttgatggcgcaactgattaatcaaaacggcgcgatcccgattgaagtgggttgctagaatcgtggtaccagttgtgcggtagtcaatccacaaccaacttagcaaggcaaccaatcccacgatgcccagaccaatcagccagtatttatatcgatttgtcatgagcgagcccctttgccattagatactcttaacttaccataaatttacgagaaagagaacgaacagattgagtaattgccggttcggggagtatgatgaaagggtaacaagaaatctgatcgtaggggagccagaaaaatgacaaaatcactcaataccgattatttttttgatgaagcggcctataacacccatgatggtgggtatgtgccgctggcagaaccgaagacaccacaacaggccttacggattccgccgttattgaagccagataaagaaactgcgacggatacctactatacggtcgaggcccaagctggtgaaacccaactgttacccggtaagaagaccaagacgtggggctataacaccagtctactgggacaaacattggtttttgcgcagggtaaaacgatgcatattgatttgaagaatagcttaccagaactgacgacatttcactggcacggtttaaatgtccccgggccatatacggacggtggctgtcatgcaccggtctatccgggacagacgcggcacattgattttaaagtggaccaaccggcggcgaccttatggttacacgcgcacccgtgtccatcaacggcggaacaggtctggaaggggcttgcggccttagccttggtgaccgatgatcacgaggcacagttgccattgccacatacttatggcgttgacgacgttccactgattttacaggatcggcggttccatgaagataatcagtgggactatgaagcggattatgatcccgacggtgttcagggaccgacaccactgattaatgggacagttaacccgtactttgacgtgacaacccaacggctgcgcttacggttattagatggcgctaatcggcgggaatggcggttgcattttagtcatgatctgccgtttacccaagttgcttcggatggtggcttactgccagaaccggtggcctttacacacttgatgttgacctgtgctgaacgtgctgaaattattgttgattttggcgacgtggcgccgggagagaccgtcacgctgtatagtgacgacgtgccgttggttcgtttccgagttcatgaatttacgccagatacggctgtgctcccagaacatttggttgagatgccaaatccagacgtgacaccggatatgccgattcgtaaagtggtgatgtctggcatggatgagacggtcatgatggacggcaaaaagtttggcatgcaacggatcgatgccaagcagcaggtcggtaatgttgaactgtgggatgttaccaatacgaatgatatggacggcggcatggtgcatccgttccatatgcatggtacgcagttcttagtagtctcccgtaacgggcacgccccgtatccgaatgaacacggctttaaggatacagtcggtgttaaccctggggagaccgtgcggttaaaggtttggtttgaccacacaggggtctacatgtatcattgtcacatcatcgaacacgaagatggcggcatgatggcccaaattgaggtctttgatccgcaacacccacaaacctataaattaatggatatggaaacgctgatgaaggccgtggctgaagaacgcggtaccgccgtcaaagatttacatttggcggggatgagttcctatgagaagatggggatggagatgtagtcagtagaataaaaagggcaatcacattacgtggttgccctttttattattcaccatgctttttccctcgcaaaacatgatccacgtgggcaagggtttcgttaacaatatctaagatatgggggtcatcaagctcatagaaattttgtttaccaatacgttgggcggtgaccagttgttctttcttcaggagggccagttggtgagatacaaccgattgttcgacctgtaagagctgacccaattcccccacgttgagtgaccgctgttccaatagataaagaatttgcagtcgcgtgggattacttagaagtttgaaaatagcttgtgctgcagccaatttgggcgcttgaatggtagtgacgggttcttcagtagacgacatttaaataggttgctcctttcatatgaatatgataacatatgttgaaaataacatattggagatgaccaaacatgctacgaccaattttaaccggagtgacggattacatctcaaccggattagattaccttgttattctaatgataattttcagtcgcgtaaagcctcaagatcgttggctcgtgttaattggtgactttatcggtacgttgattctggttgggagttctctggccttggccttcttcttaggttttgtaccaaccccttgggttcttggattattaggcctaattcccatctatttaggcatcaagctgggacttcaaggcgatgacgatgatgtggccgcggttgaacgccgggtcagtcagccccggggattgattgcgagtgtcgtgctgattaccgttgctacgtgtggtgccgacaatatcggaatctatgtgcccttatttaccactgttgcggccagtcagattccattaattttaattacgtttgctggcatggtcgttgtgttttgggaactgggatttcgactggcaacattaccggtgattgctggtgtgttagagaagtgggggcgtcatctgaccgtcgtggtttatattctgcttggcgggtatattttgtgggacaacgggacgattcaccaactattgcgttggctatagacgtaaaaaaccagtatcacggccatgaaccggctggatactggtttttgtatgaatcacgatttaaaagaatagcttgctggcaatggtgaccccagctagtaagaccacggacgataaggttgcggctagaaaggcgttgcccccccgttggaagataacgcggaaattcacgctcataccaagagcggccattgccatccccaagaagatgtaggcaagtttaaccagaccagccagcgtggtggctcctaaggggacccaggtgccaatgatactggttaataggaaaccggccataaaccagggaattggtaacttagttggcccatcgtttgtggttgtggtggcggtttgtctttggtaccaccagccaatgatcaaggcagctggggccaataagagtactcgtgacaacttggtaataatcgcggtgtccagactcacagggcccccagcactacctgcggcaacggcgtgggcaatttcatgcagtgagccccccgtcatgacgccgaattgaacggcagtcaggtgcaatagaggtttcaacccgatttcaattagggtaaagacagttcctaagatcgccacgatagcgacggccaagacttcgttttcccgttgtcgttcagcttgatcggcagggactttaatctgtggagagacgcccatgacggcggcggcaccacagatgctcgtacccgtagcggttagaatagctagttctcggtcgaccccaagcttacgactcaagttatacgtcaagaagaccatcccagtaacgacgacggcagccagcgtgatggttttgacccccgcttgggccaattgcagaagatttaacttgaaacctaaaagaataatccctaatcgtaaaaatttattgctaatgaatccaatgccatcccggttgacggcaaccatccggggtgcgagttggcaagccatccctaataataaggcgatgaccaaggcaccaactaagttcaaatagggcaattgggccagttcgctaccggctaccgcacaaattaacgtaatgacagccgctccccagaagctgcgggttactagggtattgcgaatatccatatcaatttcctcctctatgattgataaccttagtttaccggaagtcgattataagataaaattgggatatttaatgacgatataaattttacttatgaggagcgatgatatgctagataaacgatacgaaaccctgttggctttagtgcaaacaaaatcctatacccagacggcccaacggctctttattactcagccggcagtgtctcaacagattaagagtttggaaatggagttgaacgtaaaactggttcggtatcaacgaccacggctgaccatcacgccagcgggtcaagaattggcagcctttgtgcagcggattcaagtgcaggccaataaggtggtcacggccttacagcaccctcaggtgacgcggcaagtgatttttagcacgacactgtccttgagcgaattcttagcgccccagttgattcaagcgattcaggctacccagcaatttcgcgacattcaatgccgggtgactaacacgcaagccgccttgaccgcgattgatcgcggaaccagcgactttgctttgatcgaaggcaattttgacaagacgcgatatgattatcagatagttcgtgaggaaccatttgttgccgtggtggccgccaatcatccactggcgcagcaggcacaagttagttgggcggacttgacggcttatccattattgctgcgggagttgggatctggtagccgagagattctgaccaatctggcccaggcagccaatgtaacgttagcggagttttcgcagacggtgacgatcaataatctggcggcaattcgtcagttactgctacaaggggccggcgttagttttgtttatcggtcggttgtagcgagtgaattagcggtcggaaaattagtgacgttacgtttgccagcgggacaattgctccatgaattggcggtggtatatgcgcgtgatagcttttttgctgcggattatcagcgctggacacaagctttacgacaacctggtaactaagtcacttaaaagatgagcttaacagtggacaaacccggttctttgttggtagcatgagactattgtcgaaaaatatggagaaggggtgaaccgttgtgacacgcaaaacaaaacgggccatttttattttaatttttagtgaatttctagtctgcttgggaattagtttagtgattccggtcatgccgtttttaaaaacagaactgcatttgtcggcgactgatatggggatcatgaatgccctgtttgcgctggcacaatttgtggcgtcacccctcatcggtcgattgtccgataagattggccgtaagccagttttgacggtggggttactgttatatatggtatcggaagtcctattcgcactgacgaactatctttgggtctttgatatttcccgcctaattggtgggctatcagccgccatggttgtgccaactgcgatggcgttagcatcagacattacaactaaacgacaacgggccaaggtgattggctggctatcagcggcctttagtggtggcttgattttgggccccggtattggtggcatattagctggtatcagctacaaaaccccattttgggtggctggggccttaggcttattaagcgcaattgttttgattgcgttacttcctagtgatgctgaaaataagcgggtagtagaagaacccgaacaagcgaaaacgactgctcacccaatgagtcgtgcgttttggacgctacccattattattttatttacgatgattttagtgtcatcatttggcctacagggatttgaaagtatttacagcatttatgttaacgaagtctttaacttcagtctgagtaatattgccttagtattaaccctgaatggattgatctcactattcttgcaggtggcgttgttcgataccatggtcagcaagtggggtgagcggcgggtgattcgcctttgcttcttcctcgcggcaatctgtaccatttggattacgcaggcccacacgaagttagaagtgatggtcgctacattgattattttctcagcgtttgacctcttacggccagccattaccacgctcttaaccaaggctagcgagtctgaccagggcttaatcaacggcttgaatatgtccttaacgagcattgggaatattgtgggaccgattatgtccggcatgttattggattggaatacgcacgttccgtatctggtcgtggctgtcttcttgattgtgtcgtatctgatggcctttttactaaaacaaccgggcaagcagcagtcgaccgttaattgactgtgatagtaaaaaacgcgtttttctagggatcaattagattcttagaaacacgcgttttttgagttcaacgggtgttacgacaaattaaaaagcaactagatggttctctagctgctccccccaaggccccgatggccgtctattctgttggtaggccccctcaagccataccgattcactagctatcataactcccccaagttgtgatagtagttaaggtcagcaacctaaccggataaggcaacgccaatcatggccgtcgttgttatcctgatgttgcaagttcattataacggggatcaaggatgggggtaatcccataatctaataattggcttactaaatttaactattttgcctcctaacatgttatgctatgactgaaagcggttacggttaaaccgtgcgggaaaacatggctcaatgacagatagaagaaggggcgtcagtatgccacatccgtatcatgaacgactaaactttaagacagaattgccattgcgagttatttcacacgggacggtggggccaaaaatggtcttgccccactggcatcgcgcggttgaattggcctatgcttaccgaggacagcctggaacggcgcacattggccgctcgacctatcatatgctggctgaccacctctacgtgattaattcggaggtagtgcacagttatgagacgtttctggatgaggataaccaaattgtgacgctgcttttaccggcgtcttggttacgcaatgcggtagctgatgagcagttgcccatctgggggccgttggaccttgacctacaattgggagtgtatcaaccgctggcggaggccgtccagacgttggttgcgggggtgatcacgccttcatcagcgcggtcagcctacctcacgagcttgggagctgaataccaattggtcggccaattactccaacatctgacggttgacggccaagtgaccagtgatcagttaccgctaccagcaccactcaggcaggccgttacggaattacaggagaactacgcgcaacccgtttcaattgccaatttagcggagcgactaaattactccagtgtttatttttcccgctactttaaggattatatggggatttcacccaaggcgtatctcggccagattcgcttagaacgggcgacatcgctactgatgacgtcacaggattcaatccaaaatattgcactcaagacgggctttagcaccgagaaaaacttctttgtgacgttcaagcaatactaccaaatgaccccgcggacttatcgccaacggtattcggcacagcaaagctggtcctaagcgggtgacaggcggcactttttatgatacactaccctaatatgtcataacgaaaataagttgaaaccaacgttgccgttaatcagacacgttggttttttctgtcaaaataggaggaatcgttcatgttaaccgtcaataatgtcagtatgcagttctccgatcggaaactctacgatgatgttaatctcaagttcaccccaggtaactgctacggggtcattggcgctaacggcgctggaaagtcaactttcctaaagattatcgaaggtaaattgaaacccaccagtgggaacgtttcaatgggacccaatgagcggatgtcgagtctgaatcaagatcactttgcctttgaagatagcatcgtcatggatacggtcattcgggggcaccaaaagctctacgatatcatgacagaaaagaatgccatttatatgaagccagattttagtgatgctgatgggattcgggccgctgaattggaagccgaatttggtgaaatgggcggctgggaagccgaagctgaagccagtcagatgttgcaagccttggggattgatgattctttacacaacgtcttgatgagtgaactgaccgaatcccaaaaggtcaaggtattgttgggccaagccttgttcggtcatccggatgtgctattgctggatgagccgaccaacgggttagatgtccagtcgattagctggctggaaaactttttggcaggttacgagaataccgttattgtggtctctcatgaccggcatttcttgaatcaggtctgtacccacatgtgtgacgtggattttggtaagatcacgttatttgtcgggaactatgacttttggatggaatccagtgaattagcggcgcaattaaaggcgaatgcaaacgccaagaaggctgaccagatcaaacaattgcaagagttcgtggcgcgattcagtgccaacgcctccaagtctaagcaggcaacgtcacggaagaagcaactggaaaagatcacgctggatgatattaagccatcttcgcgaaaatatccgtatattaagttcaccccggaacgcgacttgggtaatgacttgcttcgagtcgagcacgtgtcaaaggccattgacggcgtcaccattttagatgatgtgagcattactctgcggcccgatgagaagacggcgttcattagccggaatgatttgacgacgacaacgttgatgcaaattattgccggtgacgtccaaccagacagtggtaacgtggtgtggggccaaaccaccagcacgacgtatctaccgaagaatgttaatgactactttgccaataatgacttatccgtgttggattggttacgccaatttgcctcgaaagaagagagtgataataccttcttgcgcggattcctgggcaagatgctcttttctggggatgatgtgaatcgtgcggttgatgtgatgtccgggggcgaaaaggtccgggcaatgttatcgaaaatgatgttgagtaaggcaaatgtgttgctgttagatgatccaaccaaccacttggatttggaatcgatcacggcgttgaacgatagtttggtcgcttttaacggcgcaatcgtctttacctcacatgaccacgagttcattcaaaccattgctaaccgaattattgaagtgagttctaagggattggttgaccgagcagataccacttatgacgaattcttaggtcatgagcaggttcaggctcaggtggcagctttgtatgatggtgaataattgccgaatttagtgacaaaaaataaaatcagtgtttcagaattttcgaattctggaacactgattttttattcttaaaataaacgaatgagaataacgccacctactaaacacaataggcctagaaactgaaccggtatcgtaggatttcgcttagctccgagtaacccaaattggtcaatcaataggccaccagttaactgcccgagtaaagcaaacactactgtttggccggtgccgagaatcggtgctaagtaagtgttgcctaaaacaaagataccgcccaataaaccacctagccaaatccaccacggttttctgtgaccggtggcattggcaatatgactgagattgcgatcaacgacgaaaacaatcaccaataatgtcatagcaccaattaaaaacgagatgaacgatgcgtgaactgccgaatttaaaacgacacctaaatggccgttgatcgtcgtttgcacagcacctaaggcgccaccgacaattcctaacaatcgccatggccagggattgccactggtcgtcgtggtagtttgatgttgtaagatgtctggtaaggcaacagtcactaggataccaattaacactagaatgaccccgaagagccgggctggtgtgagagattgttgggtagccgttagccaaccaaacgtatcaattaggagtcccattaagacttgacccaaaatcggcataatagcagtttgcacggcgccaatatggggaaagaggaggatgttggtcgttaagaagatgacgccaaggaccccaccgatccacaaccaccatggctcttgagctagtagctgggacgagacaccaagtgattgatgtgaggcgagggttaccaaggcgagaaagagcgttccaatagtgaatgagacaaatgaagcttgatagggcgagccgataaaggcccgtaaacgtgaattaatggcggtctggcaagagatgatgccaccaataataataccgatggttacgggaagcataagaaaatcctcctctgagtaaaaataaaaggttggcggttggaaataccgtctccctttcagtataacctatttatcggcatgcaaagctaatgtgtcaattcgtttaaagaaggcatcgtgatccacagtagtcactaaggttacgggccgaccagtcggtgtttcaaatgttcgcccacgaccggggccttcagttaaaacatcactggtgacgcgtttagttgtgacgatctcgggaaactcgctggcaacagtcgttagcacatcccataagaagtaagtagagtttgtctcaaagtgttgtagagcgggcaccaaggcataaccttggccaataaagtcaattgcaggatgctggcgtaatgttgcccagtgctggcgaatggccggggtcaatgggacttgacgagtgctttcaagtccaaccatttggatagtgaggtcactatcccagacagtcttaacggcctgcgggtcccaataagcattccactcagtagtcccgtcttgttcaggctcggcaacattgccacgaccatcaaaggtaccacccatccagtatagttgttcaattttggccgtaattgacgggtctgcctgcaaggctcgtgcgagatcagttaaagggcctgtcatgaccagagtagttttctccgaggtagtctggagcttgtcaacgagatctaaatgtgccggcttgggcgcaacgggcgtaactacggttcccgactcatttagaatcggcagggcatctaagctaaaggcatctagccgccattctttcgggaatgggtgaacgccgcgagagtcagagacggcgacctttaggtgagtatcgtgaccgaaacgatcgatgactttacgggtagctgctagggctggctctagataggaatcggcgccaaccacaccaacgccagttaaatggacatctggcatttgtaacagcagtagtagtgatactaaatcgtcgacacttccgtcatgattaaaatacacgttacgcatctgaaatcgctccctttatttacgaacattattgttttaatatcatattatagttcacataatagcaaaagtaccaatagtttgcaagtaaagtcgatgacggatttagttagggttaaggaagcgcgtgtatactggattctaagttgattaataggaatcaatagagaggatgacggatctatgcaaccagcccgtaaagaacccaaacgctggctagtgctgctactagccggaatcattctgtttgtcggtggcggtgggaccggctatatgttgggacaacaacaagcaaagtcggcccaaacgacgcagatgaaaaatggccccaaaaatatgaagggtcaaccatcaggcaaaccgagtgggatgcctaaacaaaatagcagtagtaattaacgaacaatagccattgcttgctggattataaaacgtgtatcatcgggactgtcgtaaagctccggtgatacacgtcttttagtttgatgtggtgatggtggcaagtgaaacggtagcacttccggggtataaattcatgcgttgtgcgcggtatgaccaatcaccgtgggcgaacttggtccgatcgacatcgaagacaatctggttggtttggcgattgacttcaacaaattcactacgcttgccattgtcagcatagccaaagccaatgagcgtattacctttgcccacagcgtagctactcccgacaatattcgtaaagttccgtttgccgagcgttttgccaaagctccacgtctttttaacggtcttatggagttggttaatcgtgacaatttcccctgccgaccattgcttagattgcttggtttttccgcgggtaacagggacattgttatcgtagtactccagttcaattgtagcgccttgatgttgtgattgatgaatcaggttgacggcgtgttgaccgccactataacggaactgtttactttgaggattcaacaagtagtgttgataggatgccggtaatttttgtggtgcagccagaatccattgtaatttggtggtcttgtagttgatagcgaaaatcatatcctgattgcgtccagaaacgatgagttcaccccgttttttatcataaaccattgaattctggtggaaccagtcaatttttccgtcaggacgatgggtgccagtatacgtggtgtaagctgaacgggggagaatgcgcttgagatcaattactttgacaatcttgccggtcttataattaatttcaatcatggtatcttcaacgtacttactactaccatcatcgacggttagcaagaggttatgattgggcaattcaatggcatcgtgatgaatgacagtgttagtcgctaatttatacggttcttttcgagtggggaagaggccactgaagttatattgccggtagacacgaccgtaaaagtcggtttctcgcagggcgttgtacttatgctcatcgggtgaaattttggtgagaattaacaagtggtgattgctgagctgcttaaaaatgtgggaaattttattggtactgtaccaccggatctttccccgtgcatctagtccatacgtgtagccctggctggacacggcaaaggttaatttagtatggccggttcccaaagccatttgttgggggttactggtttttaacgtatttttaccaatgcccttcggtgtgtgcccggtttttaaccggtaggtggtacgcgaggtttgcccgtctttttgggtaaaggtcagcgtgacacggttggttcgattggcatataggcctaagacccccaccgaatgggctgttttgtagccggatagctttttggtgatggtcgtcgctggtcggtcaccatggacggtcaaggtgacccgagttttggcggcggttttaaccaagattaacccagacaggggagatgtttggtaaggattaacaatcactttggcgtgctgcggtccggttgggagctggtgaagctcgcgccggtaggtcgtggttaggtgattagttgccgttgtatttttagtcgatagagccggtcgtaaatttagtttgatttgagataaacgtaaaatatctgtcttttgatactgctggtgaacgagtagatagcggcgaatcttgtgacgctcatgataagctgcagcaccaccgacaatgatcagaataagcaagacgcctagactgattttccaaaactttttcatgttatggataactcctttaaataattaacgctggtattcgttgatagattcctgcttagtttagcaagtattttgatgggtaacaagtcgtaggcgagaaatgacagtcgagagtgggtctttgatctgaaaaattgtatactaaaagggtaaaaagcttagctttagggagggttaaccaatgacacaaagttttatcgtagacgaagcattttggcaactgtttccagaggttgaaattgcctttttgacagcccaagacattgataatcacgctaaggagcaagttcccacagatttgctgacgacggccaatcacgttgccgcaactaagtgggtgccgaatgatccgattagtcaaaacacagttgtccaggactggcgacaggctttccaacagtttaaaaccaaaaagggtgcgcgctgtgcggtcgagaatctgttgaaacgggccaaaaatggcaaaggggttggcaccattaatccagtcgtggatgtttataactcggtctcgcttgagtgggcctttccagtggctgctgaagatatggatcaaatcaaaggcgatatccatttgacggttgctcagggtggggaacgttttcgtcccatcggggaagacgacgtggagacggctctgccaggagaagtcatctaccgcgatgcttatgatgtcatctctcgatgctgggcttggcgggatagtgccagagttgaggctaccgaagccacgcagaatctgttattctatatggagaatgttaatccacaacgccacgctgaccatgtggcggcaaccgctgctttacgaacccggctgcacgattatttggggataagcacaacgttacacgtcgtgacccatgatcagcctagtgtggcgtttaaggattagctgattatttgagggggaataaagatgacatcacaagatcgaactgatctaaaggccggtgccaaacggcagattttagataactataaattttatgtcttattatctattctatggatggcactatggtggattggcaataccatgtatacccgtaatatgaatattatttcgcagatcaatgcggggagcgctggtttttcgttgagcggcctcttctcatttgcgggattatttatgatcgtggcggctatgctgcgggctggatcgcagctaactatgattgatattgaccggggaagcacgcaaatggacaatcccattcagcggagctttatgctgtttgacaagggccaatatttcttaggctggctatttattagtattttggttgcgattctgacgttcctctggtcccttttactagtagtgcccggaatcattaaggcatattcttactcacaggccttttacatttaccgcgatgcttatgaccgtggtgaatcaatgacggcattacaagcaattacccaatcgcgggaaatgatgaacggctacaagagtttcttgtttattatggacttgagctttctgctttgggacctgctggtggttgtaacatttggcctagcgggactgtttgttctgccgtactatgatttagcacgagcgaagttttataaccaattggtttggcagcaaagtgaaacacagtcggtagcatcaactgacgatgatcgttaaactaacaatggactgggcctaggctcagtctttttttatttaaaattgattggactggaccaaaaaaatccgaaagggggttgtcaaatcgagtgtactaggtataatagtacagatagaacacgtagccaaacaccaaggggtgaacacacatgcaagtcaatgatcagtctggattaccatattacgagcaattgattttgcacgtcaaacagcaaattgttcaggggattttacaaccgggtgatcggctaccctcggtgcgcgatatggcgcgacaagaacaattgaatcccaatactgtgagcaaagcatataagcagttagaagcacaacaggtgatcacaacggttcacggtaaaggaacctacgtccgagaaacggccgtggtcgctggagattcggcacaagttgtggctaccaaaaagcagctattcacactactaacggagcttcgttatttaggcgttccgttggacgaagttgttaaatggattaaagaggcttatcagggggtagaacaatgacgctacaagtaaaggcactcagtaaggccatcaaccaccaacagattattgaagatatcagttttgattgggcgccgggtgagattatcggtctggttgggcgtaatggtgtgggtaagactaccttatttcgaacactaaccaatcaatacgttgcggagcaagggcaggtactgattgatggacagagtacgactcgacacccactacagcagcggcagttgttcttcttagatgggcaatataattttttaagtaattatcgattgtgggaaattcccgaatttttccggctggtttatgcccagttcgatcaacaacgttatcaagacttactggttcaattcgaattggatcggaacagccaataccgacggttgtctaaaggtatgcgtgcgttggttaacctcatcttggcattaacctcaaatgcgacgtacattattttggatgaaccctttgatggcctagatgtaattgtcagagaaaatattgccacgatggtgatcgatgaggtcgctgaccaacaaaagggctttttgatttcatcgcatgatctaaatgaactagatggcttaagtgatcgcgtacttttgttaaaggacagtcgattagttcaagattaccatttggaagagattcgcgagacggctaaaaaattacaattggttttcaatgacaaaacgattccggcggtgctcaaagaacatagtcaacttattcgtgtgtctggtcgggtattagtggtggtcattacccattacacaccagagatagatcagcaattacgggcattgaatccggtcttgttagaggaattaccgttgacattggaagacctgttccgggctaatttagcccacgacacgggttatcagttaatgaaataggagggttagcagatgcataatcaattggatcgattgatttggcgccgtcatcgacgattattcttggcattaggcgcattggcactttttgctaatgtcgtgatggtgatcattgctctaagttcacgacaaactgccggcgcccatcaattagtaggcgcaagtattcatcattgggcaacctataagggtgactactttacagcttattcctactggctaatcttcgtttattggttagcgggattgctactaatgaatcaggacttgaaggataactttaaccagttcctatttaccagtggtttttcacgtcagcgggtttattggacaaagctccgccaatctttagtcgtcctattaggaatttcaatcgttacgattgccgtgcagtacagcttgtattggttaatgaagcctcacggtgttagctttacactagcttggccgggattactaacctcatggattagtggactggctgtggcaacggggttgtttgcgatttgttggtttgcggcgttaattattgggcaaaccggggcgttgatcgtgacggttaccggctttaccttgtcacttatgagtgtaggagcgattagccaaccaatcttaactaaccgaccattttccttatcaggtagtcaattaacttggttagtaatcggtgtttggctgattgcggcgattattttatttgtatggggagcagtactttatcaacacttgtcattggaacacaatggagaatatctcatggtgccccggttgaaacgaccggtgtatcttgtctttgtgatttatgtgaccggaatattttcgtggggcgacacgaattggatggcagatgttgtgacctttttaatcacggttatctttggatatgcctggttgtggcgtccgcgtatcggggaacggttgcatcagtggcgcgcacggcatgatggctaaagagtcagtttgatggttatcgggtagaagaaacacttggggtagttggatgaatcgttgggggatgattcatctgtattaaaaagctgttggatgaaaaatatccagcagcttttttgtggtcttatttatcagctttgaagtataggtaaccaacatatagggtgaaaaggtcgagtgtttggtgggggtccaactgaaagatctgctgcaatcggtcaaggcgatagctcaaggtattacgatggatatgtaaggccgcggccgtttgcaagacattggtgttgagtcggacaaacatgcctaaagtcttaattaattcgcggccatttgcggtactagctaacttctgaaagcgttgttgtaggtcggtaacgtgcagatgaccatctagtaatgcttgaatgaaggcgatttgcgagtagtgaataaaatcaggacgctgaaagatttggctgatgcgtaaggtctgtcgggcctgtcgcacagagttaccaacgttacgatcaaataaaccaatgcccaatcggtgctgtcccgtttgacaataggtcgtgaatcgtgcaatggttgccggtaaggctgttaagacaattaaagtagtcgtatcaaggtcgaactgaaaatcggtcgcatccaatagtccaatgggtaaagtctgtttgggtaagacaatggctgcacggggtttgaggatatcaattcccaactgttgcgcttccagtaacaagtttgtattcgtgtcaatctgctgggtgacctgtgaccagtgatataggaatcgattcaacgttgtttcgtattgcttttcctgaaggttgtgctgattttgatcgagcaatagctcggtggctactcgtagcagagaggctaacggcgtgactttttcagggtcaccagtgataccaataacgccaataatttggtcgttaaaaacaattggcatatttacaccaggttggccgtgatcgccgtaagaatcgtgcatcggtaatgttgtttgttgattgatggccgccacggcgccgacatgcaaggtatttaaccgctgggggtcaccactagcaatgatatagccttggtcgtccatcatattgacgttataggggatctgcgtcatcattttattcacaatatcttgcgcgagtttagggtctagtttcatcgggcaccggtcctttgttcaaaatggtagcgtaaaaagagaaaatctttgatcaattattatcataagcgtttgaccgaaaaaatacagggagaattttccaaaaaatagcgctaatttttgggcagattgccgattgtaccgatttgaaaagtcgattaaagttaaagacatagttacattgctcaattagtaacaaataattagttcggtaagtgactaaattgtgagctagaaaagcgactggtttacgtctagcgagataattgataaaaaagtaaggagtgtcgtacgatggcagtatctgtaagttggattggggcattgttggggttagcattagccattggtttaattctcaaaaaacttaatccggtttatgcgctattattgggaacgattgttggggcgttaattggtggtgctaacttgacacagaccgttaacatcgtggttgctgggtcgcagagtgttatgggcacagtgattcgggtgctagcggccggtgtttttgctggtgttatgatggagtctggcgcagctaatgcaatagctcggggaatcgtcgatcgatttggtgagagtttagcgattctctcgttagcgttggcgacgatgattattacagccgtgggggtgtttattcccgtagccgtactgatcgtagcgccaattgcactagaggtaggcagtcggatgcgaatttcaaaattagccttattagtggctttatctggtgggggcaaggcaggcaatattatttcgccgaatcccaatacgattgcggcagctcacggcttcaatatagagcttagtcaactcatggttgccgactttgtaccggcggtatttggtttgatcgcgagcgtattactagccacattattgcggcatcatggtgcgattgccaccatggctgatgttacggctaatcaaaaacaacaagcggccagtgatgtgtccgtgttaccgtcattaaaggcagcaattgtggcaccagtgctggcgattgtcttactgctactgaacccaattggtcatattcttcacattactttacttgagaagtttgaagtggacgcgatgtatattctgccattagctggattggtgggtatgttagccatgcaccaaggtaagcaggtcttagcctatacgaaggctgggatggcccgaatgacagacgtagttttgattctgattggggctggtgccattgggggcttaatcacgacttccaccttgccaagtgttattgtccatttaatcaagatttcaggaatttcaggaactttcttagcaccgattgccggaattctaatggcggcggcaacggcttcaacctctactggggttattttagctactgggtcatttggtaaagctattttggcctttggaaccgcgcccttggccgcagcggttatggtgcatacgggggcaaccgttattgatcacctgccacaaggaaattattttcacgtaactgctaatgccatgaacatgacgttaaaggagcggatgcagtctgttccgtatgaaaccatggttgggttaaccatgaccgttgtcggggtcctcatgtatgctgtactgtaaaggagatctatcatgaaatttgttattgcgccagattcatttaaaggaagtttaacggcacaggaggcggctcaagcaattgccacaggcttgcggcgagtcttccctaatgcgacttatgaacttgtgccaatggccgatggtggtgagggaacggtgcaatcattagttgacgccacgcagggtgactttcgccaagcggtcgtgctcaacccgttaggtcaacccgtgacggcaacctatgggttgttgggcgatcatcaaacggctgtgattgaaatggcagccgccagtggtatccaattcatcaatgaccagacgaaaaatcctttgataacaacaacctatggaacagggcaattgatgttggatgcgataacgcatggtgctaaggaattgattattgggattggtggtagtgccacaaccgatggcgggcaagggatggcggaagctttaggggttcgcttcttgaatcaacagggacagcccattcaacgtggcggtggtggattagccgaacttgcgacgatcgatacgtctcaagttgatccattggttaaacaggtacatgtgcggattgcctcggatgtgaccaatccgttggtcggaccacaggggtcagctgctgtttttggtccacagaagggtgccacaccagaaatggttgcgacattggaccggaatttacaacactatgcgacgattattcaagaaactctgggcgtagatttagccgattatccgggtgccggagccgctgggggtctgggcgctggacttctagcttttacgcaatcgtcgatggaaaaaggcattgagattgtcgttcgcgaaacccacttaaaagaacgggcggttcaggccgactatgtgttcaccggtgaaggggcaattgatttccaaacccagtatgggaagacgcctatgggaactgcccaagctgttaaggctgtcagtccacaggctaaagtcattggactagccggcaatgttggaacgggaattgatcaactgtatggtttagggattgacgcagtttttggtatcttacccggagtggtaccgttaacgacggcaatggcgactggtgcagagaatttaacgcgtacggcagaaaatattgcacggttgttggcacgtgattagccagtgtggctaaattcatagaataggcaaacgggcatcgaacggcgtagtaacgctagttcggtgcccgttttggtttatgattgacagttacgattgcaaggtcgattgtaaataccacttgtataggtgttcaactgctgacagttttagataacgtaactgaatctcttgattatgattaccatgccgaacgttaatggttaggtgggcaaggcgggtgcgtttcatccaaatggattgtcgtaaatgcagggactggattttagcaaccgggataaagtagcaatcgcgcgtccaccagtggccggcctgcactgctaataaatctgaggtaatgaggccgcctgccgtattggttgctgcaaagttcccctgtagtgctgccagcagtaagatgggcaagctaatccatgcccaagttggcaaccaatagctcaacaaccccagcggtattgcggcaattagcagggcattgcggatttgatagcgtctacgggggacggtcaaagctgttaaggaaggcaacgtggtgggaagccacgtgataaagggatgtaaggtggccatggcttgatcggcttgaataactggcatgatcacgagatcgttgtcatcttcatcaccagcagccttagaagcaatcagaacctgaacggtctgaaggtgtagccattgacgcaatagattttgtttaaaccggaccgcttgaatacggtcgagtggagcactgacggtgttgcgttgaaagaatcctcgcgccgtttctaattgatcggcctgacgcgtgagctcgaagtgatagtaccgttgtaatgtccaaatgaaggcaccgagccaagcaatcataatgaaagcgacaatggcgctcaccaacagaactcgggctaagtgggtggcatcagtgactagcgctgtggtcatagattttggtagtttgttatataggccgagtaagaccaacaggaagggcacaaaaatcatagaggttagcccaaatttaacgaggtcttgtgggttaatacgatagtaagcttggacggtgcctgtcgcgacggtggtctggtcggggatgaccgcagctgatccggtagtagctgtaggtttagtttggcgatagcgggcaattaaatgggccgcggtcgttggaacagcagctaggcgtgcttcaggcgcatggccttcgtgactagcagtttcaatcaatagttcctctaactggaatggtcgtaagtaaaaccactgtttacgctggacggtttgaattcgggaataaggaatgtgttcgtggtgccgcaccaaaatgccggaatgaatgataatcgccgttggtgtgatttgataggttaaggtggcccaacgtaaaattggccagccacaaaagaccagaattagtaataccagactaatggcaaatccaagatgaccaagccgtgcggtaagcaggatgaccattaggtaccaataatcctttagtgcctgggcaatttgttgtaggacgcctaatggatgggtgtgtttaggcttggtcatggcgcgcctcctgggccaagcgcatgatttgttcacgaaggcgctcggcatccgctagttctagcccgtcaatgctgtgactggtggatgcggtggcaactgtcactttagtgagatgttgccactgtaacaacggtccagccgatagtgtaacgttttgaacccgtgcgatcggaatggcaatccgttcttgaaaaataaaaccggcttgcatatcaacggctaaatctgagatttgataccgtgtgaagcgatagcgatagggaatcagtccgagctcaattcccggttcaagcaaagtgagcattaagccaccgatactcagccacaggggccaattccaaaagtgataagccagccacaggaggccgctgatgatcagtaaaactaataagttgccgagggcactgtagccccagatccgtttgattcgttgtggtagatggtgtgcagtcgattggtccataatttagtaagcccctctccgaatagtcttagtctacaggtgagctggagaactgacaacccttccttgacgttaacagctcggacataaaaaatttgaacccaggcctgataagacgtcaaacggtaaacttactgatcaaactgataatcgcaattgacggattttttaagaccccgtataataatctgcaacaaccacatagtccttttaaattagtcccgtgaggctaataagggtccggtagaattcattgatgaaatgaagctagcggtctaaatccttgcggaatttggaccgctttttttatggccgtcggttgaaattagaaacatggaggaatttttacatggcacagatttacgtagcaagtccgttttttagtcccgaacaggttgatcgcgtcaagcgattagaagcggcgttgagcgctaatccaacggtaactgatttttattcaccacgcttacatcaggatgccgaacatgaacagttcactaagccgtgggccacagagatcttccatcgcgatatggatcaaattgcagctgccgatgtgattgtgacggtgctggactttgaagctaagaacctagattctggtacggcatacgaattaggagtggcaacgatgagtcacaagccaatcctggctttacaggaaaaggatgaagccgttaacttgatgattacggaaagcttgcactggtacaccaaacaggtcaaagattttgagacgtatgattttaaaactctgccagctggtgagttcgtcggggaaattctgtaattagatactaggcataaaagtgaaaggtgagggccgatggcacaagaagttaaggtagctgcaaccaaagaaacacaatcgtttgggcatgtcgaatcaatcccgttggcccatcgacggatgtccaactgggatttatttgccacttggattggggccaacgcaaacaatgggacgtggtacattggcggcgttatcgcggcctgcggatttctcacggcgtcgacaacgttgattattgtggggctggtctcgtatgcgctattggcagtcgccagttatatgggttaccaaacgggggtgccggcgatggcactcacgcgggcctcatttgggttacggggaagctttatcccatcgctgatcaatgtcgtccaatttatcggctgggctgcggtgaacacctttattgcagccacctcgattagctatatttttggtgaactgtttggctggccattgtatggtaaaccaggcgggacgtttggcttgattgtggggattctcattatgagtgctttgcatttactgagtatttctttgggagaacggtcggttcgcttgattgaacgaattgggattgttttggttgtcgtgtttgttctatgggaatccgttgtggtctttcggaccgtctcattccatgaaattttgacctggcaaccaccgcataacttacggatgtcatcaggagttgcggcggataccttagcggccttcaatctggcgtgggtaacggcggcttctgactttagccgctttaccgccaaaaaatcagcagccacgacagcctcctttttgggcgctaacttagggcttttctggtttgcctttattggtttatttgcgacaattggcacggcagtttccctgaaccattttgatccgaataactctgatccgagcaccgtggccgctaaattaggcttagggatcattgccctactggtcatcgtgttgacgagtacgacggccaatgccgtcaacctgatgtctgccggttcagcactcaccaatatgacgcatcgcttgtcgttaaatgttagtttgtggttggtgacaattgctgccacactggtaacctttattcccgtttacttagccagcttcttggatgtctttgagacttttctcgacgggattgggatgttcttaggaccagaaattgcgattttcttagtggattatttcttcttaaagggaaaacactatcgcctcgcagaattaacgaaggtgcggggagtgtactggtatacccacggcatcaattggattgccgtagctagttggctcttaggggttgctgcatactgggggttaaaacaagtaccagcgattgcgaccaccacgggggccacgttcatcgccatggctatcacggccgccatttacggctgtggaatgcggtttactaaagcacaacctgttacggcaaaataataaaagcaacgcctccagttaacctttgcgactggaggcgtttttaattaatccacctataaaagaccgggatgttcgagtggctgaatgcccaaattaaggggagccgtggtagaattgtaacaacagataatgagaaggggtggctgaaatgatgcaagaaatgccaattttaccattagtagaacgattgacggctgggcaaagtgtaacgctatcgatcagtgacggacaagagattcacattgcgccagaagtcatcaccggcaagttaaccgggaacttcatcagtagtgcgttaccacaggttcgctacgatgatccccgaattattttaaaagaaactttggcaaaattagatgaacagagtttaacgatcacgagtattgattaacattcggtcggtggcacggtgtatttgcgggtacaaatgaggtgctgctggttaaccacgatgggggagagcattgtgaagattgattttgctatgctaacggctaaggaggttttgcggttacgactgctaacctatattgaagaccaacagggccactttaacttaactgattttgccacggtagctgagatcagctattcacgagcctatcacagtctattgaacttgcggacagatttgcaacaattggatgcgacgacgaccctgacaaaggatgcgctagagacgaccgtcacattagatgaatatcgacattggttatatcagcatagtctaccgtatctggttatggtggcgagtttgacggctgagtatgcttcaaccgcagctttttgtgctgctcaccaggtgagcttgtcaacccttaatcggcggttacggccaatgaaacagcagctcacgcaatataatttacaattggtcgctacacccttacggctaacgggcaatgagacgttgattcagttgctgtacttcatgctctataccacgacgttaacaccgataagtgaattgccaggcttaccagataaactacgaccgttacacgatgcgctaatgacaacctatacaacttccaagctctatcaggaatcacccgggctaaaatatcgccgggatctgttgattacgttggcattattgcgcttatctcaaggatatcgttatccggccttacgcttaccgttggctcatttaacggacttacgccaattagcgacgcaatttcagcaacaattgggggacacaccacaacaagccttgactgagctggcgaccttagattacttgttgacgacttccccgtattttgtgcgggcattacagccggatgcgatgtcccgtttatatcgcggacttcgccagcgaaccacaccggcttatgaattagcccccggagtagttgaactggcagattttgcgacgggacacgattggtttgccaattggttatttgccttgtgccaatttatgttgctctttaaagtcgatccgttcatgcgggctgaaattaccgcgttgtaccggccaacgccggaatcaacggccgctggtacagccattattaccagcatgggaagcttatatccacagcaagtgggggtggccgatcaacgattgattcaaaaatatctgagcaagtatacgaacgggttgtcgctaacggccgctaaagtggaaattttagtatcacatgatatgtacggcgtgaccactgacatttttaatcggttactgagcggggtggttcacgtcagtctgctgacggagcaaacggcgattgttgatcaccaacgggcgaattacttggttatttatggggtggatgaagctgccgtgtcatttgctcaacgccatcacctagagacgtttcattggatcaaggaactggattatggcgagaacttcgatcgattgttacgcacgttacgccatcatgagctgtccttgtttgccctagattttaataatcggggaacacatttggaatcgtaaagttaggatacgctggaatcgaagtgattctgggtatcctttttcattgtcaatggcgcgtgcctgatcttatttagcgatgtctcacgagtgaaagtgcggtagaataaggacaaaaatgattgggaggtagtgagatgacgccaacagcatttaataccgggcgggtacaagtgaataagacaatcgcggagctgcgatctttgggtaaggacgcgcgtgaacgagttccgttctcacaattgggtcagtaccagccacttgatcgggatagtaatcaactgatggatcggattcgccggttgctgattccggaattgttaccagaacgtacgcggcgaatggctgcctcaccttttgctttttttcgcggaactgcggagttaatggaagccgatctccggcagcagcccaattctacgattgagacatttgtttgtggggatgcccatatcggtaactttggtttttacgcgtcaccagaacgacgcttgctattcgatttaaatgattttgatgaagccggcatcaatccgtgggagtgggatctcaaacgattactagttagtgttttactggcagctcaggccaacggaattaaagaaaagaagattaagcagtttttgccgacggttgctgctagttatcgaaagagtatgaagcaaatgttcacgcaaaccacgctagcgcgcttttatcccttaaatgacgttgaaaaactcattcaggctagcgcattgacggatgccgattcacaactgctgatgaccattatcaatcgggccagcaaacgtgactccgagcaggtcgtccgaaagtttactactttggatagccgaggtaacttgtgcttccgcgaaaatgcaccaaaaaccacgcatgtgaccgacgatgtgacgacccatatcgcaacttattttgcggcttaccggcaaacggtacgaccagatgtgaatttgttattatcgcaataccatttgacggatgtcgtccggcacagcgttggggtggggagctttggttcgcggtgttatttggtcttattgaccagcatcgatggctctcatttggtgctacaaattaaagaagctctgccaactcgacagcaaggcagtcagacactggcgcaattaacggtggctcaagaacagacggaaggccaacggattgtcgattgccaaaagatcttgcagtcagcatctgactcgtttctcggttactttgcggggaatcaacacagcttttatgttcgacagttccgtgacatgaaagaatctatcgatttaacgcagctagattggggtcagttgcagacctacgcgaatacttgtgcctggacactagcgattgcccattgtcagagccctacggcagccatgatccggggctatattggtggcggtaaacagtttgatgaacaactagcagcctttgccagtgcttacgcacaacaggtgcagacggactacgaaagctttgtggcctatcgtctacctacgaagcagccttagccatcttgggcgggttcgtgctacaatgaaaccgaatacatatcggtgaggtgaacggacatggctggacaggaacagattcagcaaatcatgcagctctacggggcgataactcagtgctataatcatccgttagacagcttgaccgttaacttgccacaatgccaattgttggggtatgtggctagtgatcatttgtcggttgcccaagtagctaagcggttaggattttcggctactagaacgtccaatctagttgttgatctgtgtcgacagggatatttggaacagcaattagcgccagatgatcggcgccgtcgctacttggaattaacgacgacgggacgaatgttactcgcaacgatcgaacaacaattaccgtcggcgttatcggttcttctgaccgatttacaacggccgattcactaaaaaatctcatcacttgggggttacccccctggtgatgagattttttggtgaatccttttaagaatgactttcacgttttttcaatgagcggactgattgccgatggtaccagccatcggctaagaggccggctagtaaactaatgaatagaccccctgcacccaggctggttaggccaatgaccattaatgtgagttgaccactaacaatggcggcaaggccagcaatgacaagcacggcgataaataaaggagcaagtgtctcaataaaaaatttggtatgggtcatgagtttctcactttctgtaaaaaattgactagctgatattatcttgcaaatagcatgaaaatacaagaaaaaaatcgaattttagcattattattttattgggtaatataaaataaaagttagacgcaactaaaaatagctttacaaacgctgatgagtcagtataatagtgacatactgaggagataggggaattgaaaaaatgacagacaacgtttcagcaaagtcggtacaaggcgacttgacaaacggaccgtcattggcggagattaatgggtcagtacgggttcctaaggagaaagggttcgttcgtaacttattagctttttcggggccgggggccctcgttgccgttggttatatggatccggggaattgggtcacatcgattggtggtggcgcccagtatggttacttacttatgtccgtgatcttaatgtcgagtttaattgcgatgctgctacaatacatggcagctaaactgggcattgtgacgcagatggatttggcccaagcaactcgggcacatacggggaagcggattggcgcggtgctatgggtcatgacggagttggccattatggcaacggatattgccgaggttattgggggagcgattgctttaaaacttttgtttggtgtccctttgattttaggggtgtcattaacggttttagacgttttattactactattattaactagattaggttttcggaaaattgaggcgattgtcctgtgcttgattttagtgattctagtggttttcgcatatgaggttgtcatcgcccaacctagtatggggcaagcagtagcgagctttgtaccacaagcggagattatgcggccgggacagttgacgatggcgttgggaattgttggggcaacagttatgccgcacaatttatacctgcactcatcgattgcgcaaacgcgaaagtttgatcggcaggacccagctgaaatggtgcgggcagttaaatttacagcgtgggattcgaatattcagctatttggcgcttttattatcaattgtttacttctattgttaggtgcggcgatgtttttcggtaaagatgctggtgcactgggaacgtttggccagctctatgatgcgttgcaagacaatcgattggcgggagcagtggcatcacccgtattatcgacgctctttgcagttgcgttacttgcctccggtcagaattcaacgattacgggaaccttgacgggacaggtgatcatggaagggtttatcaatatgcgattacccatttgggttcggcgcctagtgacccggttgatttctgtcgcccctgtcattattgtgaccatcttgtatggtggtagtgagcaggcgttggatcgactcctggttaattcacaggttttcctgtccattgcgttgccattttcaatgattccgctgacgatttttacatcatcaaaacggattatgggcactcggtgggttaatcggtggtgggtaactgcgttggcttggggctgtacggccatcttgacggtattaaatattcagattgtctgggcgacgatgacgacgctcttttgataatggtgtattgacttttacacaggaccccggtatcatcgagtgcataagcaaagaagcagttcagtagtggtggcggctccggttgagagatttgacggtgctgggagtcaaaacgtccgtggccatgaattaccctgtggagcggccgaggtgtcggcgggtcattccgttaacaatgacgagcggttgtcaatcgacaacaacttgggtggtaacgcggatttcaattcgtccctgatggttttaaccattggggacttttttattggagaaataattaggaggacgagcgtatgtcaattattgatgagttaaagtggcgaggtgcgatcaatcagcagactgatgaagctgggttggccgaattggtcgatgagaagtcagtggggctctatgcaggaattgatcccacgggagattctatgcatattggacacttgattcctttcatgattttgaaacgattccagctagcgggacaccggccgcatattttaattggtggggcgactgggtcaattggggacccttctggtaagaaggccgaacgggttttacaaacaatggatcaggtgcatcataatgaagcgtgcttgacgaagcaaatggaacatctctttggtcaagacggttcctttaaaattgttaacaactacgactggctgtctaaagtttccttattagattttcttcgtgattatgggaagctctttaacgtcaataacatgttaaacaaagaagtcgtggcttctcgattggaagttgggatttcttacactgaattcacgtaccaaattctgcaatccattgattttctacatctatatgaagcagaagatgtacaactccaaattgggggtgccgatcaatggggaaatatcacggccggaattgatttgatccataagcaaaagggtgcggatgctaaggcttacgggctaacgattccattattgttgaaagctgatggcacgaagtttggtaagtcggaaggcggcaatatttggttagatcccgaaaagacatcaccttacgaattctaccaattctggattaatacggatgatcgggatgttatcaagttcttgaagtactttacgttcttagatcaagatgagattaaacaattggcagatgctgtagctacccatccagaaaaacgggaagcacaaattcggttggctgaagaagttacggcgtttgttcatgggaaagaggccgtggtggaggcccagcatatcacgaaggcattattctccggggatgttgcggcgttaacggcgagcgaaattgaacaaggcttcaagaagatgccagcggtaacggttagtccagccaagaagaatattgtggaatggttagtggatgatacccagattgaatcttcacggcgtcaagcacgggaagatttaaccaatggtgctatccggattaacggcgaaaaggtaactgatacggatgctgaaattgacccgactagtgcttttgatggtaagtttgtcattgttcggcgcggaaagaagcggtatttcttggctcgcgtagtgggttaaataggattttaggaagcacgaacgttcattgcgaatgttcgtgctttttgttggaaaaagtaaaaccgaacggttataatttaagagtcagggaacacacggcctccgggtaactattcaacggctttcagataaataatatgtctttgaaaaaagatgcaattattttcatattttagttgacgtgtcgatgctcacttggtatagttatatacgttgtcacgacgagtaaccaactagaccaattcgaaagattgaaattagttgttgacaagtaagacgacgatatgatatattaatcaagctgttgcattgagatagcgaatcagcgagaaacgttgttaaatcaaatttcttgttgacatcaaatcagcaacatgatatgatgattaagttgtttgcgagagcaaacacaaggtagacctttgaaaactgaacattgtttcgacaaaccaaatatgtgtagggcggtttgattttagaatcaaacccaaacaatatttgcgaagtcaattcgcttttaaaaatgtaaattgccaaagtataagaagtgttatttgagattgttaccgaatcttaagtgttgcttctttttgacgcattagtcttgatttgccatccaaatggttcgtttatttagctggcgagtaaggatgggctttgagcaactgactgtaaaactcgatgtccgcaaaggcttcctgcaatcgctgagcaaagtgggcactgttggttgcatcggcaagcaaggttccttggtcagtgaaattatcgtccgcgttccagagaagaacgggtgttggtaaaacgatcatttttaatatttgtaagatttcaaccatggactcagccgccaacataccgccatcactgtaatgggagtaggtgatgatttgcacaggcttgtgatcgacttcagggccaacaaagtcgagcgcgtttttgaggatacccgggatggcatgatcgtattcagggctaatgatgatgtaaccatcttgtgcggccagctgatctaaccatgcctgttcaggggtgctgaggtcgtggattggcgtttctagaggcgtttcttcatgatcgtagaatggtaaaggatagtctcggagcgccaaccacgtgaacgttaccttgtcagtgttggagaaggtgcgttgtaagtagtgaaatagatgactccccaaagacggttgccggggcgtgcctaaaatgataccaattctagtggtcataaagatcctccttgtgttaactaactaaaagtaagtataagccgaatttggtttagcacgttgataatcgtttgtctagtaggtatggaattattaatgactgggcttgaccgttcactttaattggttgtaatgagcgccattaattgaagtccaacagttttgttagtataataaacaataattggtatagccgttatttaagatcaataattcgtgagttatgaggaaagctcaaatgagggatcataatgaaaaaaacagtcattaaagaaaccgaacgattgctgatattgttaggagcaactggtttgttgagtggcataggtattgtcatgaatggcacacctataacggctcaagccacaacgaccacaacgcaaacgcagggaattttacattctggtgattttgggacgagtcattggtatatttcggatgatttaacattgcacattggtgcggggacgtttgccaacttgtcgaatagtcaaagtgcgccgccatggacggcttatggcgaccaggttgccaaaattgtgattgaagggccggtaactttggcgcctaatagtcgcgaactttttggttacctcggggccaccagtattgaaggtcttgatcaaattgacgccagtcacgtgaccaactttgaatttgccttttttggcattcaggtgccgaatcttgatctgacgagttgggatgtccacaatgttactgacgcgggtttcatgtttatgcgggctcagtcagatgtgattaatctgtctggctggcaaatgccaaagctaaaattggcccaatggatgtttatgctggcgccacgagtacatgaattggacttggctggaattaattttcgcaatgcagatgccacgcgggcattgatgaatatgaatctgacggttattcatttaggaccagattcacttttgacggggaccaacttacagccatttcacaatgatgcctatcaggatatgtggcaagatatcggtgatgggactactgaagcgccgacgggaaagaaccgatacacctattcacaactcatggccgagtttaagggagcagcgccatacacgtatgtccgagcgaagaatcctgggcagccagtgaccgtgcagtatctcgatcagctcaatcaggcattagtcaaggccgatacgttgactgggtattacggcgatacgtttacggcgcaagccaagactttcgctggctatcatgtgacgtcggttgatggtgagccaaccgggacgtttggcagtcgtccgtacacggtgacgtaccactatgctgtagatgagaagaaccaacagagtttgttgggtgaagatgcaacgataacggtgggtgatccagcaccgactagtgaaacctttaaggctaaagccacggacaaagatggacaggcattaccagtggtggtggatttgagccaagccacgcttaatcaaccggggcgttacccggtgactctaaccactcgcgatggtcagtctaaggccgttacgctgacggttaaggcggccgacgagtcgagttcatcaagctcatcaagttcgatagacaggagtcactcatcgagtaccccgaccagttcgtctaattcagacgatagtttatcaagtggtgacttgatttcaggaggcgacactgacttagcggttttcaagggtcaggccgtttacgcaaccaagaccgtgcggctgtatcaacggccgacatttaaagcgtcacaagtgcgggcacggtatgccaaacagtcacgaactaagcggccgatgtttgtcgtaattggcagtgcgcattctaagcatcacgcgctacgatttaaagtgcgggacgtcaaccatcactctaagacggccggcaaggttggttatattaccgccaaaaaggcttacgtgacgaatgtttactatcaacgcacgtatacccgagtgacggtcatcaatccccaaggggttaatgggtatcgaacacgtaagctaaccggcaagacgcggcattatcggcgcggacaaacgttaagagtcaaacggctagtgcggtaccatttaactacgcggtatgtactaaccaatggtcggtatgtgacaacgaataaaaaattggtaaaggtacagcaaaattcggtgcagcaaagtacgcagcattctgcggcggtaactacccgaaccatcaaataaaagtgatgacgaaaaagcgcgcccatttctgatgaatttatcagatgtgggcgcgcttttggattagcatgtggttgttccacatgaaacaatcaaggtgtctggttttacgcctggtcgtacttgagccacaaccagtaatattgtaggttgctggcaactagggctagccaaatgatggctaggagcgtttgccccagttcctgagtcgagaggtgccaattcaacagtaagcagataatgccgagcaatccgtatagaaaataagtggcactgaccatgactgtggaatgaactttcagagtaatcagccgatcgcgttcgtcgtcaacccagtaaaggcctttaaatgacttgacgccgaggtgctgctgcatgtaccagagcatcgcgacacaggtgaccaccaacacgagcgatagaatcggtgcccagatataaaatagatgactgaaactgacaataatcagtgcagctaacaacagaaatactagattgttcacccaaaatgtaaaccgaagaatccttttagcacgactcatttgacatcctccccgttactgaataatgcatcaacagtggtctctaaaatggcggctaacttgaatgcgagggatagtgacggatcatacttattgttttcgatcgcattaattgtttgtcgcgtgacggcggtcagttgggccaattcggcctgtgacaactttcgctgtttccgccgagtagcgatggtatttttcatcaagattcacgtccttgtgtcaaacatctttgacaaattaagtaaaacatattttacatttttagtcaacaattagtgatcctgatagcataaaaacggccatcgaaagggaatccgatggccggtttcgtttaattgatttgttagtgattttcaagttctaatagtcgagcccgcaaggcatcatcgtacgctgttaggtagaggccgtacttaccgcgcttcattaacacgttaagcacgttggcaataaatgttttgtattcggcgcggctaaattgcatgtctttgcgtttcttgaagatttctttgtgtgaatacttttcgggaataatcgtcatggtatcggtctgcggatcgtagccgaacgatggaccaataatcattcccacatagttcaagtcaaagccctggagtgtgtagatcgtaccgacttgcgtaatggagccttcacgtttcgcccagtgagtccgctgggggtcccattcatcccaagggaggctaaaggagtccatttccacattgtggcgaccatcaatgcgtggaaagccagaggtggccacgacgcgactcataccgacttccttgttgcgctttttgatgttttcgaagagttcaccagcggtatcaaacattttgaattcgaagtcactgttttctgggaaggaacgcagcggtttttcagctgctaaatcatccatccaggcgacttgttcgtcactggcgaccatgcggtattggaagttcatatcgaatcgcttgtggggatgatgaccgatggtttggtaaagaaggtcttggtcccagtacattttggactggaagacttggtcgaaatcatatacgaccacgacgactttagctaaattcatcaggtcggtcaattggttttggccgcggtagtgggcgtaaggttcagacttggagtagagcaaatgggcctcatcaacaaaaataatatcatattgcttatgatttttttgcgcgtagttaatgagggaagtgggccggcgaatggcgctggctttcatattggggatggattcagccaaatcttgataggctttataaagttcggggtgattgaccacaagcgaagtccggtaacgtttgtcggtcatatactggcggacaagttccattaagacgacggacttaccagtaccggccgcgccctgaatgatggcaacggcggattcttggccattgaggctgtccttgatgtaatgattcatgtcggtaataacagccttttggtcgtcagacaaatcgtcgacaaagaactgttcctgtaaaattttattcatcgaataactcctaaatttagtgaattagcgtcactgagacgttggaaatagcactattcattatagcaggttacggtgatggcgctgaaatttttaaggtggattgactggggcgggaaagtggttactgctggatgtaagaaaagggagaattttggaatctagtgattatagttggcctaaattatttagtcggttaagagtttgtgaatcggagatagctggagtatgctttaagagcaaagtgataaaaatagccgaattttcaaaataagaatgccggtatatcaaggattctttagtgtattccccacaggtgtgggggtaatagttatcaaggtttttagatgctggacaatgtctcatatttccagcagatggcagaatccgtatttaaagattccaaatagaaatatggccttttacatggcgctccgttcttaaggagatatcggctattcagaagcgtaaaaaggaaactagctcccaatctgatcagaccagtgttagtcatcgcgtatggtatactggtgaaattagaaatcgcttaatccggtcgtatgcccaccgaatcagcattttacagtcaaataaaccaccaaaagaaaggattgtcacgatgtcaattttaaattatgcggagcaggattcatggtcaaatgggtttggttcccaacaatcaccgattgatctgcgtcaggctgaacccactagtgttactaattttgtagtgacagatccatggatagctgaccgagaaatcgatgaccaagtgaccattcagcttgctggtcacgggacaacgcgaatcaatgagatgacttggcattttgtgcaagcccacatccatgtgccagcggagcatatcaccactgaagaaacggttgccgaactgcactttgttcatcaatcagttattggtgcgttgtgcgtcgtggcggttctcgtgcccataggtaaagccaatccgattattgacgggattcttgatcatttccagccacacgccacggaatcaatcgactgcgacttaaccggtttattgccaaatcgtggcaccgtttttcaataccttgggtcactcaccacgccgccgctaaccgagggcgtgacgtggtacgttattgaacaaactgatattactatcagttcagagcaacttaagcgctacaagcaactctttggaccgaataatcggcaagtacaggcggccaaccaacggccagttcttcgaggaagcggaacctttacgaaatagcgggttcagcggtatggggttaagctacttgtggttatcgaataataggcgggaaagcacgttcttagaagaacttactttcccgcttattttgatggctcaattagtaaaccagccaatgaagccagaagatcatttaccgacaatatcaaagtattttaaacatagatggatccctgattaattaattcggtagaaaaacagtccgactagcaatcacgctgactatacatcagataaccttatatgttataacgagcttagaaggtgggacatttaagtgagcttcggtgagcttgccgtatttgcagaactgagggggaactatgagtcgctaaggggaaattatcatgaaagtagttaggaccatttcaaaagtattacttgttggtgcgctggcactagtagggattggatcactaaagggtcaggccgcccaggtcaaaaccagccatgcgctggctaattataacgttaaggcagttaaactgattaaaaataaagattactttgtcacgcgaccggacacatatgccacgtcctcgacgtatcggtcgcaaggcacgtttcaaacgacaccggatatttaccaatccgtcagggggcacacagcgtttttgcggacggcattatatctaccggtgacggttcatcattctggcgattggagtgatccgcaagcggtagtcgtgacgccgaatgggaagaccgtgtatattgcttatttaaaagctagtaacaccacaactggttgaattgtcagatacgatttggcaaaattggttcaggcgctaggtggatacacatcccgcatggatgccttgcggcgggccacgaatgcttattctaagcataaagccaccagtcgggatcgcagtttgcttaagtacattaaggaaggaccgacctttgatatcggacacggccaatcactggcttataatccaaaggacaagcaactatggtttaccagatcaaatggaaaagcgggacaatatggttctgccgttaaggtatcgtcgaaaacgttacgaccgaccaagcaggttgcttaccgattggttaataaacagggggccaaattagctgtgaatagcacgctagcttttgatcgtcagggttacgcgtactttagcagttacagtggtcagcgttctttgagagtctatcgggggacaatgaacgatcacggggtgcatttcaaattgatgatgcaggggttggcttatcgcccgggccagacgcatcaatccatcgcgtataatccgcataacgatcggctatactttgttagtgatgatgcaatttcttcagtgcctgtgaaaaaacttcgtcagcgtcaggcaacgcctaaggatgttcatgcttctgtctttgccagtcagcgggaatttgagggactatcgttcactgctgctggtcaaggctatctgattttaaaccggggcgctgagcttatgcggatcgatattagttaaggctttccacaaatgaacccgtgggcttatgaagcatctagatcttcgcagatttaggtgttttttattaggatttttgtcaaaacggcgcggtgacgacaagtattaatcaattatgatagcgttaccaatagtgatatgataaaagataacacaacatgaaaggattgaaacccatgggaaatcttgaaaaaatgcatacgggtgacctctacttacccgatgatccggcaattgaaaaggatcagcaacattacttagatcggctgtatgactacaatcatacccgcccaagtgacagtgcgcagaaacaggcgattttgcatgagttatttgccgaaatggggaccaactgctatgttgaaacgccatttcatgctaatttcgggggccaccatgtccattttggccaccatgtttacgctaattttaatctaaccttggtcgatgatacccatatttatgtcggcgatcacacaatgatcgggcccaatgtgacgattgccacggccgggcaccccattaccccggatttacgggcaaagaactatcaatacaatatgccagttcatattggaaagaactgctggctaggcgcgggtgtgattgttttgcccggtattacgattggcgataatgtggtgattggcgcagggagtattgttaccaaagacttgccagataacgttgtggcggtcggtaacccttgccatgtgttgcggcccgttaacgagcatgaccgtgaattttattttaaagaccgacggattgatccggcattatttaaagcctgattcgaccgattggtgttaaaacacttttagaagaaagtcttagtcgtcaatcgacaacgagtttgttataatcactgaaactagtaaaaatgaggtgaatcgtcgtgagttggaaaattcagcgttggaaccatatgcagactgatattatttttgtaaaagacctccaaggggcgcagtctgtccaattttccaatactaatactcacggtttcatctaaagacgacagttcatgtgttcacggacggtgtgctttagagcaccgtctttttttgtcgtcgccaatccttggaggcgtttgataatggttaaaatcatgcaacgtaatttacacttgggctatggttataccgcattggcgtatttcggaattaccagtctttgggttattttcctacaacaacgcggattatcgctggttcaaatcggtttatgtgaaagtgtttttcacctgacaagtctgttttccgaagtaccatcggggatgctggctgatcgctttggctataaggccattttaattggtggacgagttgcggcaatagcccatgctttaattatgctaatggctacaaatttttggtggtttgccctaggtttcgtgttacaggcgtgggcctatgatttacaatcaggaacaatcgaggcacttctgtatgactcgctagctgaaaatcacgccactgagcggtttccggtagtgactaaaaatatgaatatggtcattgagagcgcgacgccggtgggcgtgttgctggcaggtgggttcgttcatggtcacttgagtgttacctatctcttgtatatggctagtgcaatagtcgcgattggctgtattatcggactgcgtgaaccgctccgcgaccaagcaactgcaatcaccggcacgcaatctttaagtgccattttacgagcggcaggaaagtgtctccgcaaattgcctgaattacgtcagttgatggtgtttcacgcggcttttagcgctctgggaatgacatactactatgactttcaggcagtcatgactgctaaaggattcagtggcccactgatttctggcattctgattgcaacggcaattttaaatgtggggggcgtgcagctaacgccgtggttacagcaaagatgggcactggtgcggttattacgtggcctgacagctttgcttgccagtgtgttgattagcgccttgtgggccaatacgttaggtctggttcttggctatctcttggttaatctgttattagcgattgtagagccagtgctgtccaattactataatcggttgcttcccagtgcgcagcgagctacgttactcagcgtttccagtatgatttttagtctgatgatggtcgtgctatttcccgttatgggatggctgattgaatggagtagcttcacggttgcttttggtggcaccggaatggtcgttctggtttgcggctggttggcttttcgtcgatagtaattattaaaaataccgttgctaggtttattcccagcaacggtatttttaatattaggttcgggtgatgaaactatggtgacatttgggacaagtcacttgaacgcggccgtgatggcgtggcacgcgaatccgttgctgacattgagcacaatgaaagaagcggtaatgccaatgttgcgacacctggtagcggaggcggcgaaatggacgcgtaatcggaagccaaacgcgttcaaaggcccgattgaggcgcacttgacgatagatcttacgagaaaatagtcgccagtaagtcagggaaatgagcacaatgacggcgacagccagccacagcgtgtggataaataagttgagaatgagtaacaagaaggttaaataagtcagaaagcgattcagactatcattctgaccgtaacggccgatcatccaagcttggagtcgacggaggaatttcgagttgggtttcatagcagactaccctttcaattaaaagtcaatgtttagcctaacataggttggtgggcgactgcaatttagatagcggaaattattattaatagttaaaattaaagctttgattattagaagtggatctgaaacatgattcgaattctatagaaaaacaagaaaagtcctcaaaaattgagaatttttcctgcttttatttattggaagccttaattagttctaatttaaaatttcaaaaaaaggaatttaatgatgaaggtcgggaggcaataaatcggcggctgatgtaacttgcaggttctataagttgtgattgaatccagtgtatttgaatacaagcgcaaccataacagtcaaattgaatatcaaattggatctctttggtcagtgcttttaatccagctttacaggtgatgctttgccgacaatagtttaccgaatatcgataaaataaatttatgacaaattgcgtatcgtatgcttgtagaagtttttcaaaaaaagtctgctgttgttgaataacagtaagagaattcgtaattcgttgttcaatgggcagcgtttggtcagtaaggcatctacccatttgcgtggtgtagtaccaggtgatcaagtcttctttactgttgaagtagttataaaatgtctgacgcccggtatgacaattatgggtaacatcgtgaatagtaattttccttatggtcttagttgatgctagatcaattaaagaattagctagtagctattgagtggactgccgatgaatcataaagattacctcctagcattagtataattatagacatttgtactgttttagtacagcgctttcaaaacatctctaacaactatttaaaagtcgcgatatgctcattatagaattaatgaaggaggaattgttatgatggttggtcgattacaaggtaaagttgcgattattacgggtgcagcgagtggtcagggtgcagaggaagctcggttatttgcaaaagaaggagcacaagttgttgcaacagatgtgcaggcggcgcctttatcccaattggaacaagagattcaacaagaaaatggaaatgtcattttaactattacgcaagatgttgcaagcgaatcaggctggaaacaagttgttacaagtacaattgagccctttcataaaattgatatcttgattaataatgctggggtaacgggtaaaacgtggggacttgcggatacaactgttagcgactggaatcaagtgatgaatattaatgccctgggaaactacttggggatgaaatatgtggtcccagaaatgaagaaagttgggcaaggatcaatcgtcaatatctcctcattagccggaattcatggtattggtggtgcaacaccatacgcagcctcaaagggtgcaacgagattactttcaatgggagcagcgagggatttaggccctgaccacattcgcgttaattcaattcatccggggtttattgagacgcctatgattagtgacttcactaaagatgcaagtgttaaacaaagtgtgattgacagtgtaccactgggatatttaggaaaacccgctgacgtggcatatgcggccctattcttagcttctgatgaaggccgctttgtcactggttcccagctagtgatcgatggtggtcaatcaatcaaagagtagaaaaattttagcgatatcaaataacataaagtgccggcttaataattacaaattaagccggcacaatgtttcacatgaaacaccctctaaaaaacggggtacgccgcatggacggcattttttaattgatcgcctagtcgatgcataccggcatcgatctgggttgggttgacaccactaaagctcaagcggagggcgttgtggacatcgcgttgtggatagaaattagtcgctggtacgtaggtcacgtgcgcttggggactaataacatctagcattaaccggcccgtatcaatgtcttgcggtaaggttacccaatcaaagaatccgccagccgggtgagtgaagagagcttcatccgggaaatagtgggttagactttgaagcatcgcatctcgttgctgtttgtagtgcgttgtcatgcgttgaatatgggcatctaggtcattagcgtctaggtaagcgttaatggccgcatggatgacacccgtggtctccaaatcactagccagccgcatctttaagatggcatcgcgtagctcaccatcagcgattaaccagccggtccgcaatgcaggcatgagaatttttgaaaagctagaaagaaagatcacgcggccctcggtgtcaaaactcttgatggcgggcaatggggcaccctcgtatccgagatcacgatagggtgtatcttctaagataatgaaatgatagcgattagccaatgccaccaactgttggcgcttggcgacactcattgtaattccggtgggattgtgataatccggtaccgtgtagaggagttttacgttgggatgttgttgaagggtggtctccaacacgtcgagatctaggccgtcagcttgtagtggtacagcatggtagtggggttggtacaagtcaaaagcggccaacgccccgatataggttggaacttcaacgatgatatcatcaccgggattcaatagggtttttgcgacgagttctacgccttgttgaccaccgacggtcagcaaaatattatcagcggtagtcgtgacgttgccccatttggcaatgcgcgtaaccagtttttcacggagagcgctgtttccttgagccgattggtactggaacaggtgggcgccttgggtatcaatggccgtattaaaggccgcttgcacctctttaactggaaacagttgctcattcggactaccagccgcaaaagttaccgcagttgggttgggatcttgcggaaatagtcccgctaaagcagaggaaacatctggattgacgcgttgcgcaaataagtcgttcatcatcgcacacacctttctggtcgcttcgaacgaccctcgctaacttatccgattacttgtttagtaggatagcggtttttgaatgaaaagtaaaattcaattaattcatttttaagtgaatgttattcaatcttactaaatgatttggttatcggcataagcgctggtgggatggccgtggtatgatgaaccaataagacttacagataaaaaaggagcgcagtcatatgaaatccatcacagcgggcattgtcgcccacgtggatgctggtaagaccaccttgtcagaagccatgctataccaggccggtgcggtgcggcagcttggacgcgtcgataatggggatgcttttttggacccggatgcgttggaaaaacagcgagggattaccatcttttcccaccaagcccgattgacgtaccaagacctagcgctgactttattagatacaccgggacacgtcgattttgctagtcaaactgaacaagttctgagtgttttggattatgcggtgttagtcatctccgccaccgatggcgttcaaggttatacccgaaccctgtggcgcttactcgcgcgctaccacgtgcccaccttaatctttgtcaataaaatggatgcacctggtgctgatcaggcggcgttgttaacgcaactgcaaaccgaactatcaccgggatgcattgcgtttgacggcgcccaaatttccgcagcggctagtgaagacattgcgatgttagacgagtccgttttggctgacttccttgattccggccaattgagtgccgcagtcatccagcgcatgatagatcagcgacaagtctttccttgctactttggtgcggctttgaaaatgactggggtgaccgagttgctggcgggagtgcagcagtggacgactcccagtgaaacgacccgtgattttggtgcacgggtatttaaaatttcccacgatcaaggtgaacgattgacgtggctgcgagtgacgggcggtgatttacagcccaaacaagtcctgctggaggagcaaaaaatcaatcagttacgagtttataacggggttaagtacaccgtgcagccacaaattctggctggcgatgtctgcgcaattccagggttaacgggaacgtatcccggccaaggcctggggaatgtcccagatagtgcggcgcccgttatgcaacccgttttgaactatgcattggacccacaaggacaggatctgcacgcctgtttggccgctttgcgggagctggaggatgaagatccccaattacatgtgagctggtccagtcacctgcaggagctacgggttcaactgatggggacagttcaattggaaattttacagcagctgttgcaggatcgtttcaatctgacggttcatttcggcgctggccggattctttataaggaaacactgacgaaaaccgtagaaggtgttgggcattttgaacccttgcgtcactatgcggaagttcacttgctcatggaaccggctccccgcgggagtggattaacctttgccgccgactgttccttggaagtgttgggccgcaactggcaacaccaggtattaactaacttacgcgccaaagaacaactgggagttctaacgggttcgcccttaactgatgtcaaaataacgttggttacgggtcgagctagcattgttcattcggttggtggtgacttccgtgaggcaacttggcgggcggttcgtcaagggctgatgatgcgacaagacgatggctgtcaattacttgagccgtggtatcgtttccgcttagaggtgggccaagagcaagtgggtcgagccatgacggatgtgcagcgcatgcatggcagtctcgatgcggcagttgatccaacgaccagtcgaggtaatctcaccacactaacgggggttgcgcccgtgtctgaaatgcaagactatgcccaagctgtacaagcttacacgcatggtcagggccaattggaatgcttgattgatggttatcggccttgtcataacgcggctgagataattgcacagcagcaatatgcaccagtagctgacctagagaatacgccagattcagtattttgtgctcacggtgcggggtatccggtggcttgggatcaagtaccgacgatggctcacgtgccgtatgtgtattcagatactgacttgcctcagtagtgatgtgttataattgaggccatcttggggatttgcaggcgatacccacgtgaaacattgccgttgatggaaaggatttgcgatgcggattaatgtcttgcaacatacaccaaatgagggtccaggagcgattttatcttgggctgcagctcacgaacatcaagtatttatctatcatccctaccagtttggccagttgccaatggcagcagaaactgatctgttagttatcttgggtgggcccatgagtccaaatgatgggctgccttggattaagcaagaacgccagttgatccaaacgctcttggataaagatgtgccaatgtttggcgcttgttttggggctcaacagattactaaaacgctggggtatccggtaaccaaagcaccggttaaagaagtggggtgggccccaatttatcggcaaacgacgatagttcccggcctaccagaaaggctcaatgtgctacattggcacgaagaaatgtttgcgatcccaactgaggcgaccttactctttagcagtgatgatgtggtcaatcaaggatttgttcttaatcaccgtgtggttggcttacagtgtcatttggaaccacaggcgacgaatgttcgtgagatggtggttaacgatttcccctacattcacggatcagttttggggcaaacagcgaatgatattttagcaacgccggtacctagagccaatcagacagccttgtttaacctgttagattacatggtatcagccgatcagtaactacaactatattgattaaggagtcgttgcgtaggcagcggcttttttagtttagaggagtgaaacgaagtgggtttaaaggatctatattccccccaatttctaacgaatttgggtatacagttgcatcaggtagcgccgacttttgatgtgacacggttttgccaagcatgtttaaccgaagcgtggtctgatttgaaacttatggaacgtcgcgatgtgattaccacacagatgcatgcgcagttaccagctagtttttcacaagcagcagctatcttacgccaagttgggccgaattttattgggctagccgcagtgtgcttgcccaattacgtggcggtttatgggttagaccattggcaagtggcgatgacaacgttggccgtcttgactaaatattcatcagcagaatttgctattcggccatttttgaaacgttatccgatagcaaccgcgcagcaaatgcaagcgtgggcgcagagtgccgatgcagatgtacggcgactcgctagtgagggaatgcggccccgattaccttgggggacgcgactaccacagtatatggctgatcccacaccggttttagcggtgcttcatcagttgttctttgacaagagtgactacgttcaaaaatcagtcgccaataatttgaatgatattagtaaggatcatccaggagtggtgatcgcctttgcccaacaatactggggccaggccaaatcgggcgactggatattgcggcgggggttgcgaactctatttaaacagggaaatccggccgtattggcattaatgggttacgacattactgcggccgagaaggtaacgggtgtgactttgcaaccagagagtgatgtggcagtaatcgggggtctgacaacggtggcctatacggtgcgagcgcctgaaaccatgccagtttatttaggctatcgggtcggctatgttcgacaaaatggcacgacgacagcgaaagacttttttgtaaagcgaacgactctgccagccggccagttattacaaggggtgtttaagcttaaatggcagcagctgactacgcggcgactgtatccaggagcccatcgcgtggcgttgctggtgaatacacgggtggtggctgaaagccggataactttggaatgattatcaactattaataataattaataactaaatacgagttaattattattgtggggaattgtaagcgcttgacaatttggaaaaagtgcgtactctagaacttgagtactcaagtaatcgaattaagggactgaaagaaatggccattgataaacataaacgaaatagcagtattcgagcgcaaattgttgcggatattcaagctagtattttaaagaatatgcagaccggcgataagctaccatcagaagcggcctatgcacgacagtatgacgttacgcggtcaaccattcaaaaagcactcaaggatttggaagacttacagatgattgatcgggttcaaggcaaagggagttttgtgaagttaacgaaaccaaagattgatatgtttaacttcaaaggtttttctgactatgccttgcagttaggaacgacgccggttacccgggtcttaaagcaagagattgttgaccatcacttgatactgcagcgattacggggaatcaaaaccagtgatgaagttgtccaactgactttagatgaatcacacctcaatttggagcagtttccagggctagaacagactgactttgagcagaattctttgtaccaaacgctacgaagccaatttaaagtttatccagcgacagctaaccttttggtcacaccaattatgccaaccgtcgcgcaagcggagctgttagaagtggctgatagccaaccgttacttcaagtaacgggacaagtacgtacggccaataatgacttggtcgaaataatcaagattatttatagtgaccaatctaattttaaatttgtggttggcgtataaagcgaaagggagtagagaatcagatggaacggactaaggataaagtattgggaacaatttatggacaggcgattggggacgcgatgggaatgccctcagaactttggccggttgaaaaaattcggcggcaatttggcggtctaattacgacctttttagatggtccacagaataatgatattgctctgaattttaccaagggagaatataccgatgataccaaccaggccctagcaattttagattctctaattgaaacgaactggcaaccggatcagcaaaatttggttaaacatattatggcttgggcggatgctgtgggtgcatgggataacaatatcttggggccaagtagcaaggcggcattgaaggccattaaggcagggcaagacccggcaccggttacagctaaggcgctgacgaatggatcaggtatgcggattgcccccattggcacgctgtttacgccggatcaaatcaatgagttggttcagatggtctatgaggttagtcgcgtgactcattctagtgacgttgcagtgagtggtgccagtcttatcgcgggcgccgttacggcagctatggccgattatgagtgggatgatattgtgacttatgccttaaatgccaatgatttgggctaccaaatgggtagtcatacttgggctgccaagactcatgagcgagccctattagggattcaattggcgcagcagtaccccaatgatgagcctaagtttagtcaggccatttatgaccttgtgggaactggaacgatgatttcggaaagtattccggcagcattcgcgattgcctactacgctcgagatgttcaaaaatgtgccttactttgtgctaatttaggtggtgataccgatacgattggggccatggcaaccgctatttgtggcgctaagactggatttaaagctattgatcctgcttggattcagacaattgatgaaaagaatccgcaacacattatgtctaactatgccgatcaaattcttagttttaaagcgaactagctttttggaggattatcataatgaataatgagctcgtcaaaatttcggatgcagataaaacattaacgccagggaaaattttctacaactggtttgccgcgaatattgggattatgggattcgtctttggtgcgatgattgttgcttatcatctgtcgtttgcccaagcaattctcgctgctttttgtggcgcgttgtcttttttagtgccaggatgggtggcgatgattggtcaacgagaaggtgtgacaacctttaagctgagccgggcggcctatggtactcgggggaataaaattcccaatgccatcgcttggattaatatggtggggtggctttcggttaacgtgattacggggaccatgctattaatttccatgtacggtgttttaaatatccccaagaacaccgtcacacgggccgttgctctggctatctttggtgggttagtgctgctgtctggtttgttaaaagaagccactttagccaagattcaaacatggttaagctatgtctttggcgcgttaacggttgttattttggttctcttcttgctaaaggcggattggcaggccgcttttaatcttccaagtggtcattggattagcggtttcttgccagctgtcagcatcgttgccgccggttcaggcatttcttggtcgatggccgccgccgattggggtgcctatgtcaagccagaaactaaaccgcaagcgaccttttggggaacagccttgggtggcgcaatacccttgtttgtcctcatggccggtggtgttttgttaagtacgattgaaccggctttggcgacaacgggtgatccgtttggcgtaatgtactcagccttaccaagctggatcggcgtcatctattttctggtagccgctgggggtctaatcccgcaatgtattgtatctttgcggtcggcccgaattaacttggggacgattggaattcgcgtgtcacaacggacttctttagttattcatggtttaattgtgattttgattccagtttacgttctctttatctcaggaaattttctagctaacttcgaattgttcttaaactttttggggatttgtttggctagttgggttgccatcttcctatgcgatagtgcgatgttcagaaaaaacggctatgagttggcgttattagtgccagattctaaaaagcactataactggggtggcattatctcttgggtcattgcgacgattacgggttttctgtttaccaataatgcgatttggaatggcccatttgctcacgggatttttagaaataatagtctcggcgtttttatctcggcaattgttgcgatcatctgtatgttcatcgttaaaatggtagcgtattcaaacaatgagggggttagccatcatgagtaaggctttggtattgggcgccgcttttgttgatgtggtcgttaacgttccacgattacccttttctggcggggatgtgacgggtgatttaaagtcttatcgaattggtggttcggcctttaatgtttatggcgccttacgctacatgcaggcatcggcagatctactggtgccagtgggtgaaggcgactatgccacgcgcgttaaacaacatttaagcaatcaagggatttccttaaaattaccggtgacgggtgctgataatggttgggatttatcgttagtggagcccgatggagaacgtagctttttgacaattaatgggattgaacaatgttggaagccacagtggttccagcaggttcagctggccgattatgattatatctatgttagcggttatgaattagagaatttacgttcagctaaggtaatcttagatggtctgcggcaacggcgaccggatgcccaaatcttatttgatacgtcgccacgaattagcgaaattccatcagaaattttacaacaagtgttagcggcgcgcgtcatggttcattgtaacgaagatgaaattggaaagatcatgcctgacggtcgcaccgttgcagaaaaagcacaccgtttattcgcgttaacccagagccccgtcatggtgacgctgggaggtcagggcacctattatgtcgatggcacggcaaccgggcaagttccagcgcagaacgttccggttgtcaacacaattggcgctggtgacacgcattgtggcgggattattgccggtttaatggccggactaacactcccacaagctatcaagcaagctaatcagttgtcggcacaagtggttggtcaggaaaatggcagtctgtcttaattggttagtgggtcgggatgaaaatcccgaccttatttttgtgaaatgccctaattgctcatcatttagggtattcttaacctaactaaaggaggggattgcatggatattcaagaagggtacatgccgtttagatcgtatcagacatactatcgggtggttggtgatttacggtcaccgttaccccccttactgttattgcacggtggcccgggatcgacccataactattttgaagcttttgatcaactagtagcgacaaccggtcggccaattgtgatgtacgatcaattgggctgtggtcggtcatccataccgactgatccccatctctggcaggcagcaacctgggtggcggaattacgggcgttacgtgcttatctgaaactcgaccgcgtgcacttattaggccagtcgtggggcggcatgctggcgctgatttacttatgtgacgaccagccacagggaattcagagtgtgattttggccagcaccttatcctcggctcatttgtgggcccgcgaacagcatcgcttgattcaattcatgtcagcgactgaccaagcggccattcaccaggctgaaatgacgggagactttacaacacccgcttacttggcagctaacgagcggttcatgatccagcatgcaactggaccgcttaccgagcaaacaccagaattcttgcggcgatctaagcgcttgggcacagccgcttataccacggcttgggggcctaacgaatattttcccacgggaacgttacaggactatgattatacagcaaagttagcgcaactaccgtacccaacgttagtgaccagcggtgtcaatgatctctgcacaccattggtggctaagacgatggttgatcagttgcctcacgccgaatggaccttatttccgcacagtcggcatatggcctttattgatgagccggtcgcttatcaagcacgactgactcagtggctagccgctcatgacgaggtgactgatgattgaagtgacgtttgatccagcactagcgaatacactggcccaatccatgaaattaaccgctattgccttacccttagacttgcagattggtgatttaacgcgtttaactgatgccaaaaattcatattggggacttaaggcgcgctataccaaatcgggcggtgcctccgctgagtttgccgccgttacaacgagtcaacagcgattgcaacaggtattagccactggtgccaccttgcgggtatggacctctgtcaatccggctgatcagttggggtgggggtggttatgcagtcagttagtccaagcacaatttatgggggttattcagcggattcagattcctttaagtggtcccgtgatgactgaaatgggcccggtctttatgcaaaattcaaccattggggagctggacgagccggcgctggaacacgacttagcgacggctaaggtggtaacagcagcggattgggtagcctttagttatcactggcaagcctgctatgaagacaatgcggcgttacggttaatacttggtggacgggtagtaggcgtgccgcaggactttttagatccgttggtgcgaacctgctatcgacccgagcaatccacggcgcagactttaggtcggatattggacaattatccaattggcatgccgaattggtggtggcagtatcgcattgaccagattgccaaggcgtcagtcaggtgattgtttcatgtggaacaattggacgatgtaggtgaaatttttcagcaaaaaatggcgatacctcaatgtgggcatcgccattttgttagtggttaaggattgactttgttaaattgtcggagattaggaattgtcagcatcacggtgaaactgactagatagaggatggatagaaacgccataacgatagtcagggtatagtgatccatcagccagccaatggcgacggaggagaaaccaccgatggctcgaccaacgttaacaattaggttattggcggtggaacgaatttccgtggggtaaagccggctgatgaccgcaccataaccgccaaacatgccgttggagaagaagccaataatcgcgccagctagaatgagagttgcctgattgacagccagcgtgatgctaaagaccgcgatggctgaggctaacaagaagataccgaaagcccggcgtggaccgaaataatccagaatactgccaaaggttagcatgccaatgctcatgccgataatggtggcaatcatccaaacggaagacccggcgaccgttaagccaagcttttgttgcataattgctggcagccaattcatcaggccaaagtatccggcaatctgcacgacgaccatcaacatcagcgccagtgtttgataagccaggcgaggggtattgaagagacgacgtaattgaacgggggcgtggtcagctgcttgtttagccgttaaaaattcaggactttcgtgtaaatgacgccggatgaaataggttaaaccgaccggcaataatccgaagagaaacagggcctgccaaccgaaaacggggatgattaaggcagcggctacagcggccaggatggcgccaacttggccaccaacagcggccagtgaggtcattttgccaattttattgcgggcaaagctttcggcgattaacgtaatccccacgccgtattcaccaccggcccctacgccagctagaaaccggaagatataaatgagcgtgatgttgttggccaaacacattgcggccgtggcaaaggcgaaaatgaagatggtatgggagaaggtgcggacacgaccatagcgatcggcaatgatcccaaacaaaaggccacctgctagcattcccagattggtaatcgacgaaatcaaaccagcctgagcaccgctaatatgtaagtcggcgatgattgaggagagcgcgaaggagagaaacataacatccatgttttccaaggcgaatccagctgaggttgaggcgattgtccatttctggttcttactgagcgtgtggtcgtgtaacgaggtttccatattcaattcctccaaaatgaatgttcactgacattcgttatttttgccgttctcacggaacgttgttagtattgtggcatggatatccgggaaaagcaaccattaatcgagatattaaaaatattatacggcttgacgccatcgtttgggtacgctacactcaataacaatcaaactttaatttagccctgtgagactaaaaaggtgaacggaaatggccctcagtagatgagtgggtctatagccggttagcctaatacggggctaaccggctttttttgaagaaaggtgaagatggatgcgaccgattattgtggcattagacgtgtcgacgcaacagcaagctctggcattggtcgatcaattggcaaatgagaatgacttgatggtcaaggttggtatggagcttttttatgcggtgggcccgacgatagtaacagctttacgtcaacgtgaggtagcgatttttttggatttgaagctctacgatattccccatactgttgaacgggcaatgtgccaacttggacgccaagaattggctttggtcacggtccatgcgagcggcggctcggcaatgatccgtgcggccaaacgaggattggcccagggtgctgcgattgcgggagttgccccagccaaattgttggccattacgcagttgacctcaacatcggaggtgcagatgcaggcagagcaattagtaaccgttgatttgcccactgccgttacccatttaacccgcttagcgcaacgggccggtgccgatggggttgtatcttcggcactggaaaccccgctagtacacgcagcgacaacggctgactttttgagtattacgccaggcattcggttagcccaggatcgcgctgacgaccaacaacggattgtcacaccggccgaggctgctgagttgggcagtgatggcattgttgtggggcgttcgattacgcaagccagtaatccagttgtcgcttatcaccaaatcttacaggaatgggagtcgacatgcagatgataccagcagaacaaattgcgacagatttactaaccattggggcggtgacgctagcccctaaccatcctttcttgtgggcaagtgggatgcaagccccaatctatacggataatcggcgaacaattgcttttccacaagtgagaacacatatcgccgatggtctagctagcctgattaaacaccgttatccaacagccacggtgattagtggggtggccacggcgggaattacccacgccgctttagtcgcagatcgattaaatttacccatgagttatgtgcgtgctaaacccaaagatcatggcaagggtaaacaaattgaaggccaaatgacggctagtgatcaggtggttctgattgatgatttaatctcaaccggaggaagtgttttagccgctgctaaagccgttcgcaaggctggcgccacagtgctaggcgtggttgctattttttcttatgaattaccagatagcgtggtgaactttcagcaggcggggctggccctgacgccactaacaacgtacagtacactgattacagtagcgcagcagcaagccaaaataacggcaccagaaatggcgtccttgcggcagtggcgtgaagatccgtggggctgggtgtccgtttgattgcggtgaattgactcattaacagttatttctgatacacaaacaccagtcgttctgaggttgagtgcgatgcatcaaaccggtagtcgggatgatcaaagtctcttacggcatcaatggtggtgacttggttttcagccaggtaacgcaccatcgcgccccgagccattttagctagtgtggctttggtctttagcttgccgtttaccagactagcaaaaactacggtgataaagggctgattaggctgcagataaggggtaatggccttggcatattcctgagaggccagattgataattggttccgtgggtgctactagagcgtgatagaggcgatcaccccagaaagcatataagttagtcgcttcacccactgacaatcgggcttgcatttccaagcgatagggaacaataccatcaaaaggtcgtagcagaccataaaacccagatagaatccggagattatggcgaacgtaatctaaagcaggtgccgtaaagagatccggtgccatgtattgatactgaaggccacggtagcttaagagggcgggagtaacttgacgagttaaatccatctgatggagccaatcgaagttgcgttgagccagcttgtcactacaatgccatagctgctgcgcttctgggtaagtgagttgtcgtagaacttctagtagttgttgggcttgtgattgaaattggggctgggtttcgggtgcaaagttgtcgagatccacggccatttgtttggccggcgcaataatcattttcataaatccacgtcgtttctttcagagttgttcttatcgtagcatattaaaaagccagtcacacttttcgatattgagaaagtgtgactgactttttgattaatgctgtccaggggcgacatcactatgattagcgggtgttggattcagaggaaattcatcatccacaggcacgttcgtggtgttaagcggggcatctgacttgtgcagggtgacggtcccatatggcggaacggtgaccaattgccaattagcaccgttaccattaatggtgacggcggcctgaatcggttgggcggttgggttgtaaaggtgtgcggcaatgtcgccagcggttcctaaaaaggccacagagcctagcccacccgtatagccatcacgggtatagttggtggaaccaatgacggttgcgcccacgctaacatcctgaccgaagtttcgcagcatgaagtattccaggttacgctggactttcccggtcgtatggtcaatggtgacgacaccttctcgcccagtggaatccgcggcgttgggcagacctcgttcatcgagcgctaggttccacaaggtaatcatactgagaccgttgtgaactaaccaattaccgataattccaaacataatatgagcggcttcctcaggcgtgtcggtcatcatgcatcggcgttcagtcatgattgtcgaccaattgggataggcacggttggcgtgatagagattgtcataggggcccgagtaggtgtgaacggcaagtccgtcaaatgcggcggcctgctctggggtgacttctgccgtaattggcttggtcaacgcatgaaaactatcatctaataggtaaagtttggtatcggggaaactgtggtttaatgccgggcgaagataacggtaaccaaagtcagctagctggggaaccgtccaaatcatagctggccagtgagcggcattcgacggttcattttgaatggtgagcccatagatggggatgcccagtttttgataggcctcaatataccgaataaagtactgggcataaatatattcgaaacgattttcctcggtatagccattgccagtgaattcgccaaaccgcagatgaccaccatgggtcaaatgacctgtgtttttcatccatgcgggggcggaccatggtgaagcaatgactttcacggccggattaatggccaaaatttcttgtaggacggggacgatgtgctttaaatctttggtggcatctggtgcgcctggctgaccagtaccgatggagaactgttccagcttctgatcgtgttcaccatatgggacgtcatcgtaggtataaaaatcttggctttgaaaatcgcaagatcctagaggcacccgcacgctagaaaagccgccttgatcgggatcaaatagttcagttaacagggcacgccgttgttcagcgctcatgacggaccataagagatacgcagctgagtccgtaatagcggccccgccacctaaccatggttgatgacggtcggcggggtcaatgatgattttcacggccgccgcgctggtcgattgataatcgggtgttgctagcggtgtgcggcgctgcgttagatcgccggaagtggcggtccagaattcatgttggaacttcttcataaataaagcctccagtcagtaaagatgtacaactctagcgtaaccgctttcttaaaagctgtccatagcgaatactgtggtaaatttgtcctaatggcaagtagtgactgattgtgagcgcgtactaatcatgataagcttggtcgtaagaatatgatggaaaagcttgggggaaaccggtgtggcacagtcacaagtatttcaggctatcgaatcaaccgtttatctatatggtgggcattttcaacagaattttcccaattggcattatccgcaagaacaacatcaattatttgaaatgattgtggtgttgcagggaacggagaccatatttatgggaacacggcggtgcgtattatctgcgggggaagccatgattatcactcctgaaaccgcgcatgaaagttttaatttctgtggtaatcggctacgcttcttctgttttcactttagtgtcggcgatttggcgttgaaaacgcaaattattcaaaatttgggaaatacggtattagctgctgatacgccgttagcgcaggccgcccagcggttgattcaacggtttagtgcgttacaagcagcccaacaacagccggactggacgttaaatatggaaattgcttttttgcagttcatggcagttgttagtcaagcaccccgagtcattgcaccggtggcccaattaccagaacagcaggtcatcttggcgcaaaaaatggcgacgttgttatttcagaaggggccgcgaccgcagtcatttcaagccgtttgtgcagcgcttaattttagcacgacgtatggtcataccgtgtttaagcgtgtgtacggcattacgccaagtacctacacgaaagaacgacgtttcagccgtgccaaggtgctgttagagattggcgaaaaatcaatggccgatattgcggcagacctagcctttagcagtcaagccagctttagcaaacaatttaagttgtggtcggggatgacgcccagtaattttcgacaaacccagcggcggcctcagtcacaagctaactacttgaaccagtgagtcggtggccgatcgcggtattttacttgacacagctgattggtcgtttgaaaatgtaagtgacagaataaaaaacacggtctggttggtagtccaggcgcggctgaaagccgtcagtaacctgcctccttggttgtccctattttgttagtcattttagggaggtgttagtttggtgattcatagcaagctaacagtattttttgatcaagcgttctatcggggcgtgttcgaacggtggacgccaaccagctatcaggtggcgcgagtgacctttgggacccaacccccgtctgccccacaactgcaacaagtgatttggcggcggtggtcgactttgcaatggacgactccagcgaagattgtggtgagtgagacccatcatcgggtcaaacaacgccaacgcgctgcccagcgtgagcttaagcaacacggggcccgacaacgggcaactgtgatgcttaagacagagcatcgacaaaacttgcagttgaaaaaacaacggcagcggcaagcgcgggttcagcatgccgcggtagttcgtcaaaaacagcaggctaaacggcgtgggcattgataaaaaataccagcatagggtctgggactgatcaaagtcccgggccctgtttgcgttttcaaatattgggggctgaaatgtacgccagttaaccgccctttgtcccattctcaggtagcgtgagcatattcattgattcaagattaattaataagttatactggtttaacagatagatgattaacaagtcagattgaaaggagtgacggcaatgtttggatggttatggtcattaatcgttggtgcaattattggtgctatcgcgggagcaattacgaatcgtggtgcgtcaatgggttggattgccaacattttagcaggactgataggttcctggttagggcaaagcttactgggaagttggggaccgtcactggccgggatggctttagtgccttcaatcctgggtgcgattattttagtcttaatcgtgtcggcagttatgggttctcgtcataaataaggaggatactggtatgaaaaatcttgtattgggtattagcttagcaacgaacgtagccttggcatatttgttattgcaggacaaagatcaattaaaggaactgcaatcgcgcgccgacaatgctgctgataaggtagctggtaaagccgaacaaatcaaaggggccattaccggtgacactggcgataagctgaaaggcaactgggacgaaggcaaaggcgaagcaaaggacctcgttgatgatgtccgtaaagattttgaggctgggtctgaagaataaaatgagtgaaaaccatcatgtctctctatcagggcatgatggttttttagtgatcaatctcggagcttaaaccgcaagacgttccaagatagtggttgtaatttagtgtgcgcatgatgggtgtcagtcctagcaggcaatggttgtagctgcatatgatcatcgcgattatcagctttgacatcgtaaccgtaaaattgcgtggcatcaagtagccgatcaatcatcagctcgccgaaattaagctcaaagtcaagcgtttctgtttggtgtttattttcggcaaagacggtgacggtctgggtagccgcgtcataggtggtgacggtatccagataagccacatcggtgaactcacgggaattgtaggtgggtgatgtgctgtgatcggtgaggacgaccccttgaccgtagttggctacctgcataaatggatagaagatggattgccgccagacaccgccattttcatccgtcatgatgggcgcaatcacgttaacgagttgtgccaaacaagcgatcttgacgcgatcagcattgcgcaagagggtcatgaggagactgccaattaatagcgcgtcttcgaaattatagatatcctctaagagatgggggccgacttgccatggggtaacctgggtatcagcgtcgttggaatgataccagacattccattcgtcaaaggataagttaatcgtcttagttgaccgtttacgggccttaacggcatcgcacatagcaacgacgcccttgataaagtcatctaagtcatgatttttgcctaagaaattatctagttcggttgggtcgtcatcattgtagtagccgtagtaacgatggagcgacaggtaatcgacgttatcgtagcaagcatcaaggacggtttcttcccaattaccaaaggtgggattgtccattgacgagctgccacaggcgaccagttccagagtgtcatcaacgcgacgcatggccttagcggtctcgttagccaagtgggcatattcgcctgccgatttcgcaccaatttcccatggcccgtccatttcattacccaaacaccacgttttaatggcaaaggggtgctcagcaccattctggcgacgaagatcacttaaataagtgcctttaggaaaattacaatactcgatcaagtcagcagccgcttgaattccccgagtgccgagattgacggccatattggggacagcattgactttatctgcccaacgcataaactcatgaaggccaaactggttggtttcgagctcccgccaagccaagtccaaccggacgggacgctggcttttgggaccaatgccatcctcccatcgatattgcgaaagaaagttcccaccaggatagcgaatgagcggtacgttcagcgtttttatggcatcaatgacatcggttcggaagccatctgagtcggcggtgggatgatcaggttgatagataccggtgtaaacggcacgtcctaattgctcgataaaggcgccatatagccggcggtcgattggggcgacaacgtcttggatttgaatctttgtagaaccttgcatgcgtttgacctccataatgatagcgcttacttaaaaagttacctttactataacgaaggaaatccttagtgaacatgggagatttcactgggaatttataatttttatcccagtttagacgatgcaggcgtgtgttaaactgggtgaggaatacggaaatttttacataaaaggatggggtattttgaaaaaaattgcaccactatttgtcggcttgggtgccattagctttggaatcccggcgtcgttgtttaagattgcccggcatgagggggtagtgaatggaccactgctattctggtcatttctgagtgcagtgattatcttaggcatcattcacgttgcgcgccatcactggttgcgtgaccaacaaaccagttggcgtcagatagtgttggtgatggctgcggggacggcgtctggatttacgaatacgttttatattcagtcgttaaaattaattccggtagcggctgcggccgtcatgctgatgcaagcggtctggctgtcagttctgttgggagccgtgattcatcggcggttaccctctcgattacaggtcgttagcattatcttagtattagtggggacggttttagccgcgggattatttcccattacgcaagtattatccccattaggcttattctttagctttttagcagcctgtgcgtatgcttgtaccatgcagtttacggcgagtctgggtaataatttggatgcgttgagtaagacttggttgttgtgcatcggggcgtttttgttgatttcgatcgtttgggggccccagattatgacggctccggtaacgggggcgaccattaagtggggtgtactcattgctttattttcaatggtctttccactggtggcctattccatctttatgccgtacctagagttgggaattggtccgatcttgtcatcattagagttgccgtcgtcgatcgtggtggcatttatattgctaggggaaacggtcagttgggcccagattgttggcgtggcggtgattatttttgcggtcattttaccgaatgtttggggtgtttggcaccagcgacaattggagtaaaattaacatcatcgaaaaaccggcactgtcagggcataaacgcctggcagggccggttttgttgaagtttcattgatgaatgagggcgagtgaaatgagtaaaaaaatttggacaatcatgacgccgaggacaccaccaaagtaacgagaaaagtggtgatcacggtgccacagccaacctaacacaatggctaggacgattaaaccggtggcgaaaagaatcagtaatttaagtttgacatcaaaatcggttgagagcatgcgtcacgcttctttcgtttgacaattacacttattataccagattgacgttagttggattcaatcatcagcgccatccccatgccaccgccaatacacattgaggcgacacctaagtgagtgccactgtgcaggagttcatagagtaaggtgactacaatgcgggtcccagaagcacctagtggatgacccaaagcaatggccccgccattaacgtttaggcggtcatcaggaagtgccagtgcctgaccaaccgcgacggattgggcggcaaaggcttcatttaattcaaaacgatcaatgtcactgacggatcgctgggttttggttaagagttgttggattgctgtgacgggggcgtagcccatgatggccgggtcaatgccgacttcttggtagccacggagcgttgcgagatacgcaataccggcggctcgggcggttgattttttcatgagaatcatggcagcggccccatcgtttaagccagcggcattgccggcagtaacggtgccaacggatttaaaagcgggccggagtgcggcaagttgttcgcgtgaagttgtggtgcgcacggcttcatcggtcgttaacgtggtggtgcctaaggagacgggaacgatctcgtcggcaaaacgattggcttgttgtgcagcggttgcacgccgttgggaacgaagtgcgaaagcatcttgatcagcacggctaatatgaaattgagctgcaacgttttcagcggtgatccccatggggatgtcggtgaaggcgtcggtcaagccgtcatgggctagactatcagtgagcgtaatatcaccaaatttatgaccccaacgtgtttgcggcgtgagataaggggcattgctcatgctttcggtgccaccgactagaacaatgtcggcatcacccatgaggatggcgctttggcccaaacggatggcttttaggctggagccacaaacctgattaatggtcatcgcggtgctagtgacgggaagaccagcgttaagttcaatttgtcgggcaatgttttgcccttgaccagcctgtaagactgaaccaaagatggtctgctgaattgtggcggggtctaacccactgcgggtaatcgcggctttggcagcgatagtacctaattgctcggcgcttaagccccttaaacttttaccaaatttgccaatgggggtgcgtgccgcactgacaataacaacttcttctgccatggtgactctcctttacgatagggttccgaacctttaatataactgactttttgggatttgtcttgggtttggcttgattgatgaggggaatttggattttcttaaaggttatttgaaagtgacataaggtgcatatgaaaataaaatttagcatctagtaacgatgtgatatagaataaagtagtagtatacagagtagttatcatttattccaaggtatacttaggtactttgaaataaatgttgagaactactttttctaatatttagaatagtttatgataaaaataaatatgaattgtggcggggtgacgtgtttatggtaaaaagagtgacaattacggatattgccaaagcggcgaaaatctcaccaacaacggtctctttgattttgaatggtaagggtgagcgctttagccaggaaacttgtgaacgagttttttacttacgagatagactaggttatcgtgttgaaaagcaagtgagttctcccaaacataaacaattgaagagaataggtgtggtgattcctaattttaatcaatcattttataatcaggtgattactggcatacagaaatcagccgggcccaatgtcttgattacaatttatgaaggggcaaatttttctgaagaaatgcaatcaggattacgttggattttcgaggaatccttagatggattgatcttatgcggtccgtttattgatgtggaaacactatatggatgggctgagactgaagggctccctatagttattgttaatagccaatcaagcgtagatgattctgatgtgtggatcgatttgcatcgcgcggggcagttggcagcagaatatttacttgataatggtcatcgagatattgcagttgtggttcctgaaaactatacagtgactaatgaggttcttctctctggctttaaagaaggtatgcaggaatatcatgaggagttagctgaggctgacatatatccgattgtgccaacattacaagcgggatatgagctagcaaagaaagttgttttaaacaaatacacagctgtttttgccggcggcgatgagatggcgattggaattatgcgaggcttagttgctaatggtcgtcatcttccggcagatcaatcggtgttgggatttggaaactcagaattaggagactatacaacaccacaactatcttcgatcgacattccctcgtcggatattggtagagctgcatttgataaattggaagagttgagtaaaaataatagtgcctcacgagaaaacctactgctaccaattggaattaataagcgcttcagtgttaagcatatctagtaaaaatgtttaagttaacattagtggttcagttctaaaataggtaaaaaaagtaaaaggagaccaatcaagatggattggtctccttttttaagtaaaactatacaaaaatcattatttgaaagtagtgactaactggagaaaggagtttttaaacgcaaaaaggcatcgatcttggctataaaagttgaacttaattaaggaaagtaaaaaaaagtaaaaattatttttagatgataatttataaaaaatattgatgagcatctataattttgcctgatttttgtttttatttcattaaaaatgatataaaagaaaataacaatgatgcatacaacgctgataatattacttgcagataagaaaaagcttgtgataaaactataggataaacatatggtcgggttaaattaatggtgtctataatttatgagaaaaaattaatgtaagtgttttcaaaacacatgtgtaagaatacacttgtcaatatctcaaaaaaggggtaaaaataaggctgtaagttttactaaggaattcagacgaatgttcttagtaaaaatagaaggaggctatcatggataatttaaagattgcgtctacagaagaagctcagcaacatttctcaacaaaacgcgaaatcgtcagcgcttacaacactgattttgttgatgtcgcagctgttgttgttatggacagtgatattgatccaatcaacaaagttagtgacacgaagtttggtgtacctgtttttgtcattagtgatgatagttcacgtattcaagcagatttaatggaaaaaatttatcatattattgatttaaacaatcagtatgatgaacagttatatgaccgagagattgaatcggcagcggctaaatatgaggatggtgttttgccaccattcttcaagtcattaaaagcatacgttgaacgtgggaatattcaatttgattgtcctgggcaccaaggcgggcaatatttccgtaagcaccctgctggccgtcaactttatgatttttatggtgaaaatgtttttcgttctgatatttgtaatgccgatgtggaccttggggacttattgatccatgaaggcccagcgatggatgctgaaaagcatgccgctaaggtctttaatgccgacaagacttattttgttatgaatgggacatcgacatctaataatgtggctgtggctgctgctgtggcccccggtgatttagtgctatttgatcggaataatcataaatcaatttataacgctgcattggttaaagatggtggtcgtccagtttacttagagacatcgcgagatccttatggctttattggtggaatttatgctcgagattttgatgaagattacattcgtaagcaagctgctaaggttgatccagtcaaggctaagcaaaaacgacctttccgtttggccattattcagttaggaacatatgatgggactatctacaatgccaagcaggttgtcgaaaagattgggcacctatgtgattatattttatttgactctgcttgggttgggtatgaacaatttattccaatgatgcgtgattcttccccattattattagacttaggacctgaagatccaggtatcttagtgacacagtcaacgcataaacaacaagccggtttctcacaggcatctcaaatccataagaaagattcacatattaaaggtcagaaacgttatattgaccataaacgtttcaataacgcatacaaccagtatgcttcaacctcaccgttctatccgttattcgccacactagatgttaacgcgaaaatgcaagaaggcgaagctggtaagaaattgtggcatgatgcattagtaacatcagttaatgcacgaaagaatttactaaaaaacgctaccatgattaagccatttgtaccgccagttgttcacgggaagaattgggaagatgcagatactgagaagattgtcgacgatattgattattggcgttttgaaaaaggtgccaaatggcatggatttgatgggtatgaagataaccaatatttcgttgatcccaacaaattcctgttaacgactcccggaatcaacgtccaaactggtgaatatgaagactttggtattccagcaacgattttggcaaactatttacgtgaacacgggattattccagaaaagaatgacttgaattcgattctgttcttgatgacgccagccgaaacgccagctaagatgaataatttagtttcgcagattgttaaatttgagtccctagtgaaagctgatgcccctctggaagatgttttgccacggctttatgcacagaataaggaccgttacaatggctatacgattaagcaactttgccaagaattgcataacttctataaaggaaataatgctaaagaatatcaaaaagaaatgttcttagcagattatttcccagaacaaaagatgacgcctttcgatgcgaatgttgagttattacacaacaatgcaaaactcgtaaagcttagtgatattgaaggagaaacagcccttgaaggtgcgttgccatacccacctggtatcttctgtgttgctcctggtgagaaatggactaaggttgcacaaacctactttatgattcttgaagagggtattaaccggttcccaggatttgcaccagaaattcaaggtgtttacttcgaacaagaggatggcaagacagtagcctatggctatgtatatgatccagataaaaagtaaataagtagttttcactaaacatggcgggtgcatggtcgcccgtcgtgttttgctattattcctaattttggtgaattatttgatttggtgaggagtgaaaaaatggctcaggaaaaaaagaaaatgagcgtggttcaattaacagttatcactgccattaacatgatgggctctggtattattatgctgccaactaacttagcacaggtgggaactatgtccatcatgtcttgggtggtaacagttgctggggctatggcactagcctatgcgttttctcgtgcaggtatgtatacctctaaagacggcggtatgggtggttatgccgaatactcgtatggcaaagccggatcgtttatggctaattatacctatggtgtgtcattagtgattgctaatgcggcgattgcaatctcagccgttgggtatgcagcagttttacttggggttcacttaagcccagtagaagtagctttaggaaccatttttacgttatggttggcaacggttcttaactttggtggtgcccgaattactggacagattagtacgtttacggtatggggtgttatcatcccagtagtggttatctcaatcggtggatggttcttctttagtggccatatgtatgcggctaactggaacccacataaccttgggttctttgatggtattagtcgttctatttctattacgctctgggctttcttgggactagaatctgcctctgccaatatggattcagttgaaaatcctaagaaaaacgtcccaattgccgttttaggtggaacgattggtgccgcagtgatgtacattatttcgacaaatgttatggctgggattgttccatctttcaagttagctgcatctaatgcaccattcggattggcttttagtcaaatgttcaacccgacgatcggtaagattgtaatggggttgatggttatttcttgttttggttcgttattaggatggcagtttactatcgctgaagtatttcgtagctctgctaaagaaggttacttccctcggatttttgggaaaacgattggtaatggaacgccactaatcggaatggttatcattacagcattacaatctttacttgccttgatgacaattagtccttctttatcaaaacagtttactattttggtcaacttggccgtagtaactaatattattccttatattttatctatgggtgcgctaaaaacaatgcaaattcaggagaatgtgccaatgaaaggacgtcagatgacgaacttgattgctttcctggcagctctctacagtttgtatgcgttatacacggctggtgctacggcattggtaggtggatctattgcaacttttgctggttggactttgtatggtttagtttctcataagtttgatgtgacagatgaacaaaagctaacgaacgcacaaaattagaccaaatattctgagacttaaaactctattttaagagtttcgtttgggtttgattctaaaatcaaaccgccctacacatatttggtttgtcgaaacaatgttcagttttcaaaggtctaccaagttatcagaagtaagtgctccgtgacaacttttaaagtatatcatgctgataaaatcatgtcaacttctttttaaacatctttttgaataaatatagatgttttggtgaataagtgaataaatattctcaacaacgtttactactatatcaagaatctcacagaccgtcaagcctttttttcaattacttgatttgcaatcaattgccggacaaaccatgtttgtttccgttaattgacaacagaaaatagtttaccaatttctattgtcagggtcaagggaaaaatgaatatttactgaaattatttgcgtacgcatcaccttaactacaaaaaaggtaatgcaacagcaaagttaccgccattacattaccttttttctactttaattctggtgcatccgtcttatatgtggttcctttccccttgttcttcactaaagcactcgtcttttccttcttttccgcctcagctagtttctccatagctggcttgtacttgtaggtaaaggatgacttatcaactttggtaaagttcttgggcgtatagaatcgtaacaagtctccataaatcactcgatcagaaagtgataattccgttgtgacatggttttgcatcttatccactgtcttcttttgtgctgtcgttaacgacagtgccttgccagtcctggtatcataaactgtccccccaattttcgcataggttggtgagataaagttcccattccggaacgcaacggtttgattgcggttcttcgctagcaagtcctgtccgaactgaattgtgtccgtattcttcacgcccaacagatccaataacgttggtaagacatcaatttcaccaccatacgtatgattgatgccccccttgagacctgccgcatgaatcatgaacggaaccttctggaattgagccaaatcaaagttcgtgactttgctcttccccaacagttgggcaattgctggtcggtgattatttgaaataccgtaatggtccccatatgcaacaatcatactattcttgtagagacctgcttttttgagatacgtcataaactccccaaaagcctgatccaaatagtgtgccgtctgtacataaggatcaacggtcttatcaccagtcttggttgccggaaaatcagtattcttcttatctaattcataaggatagtgattggttaacgtgatcaacttagcatagaacggttggggtaactgctcaatatacttggctgattgcttgaagaaaatcttatctttgaggccataaccaactgaataaccggatttttcggtgtagtagctggagctaaagaagtattgatagccccatgacttatacgtattatcccgattccagaaactaggcacatccccatgaaacgccgctgttgtataacctgcttgctgactcaaaatagccggtgccgcttggaacgtgttttgtgtcccgtaagtcgtcatagctgacccttggggtaacccaaagagtgagttctctaacatcatttcggcatccgacgtcttcccttgggctacttgattataaaagttatcaaatgacaaggtattctgattatgataaaacttattcagattaggggtcacctctttgccattaaccttatagtcaatcagaaactgctggaagctctccaaatgaatgacaaagacgttttttcctttttcttttccataataagaaacatttgggctaacacggttctgtttgaggtacttcaacacactcttcatatcactagcattagcacttgcccgtgtggcgctttccttttgcgtctgataagcattaaacgcggcatactcattcaagcctaagtatttaacgatatagttattatcaaacgtccgagtcaacaaaccagaccgatcggcattagccatcccaaattcggcaaacatcaaaccaaacgatagcaccgtgattgaaagggcgtaccgtcgtttaaacggccgagcatcaatccggataacgtgtgtcactaacagaataattaaaacaataatatctacatacacaaagaaatcataaacgtgtgtaatctgcgctaaactcttacccaagttatttcccacatcgctggaacctttcataattccaaacgacaagaaatctgaaaattcacgataatataggacgttggcaaagatccaggttgattccaacacattaatgatcatcatcagccaataggccaaccgaccacggaagtataacgcaatcccaaataccagtaacgcagccggtaacggatttatcagcagcaagaactgctgcacactacccttcgctcctaatgtaaattcggtttgataggcaatatacgtttttacccagaataaaccaattgttaacaggaaaaagcccattcgggtatttacccaactcatccttcgcttaaaaaagttcgccatgcgactgcctccacaaaataattaacatccctaaagtatagctgatatcagctggtaatcaatctgattgctgaacctttgaaaaaattcaatctttcatcgaaaaaaaaaacaaaactatgtcacccatagttttgttagttatccgtcagtaaatcaaacaattcgattgccactaagtcgatgttatcaaactcaaatgtcgtttccggattatgttcagttagcgtgtacgtatgtgttgcttggttgaagacaaccagtgcttgttccacgccttctttttcaaaacgacggggttgtggctcgtcagttgcatcttcttgcatcgcctttaagcgattaatgatgccaatcaattgagattcttccatggttggtcccctttctagctttcaactatgattttaccaaacttgtgcgctgatggcacgccttaatccagaaaatctcattcatttcctgaattaggctcttcaactaccttgtctggacgaacgaccattgccaccaggccagccagcatccccaaataatacgttaagagtcgccagagtatcatagccagtactaacttactgtttgaggaaatgtaacttttaaaaatcatctcaaagctatattccgcaccgccggagccccctggaataggaaatagtgaaatgaccatcacgatgaggatgtgtaggcaggtaaccatgacgatgttcgctgtggtatatcccagcgctagcataataaaatacggaattaagtaataaaacagcaactgaaagaacgtgatgacaaaaacccgtagcatgagcttccactgcccactaatccggacactctccgcataaaatgagtcaattttttcgttaatattggcttccattcgatcaaaacgctcagcctttataaaccaccgtactggcttcaaaataacggccacggcttttttggtaaaggcgtgccaaaacatcaccatcaacaggccgacaatcacggccaaatggatgctaaagccaaacacaactaaccagactaatgcgtgtaatttatcttgaatctgattgaacccaatcactaacgcaaacaagaaattgataacaatcattgattgatacaccacaaatttcatcagcaagaccgaactggctttaccagcatcaacccccgtttgcatcaaggcaattaactgtgccggttgaccgccagaagaaaacggcgtaataccattgaacaattgttctaccattggaattcggatagcatctttaaacgtaaacccttgaattcgatctgagataaacactttaacaatccacgcttctaatcccaaatacatcaccatacacaagatggcaacgccaaaccaccaaaaattgatgtgtacaaaatcactgaccaagacggaaaacttgatgtctcgcagcgagtaggtaaaaatcgcaatgcctaaaagaaacattaacgccaatacccatttatttcgtcgtgacatgcagttacctctcttttgcctgttgcgtatagaattctcgccaaatctgtgttaaatgttcttctgagtaccgatctgccgccgccaagctctgttgccgccagtgggctagtgcttgcggatctgccgctaaacgatgcagctgttcgtccatttcagcataatccttagcgggttgataatctcccgcaataatagcttggtacaaatcaagatcccgtagcaacacgggcgttcccgtactaaaggcttcaagtaccgacatcggaaacagttcattgaatgacggtagtaagaataaatcagctaaattataataatcaactagcttatcccgatcgacgattcccggaaagctcaagttagcaggtgggttatcgaccacctttttgagttcggcatacccgtccgtcatccgaccaaatgaaaagccaccagcccaaatgaattgatagctgggattatttcgggctaatttaatgaaatcaaacaagccctttcgctcttgaatctgaccgatacctagaatcgtaaatcgatcagtcgcatacccatactgttgccgtaaggcctgcttttgctcaacagttactggataaaattcgtctcgactcacaaagttaggaatatacgtcacccgttcggccgggattcctgcagcaacgagcttcggaataaacgtcgggttcaccacaacaatgtggtccatccgccgatagaaagccaacacataggcgtaaaaaattgaccggaatggctgggggattttcaaacttccctccaaagtctccggtagaaaatgtacataaccaattttacgcccacgatgcggcagaaaagtagataagtaataggaaaagttaatcgtatggtagtgcgtgatgtctactcgccggtatcgattgaccgacacgtcaaactcttggttcaagtgagtcttcagcaaattcatcagttcattgtacgcactccccacgccctgacccttaacagaatcagctgcagaaaacatgttgatttttaacattcaataactcccttaatccgtaaagtctggggtgtcttcgtgcgactcttcatagctgacctgcgcatcttgatagaattcaataatgtgctgaccaaatgtatccgcggaaatttccgccaatttctgtgctaaaagatctggatcttgctcgtcatccccatgaagcaagtaatccaccacgttttcaaccagttcatcttgtgtcgtgaaagtcacacctaacgtgcggctagataataattcatctgtatatggactagtcatgaccacaattttggtccccgcagccatcgcttcgatgtaggtcaacccttgtgattcagagtctgacgatgacaggaaaacattggccatgtgatagtagcgaaagacctcatcattatcaatctcacccgtgaaagtgatatggtccattaactgcgcatcttttgcctgttgctccaaatcttctcgtgccgggccatcccccacaattaacaattgtgcagtcggtacctgcgctagaatccggggcaaagctgcaatacttgccttaatattcttctcataggctaaacgacttaacgacaaaatcaccggcgtatccggttgataacccaattttttgcgtaagtctgccgtatctggttgctcatactgatgcaaatttacccctgttggaatcacccgaatcggtgtcttaaccccataatccgtcagggtggtcaaaacccgatcactaggggcaaccaccccgctcagatgatagcaaaaggctaatgtcccctgtttaacgtgaactggcttcaaaattttcccattagccacataatgtagatagtcttcatacattgtatggtacgtatgtagacagggaatttctaagttacgcgcaacgaacttaccaatccaccccattgaaaactcagtttgggtatgcaccacgtccaaatttaattctttggcaatctgataagcctgaaacaatccccgaacggcgattcgccgatccgtaaaggacacaaacggaatactggagaatcgaaagacattccgttcatacacgttgcgttccacgtgcggatccgttgtggtaaaaatataaacttgatgtccttgcttttccagctgatcccgtagcgttttaatcgacgtcgctaccccacttacttgagggaaataggtatctgtaaatatgccaatgttcattgccaatcccccttgcgtcttgtgtttggctaaaatagtttggcgtttcgctttgtacaatcatcacaattatatgggtttgcctaagtgattgcaaaccacaaccaaaaaccctgattataaaaaaagacgtttgacatgcccttagtcatcaggtcatgcaaacgtcccatcatcatttcatctaccgtacgtccagaatccctggtacagcagcctgaaccattgtaatcacttcttggcttgtactcgttgaattgagcactgtatccgccaacgactgtagttcatgaacatttaaagttcccataagttgccgggtttttaaaatcgatccggctcccattgaaaactcatctaacccgattcccaataagattggtaccgcaattggatctccagccatctcgccacacattgccaccggaattccagcagcatggcccgcgcgaacgatgcgatccactagccttaagacagccggatggtacggctgatagagataggcaacatcttggttggtgcggtcagcagccatggcatatccgattaagtcattggtaccaatgctcatgaagtctacctcctgagcgaaccgatcggctaacatcgccgcagctggcacctcaaccatcatcccgacgtcaatctttcccatcggaacctgagcggttgtcaatttcgatcgttcgtcatcatagatggctttggcctgacgaaattcatctaaggtggcaatcatcggaaacataattcgcaaatgaccatacgctgacgctcgaattaacgcgcgcaactgactccgaaataatggttgatgggctaaactctgacgaatagcccgttcacccataaatggatttgcttctggtgcctggtgcaagtaaggtagcggcttatcaccgccaatatccaacgtccgaatcacaactggccgtggtgctaacgccgacacaacctgacgatagatggcaaattgctcatcttctgtagggacacgctccgcgtccatatacagaaattccgtacgcatcagcccgactgcctctgcaccattatcaagcacactgggaatatcattagcggtacccatgttggcagccaacgttacacctactccatccttagtgaccgtttgatggtgacgtagcttggccagccgcacacgattagcttgccgatctgccatggcttgcttggccgttgcaatttccgcagcagtgggttcactaatgacactccctgttgtcccattaataataaccatctcatcggtcgctaaatcagccgtggccgtctgggtgccaacaaccgctggaatattcagtgagcgggccagaattgatgaatgtgacgtccgtccaccaagatccgtgacaaaaccgaggatgtacttagcatcaaccgaaactgtatcactcggaattaaatcatgggttaccacaatcactggccgatctagcaatgccagatcgggtaacttgatgcccaataagtgggccgttactcgtttactaatgtcatgcaagtcagtgatccgctcttgcatatatggattatccgttaatttcgccaatgaggcaccataatcggtgaccaccgttgctagcgctgcctcggcgttacaccgctgccgagctatctcatcttcaactgatttaatgaattccgggtcctggagcatggcaatatgggcactaaaaacctgggcactatcagcgcccaggtttttagttgcacgagttttaatcatctcaacttcggagacggctgcttcaagggcctgatggaatcgatttaattcgtgatcaagattagtgactgaccgtttggtgatagatagatccggttcgctgtagcgaaatacatgaccgcaaacaaccccatcactagcggctattcccttgagcatcgctctcattagtcagataaaccctcttttttcaatgtttcagctacagcattcatagcgtcggcttcgtcatcaccatcagttgtgatcgtgatttcagcattttggccaacacctaatgacataacgcccatgatagacttcaagttcacggacttgtcttggtattgcaagctaacttctgagttaaacttgctagcagcctgtactaataacgtagcgggacgtgcatggatacctgtttctgcagtaacatgaaattcgcgtttttccataattgatcgatctcctttaagcttaggttgacttctttttgagcatcactcgcgttgaccttgcgcattggtcaaacaaccattccacgaacaacgcctactctctaagaatatcaatctcgccactaaattacaagcattcatgaaccgcttacatcaaaaaaacactattcaccatcatttcccgtatcttgatcgtagtggtaaatcaatgttccccctttttcagcctgaccaatcacgcgtttacgcgtgtcgaaagccatgaatgctttttgaaaggctggaaactcttccggtgtgacttcaaactgctcaattttctgatctttaagttggttcatcaatgccgtaaaatcttttgtcacaatgtcatctccttttttcagttcttccatattttacggggaaacacaccaagcgtcaaaatatttgaaaatttaatgaaatctaacaatgattttagcattctattgacgagagtgctagaatgaaggcgttcgctggaaatgccccagttgacggcgtttttcgtgcaagctaaatacttgcacccagaaatcaacgcggtataatatggtcaatggtcaagaaaggtcaagcctttcatcgacagacctgcgtggggtaacccacgataattccaggcatgaaaggagacgacaaaatgctatgtcaaaattgccaccgcaatgaagcaaccattcacctctacatgagcgtgaacggacagcggcaacaagttgacctatgccaaaattgttatcaattgctaaagcagcagcaaaacaactctggaaatggaggtggccgtatggcacaagatccatttggtttcggtaacttagatgatatcttccgcgcaatgcaaagcggaagccacgatcaagctgactaccgacaacctaatgcacaaccaggccagccaactcaaccaacgggtaaccaaggtggtaatggcaacggcctgcttagtcaatacgggttgaacctaacccagttggctaaagacggtaaaattgatccggttatcggccgggacaaggaaacagcacaagtcattgaaattttgaaccgacgcaccaagaacaatccggttttgatcggtgaagccggggttggtaaaacggcggtcgtcgaaggcttagcagaacggatcgttgaaggtaacgttcccgaaaagctaaccaacaagcaaattattcggctagatgtcgtatccttggttcaaggaaccgggattcggggtcagttcgagcaacgcatgcaacaattaatgaaagaagtccagtccaatccggatatcatcctctttattgatgaaattcatgagattatgggtgctggtaacgctgaaggcggcatggacgccggtaacgttttgaagccagcgctggctcgtggcgacttccaattaatcggggcaacgactttaaatgaatacagagatattgaaaaggatcaagcccttgctcggcgattccaaccggtaacggtggatgaacctagtgccgatgaagccatcaagattttacaaggcattcaaaagaagtacgaagattaccatcacgttcactacactgatgacgccattgaggctgccgttcgattatctgatcggtatatccaggatcgttatcttcctgataagtccattgatctcttggatgaagccggttctcgtaagaacttaaccattaacgtggccgatcccaaagcgattgatgaaaagattcaagctgctgaacagcaaaaacaagccgctttgaagcaggaagactacgagaaggccgcttactaccgcgaccaagtctccaagttggaaaagtccaaagagtccgctgctaatgctgaccagaaccaatcagctgaagtcactgtcaaagacatgcaagacattgttgaagaaaagacagcgatcccagttggtgagttgcaggccaaggaacaacatcagctgaagagtttagcaagtgacctcgaaaaacacgtcattggccaaaacgaagctgttgataaggttgctcgggcaatccggcgaaatcgaattggtttaaatggtactggacgtccgatcgggtctttcctatttgtcggcccaaccggtgttggtaagaccgagttagctaagcagttagccaatgagctctttggctctcaagaagccatgattcggtttgacatgtccgaatatatggaaccacattcaatttctaaattgattggttcaccgcctggctacgttgggtatgaagaagccggtcaattgactgaacaagttcgtcggcatccgtatacgttagtccttctcgatgaaatcgaaaaggcgcatccagacgtgatgaacatgttcttgcaaatcctagatgatggtcgtctaaccgactcacaaggtcgaaccgtatccttcaaagatacactaatcattatgaccagtaatgccggtaccggtgacgctgaagctaatgttggcttcggggctgccgctgagggaaccacccactccgtcttgggtaacttgaccaattactttaagccagaatttttaaaccgtttcgacgatatcatcgaattcaacgctttgagtaaggaaaacctcatgcacattgttgatttaatgattgacgatgtgaataccatgttggcaggacaaggtctgcatatccacgtcacagaacctgttgaagatcaattggttactaagggctataatccagcaatgggtgctcgaccacttcgacgtgtcattcaagaggaaatcgaagatcgtattgccgacttctacttggatcatgccgatgtcaagaacctcgtcgctaagattgaagatggcaagattgttttagctgctgatacggcaactaataaatcaacttctgaaaaatcagattcttcccaagcgtaattaaattgataaaaacacgatgatcgtcactgatcatcgtgtttttgtgtcttgtcgctatcgcctgacttaaaaagagtctgccactgattcttagaatgcggtatactgggttttaaaggaaacttcaggaggtgacacggaatggctttttttgactggttacgacgcatgattgaacccacacggcagactcgcccgcaacacaatcgtcggcgagcaacgccccctacaaaaccagcatcaccagcccccattcctgccccatcggattcatcggtccgtctgatagctcaaccaacacccactaaacagatcgatactagtcaactaccaaccgcgactttagttgtccggctagtggacgaacgtgatcggcccttgcaaccggcactggttctgacgggaccactacacggtcccgtccacttacgctttcctgaaattccaggatatgcacttcaagacattcacggatttactcaggaatatttaagtcgctacagtctgacttctttagtctacgttcgtcaatggggccaacccattattgcttatttggttgactacgatactaaccgcttattgacgttgccacaaattcaccgtggccgattgggtcaagccttcaacctcacaccaccagccatggccaattaccacatttttcaagcacagggcagccaacgaggggctttttctgaccaaactggtcagattgtttattattatcgccgaaattcctggcagaccgttcaacgcgtcaaccaatatgtccttttagataccgaccatgccgtttttgatgaacccaacggccgcaaatacgggtaccaatttccagcccactcgctttggcgcctcttcatcgttattaccctcactaatggtgatgtctggtataacttgggtggagaacagtggttaatcgcgcaggagaccacacgtcgtgaacacccactggtcaatcttgccttaccacaaccgccgacttggcacccacagtcatttgaccgcttaggtagcgtcgattatgtcccaggaaaagccgtcacttgctaccaagcaccttatggtgaagtcgctgggacgcttgagcatggtgccccactagacattcgtggtcgtatcgtggacgatcaacacctggtttggtatcaaatcgggccgaaaatgtatattaacgctcgctatgtccacttggttaaaactgatacactttaaacaggcaaaagctcccactagacagtctagtaggagcttttttaatggattaatcgatttcggtcgttaaaagttgggcacttcgtcgttgccaacgcttagcaatttctaaaataatcgttgggataaacatcgcagggatgacaatgagccaagcaatggcgggcattgtcaccaggccaaacattccttgaagacccggaatcgtggcgattgcgattaccaccgcaatcgcaatgagcatcgccccatttagtaccgggttacgcttgagactcgctaaggtgagcggttgtcggtctttaatcgcatagatatcgatcatcgagccgactgccaatactaggaagaccatggtcatacccaacgtggtctgtccagccgtcagtccgaaacggccaatggcatagattcccagcgttaagatcgtaaaggtcactgttcgtattgccaatcggccgcccaggccccgggcaaacaaactttcatcattggatactggtggttgggccatcgcttctttttctcctggttcccggctaatgtagaagcctggaataccatcagcaagaacgttaattagtagtagttgttctgcaagcaatggtgccccccatcccatcaggacagctccaaccattaagaaaatttgggcaaagttaacgccgaccaagaattcaacggctttcaagatattttgataaacggtccggccttcacgtaccgccgcaatgattgtggcaaaattatcatctgtcaacaccatgtcggccgcacctttggacacttccgttcccgtaatccccatggcaataccaacgtctgcggctttcagagcgggagcatcattcaccccatctccggtcatggcgaccgttttccctgcttgttgccaagcctgtacaattcgaatcttatcagtcggtgacacacgggcataaacggcaatatcctcaatctgggctgccaattcagcatcggacaacgttcgaagttcatcaccagacatcactagttgccccggtgttaatagcccaatttcctttgcaatcgctgaagccgtgaccatgtgatcacccgtaatcatgaccggcttaatcccagcacgtttagcctctctaattgccggaatcacttctggccgcggtggatcaatgattcccaccaaaccagcaaatgtgagatccttcgtcaaatcagcccagtcctgtgtagccgccgtcggtagtaccttatagcccaccgacaatacccgcagtgcttggcgaccaaattcatcatgaacgcgtttagccgcagctgcctgatcactcgtccagctaattggtaatcgatcaaaggcccctttcacaatcaccagttgttggccatctgctaattgatgaattgttgccatcgtctttttggtcgagtcaaacggatcttccgcaactcggggagccgttttttcaaactgttgtcgactaaaaccatgggcatctagccagcgcacaatagccaactctgtcggatcaccatgcgtttcctcttgaccattcaccagctgaatctcagcgtttgtcgccaaacctaaataccgcatcaagtctttaccagccgaatctagttgatcggccggcattgcttgcttggcagttggcgtccaatagtgggtaatcgtcatttgattttgtgttaatgttcccgtcttatcggaggcaatcacatcaacaccaccaatggtttccacggcatttacccggcgcataatcgcgttgcgttttgccattcgcttaacaccgtgtgctagactaatggtcacaataatgggaagcgtttctggtacggccgccacggctaatgagattccaatcatcaggctatctgctaagccttgattttgcatccaaatactgaggccaaagatcacgagccctcccaatacggcaaaggtggttaaccaccccgacaggcgattgagccggctttgtaatggggtggcccgcttctttgtcttgttcagcaatccggcaatttgccccaattccgttgccattccggtggtggtcacttggacgaccgcagttccggctgtcactgccgttccagaaaaaacctgttgttcggttgccacggccgactgatcgctcaacttaatcttgacgactggtacactttcaccagtcaaaacggcttcatcaatagctaagttggtgctctcaaggacgacaccatcggccggaacctggtcaccagcctttagtaagaccaaatcaccaggaaccacttctttagccgccagtgtttgggccactccatctcggcggacagtggttgttggcaagctcatcgattgtaaggcagctaaagctttctctgctgaggcttcctgatacaacccaatgattacgttgatcaccagaatcaccccaataactactggcttcgtccagccacccccctgagcaatcgccatatagctggccaagcccacggcaaataacaagaccatcgatgaaacatcactcaaatggcggataacttgccgccataaagctggcttcttagcggccactaattcattagcgcctacctgttctaattgctgcttcgcttgttgtgctgttaaacctgcttggtctgtcagcacaatcttcgtcatctcttttctcttcatgatagcgtcctccgttatcgcgtaaataaataattccgtctattactatattcttattattacgaaaagttttgtatagactacggtcaaagtgtgaagattttttgaaaattaaatatcccatttatcataaacagtcctaaccaccagtccctcaaaacgagagtgggataaaaggcggttagctggcgcccgttttggcacccaatatttggtaacgcaaaacgagcccgagacttctgtccccggctcgttttaaggcgataaagctgccagctaatccttataaatttttatccatgttgaacgttagcttagagagggttagccctttttcaatcaactcattcgtaaattgcgttgtcgactgccgcattgcagcaacaatttggtgattttgggccgtcaaataagcggtcagctcatctcccgtcaacgccgcagcatcggctaaggttttagccacgtgcgtccgcagttgttgtttggtggcggttaagtaatcagtgtcttgttcgataaaatgactgtaatgtgattcaacaatcattgacaacttccggtacatccagtaagcgctctgatcatccaagcgaacgggtgtatcactgtaagttgggtcagtatccgttacattcgcaaagaatgggacgtatggactgaatgctggtaccccaaaacacagccaaaagattgccgaacggtcagccggaacatcattgcgcaactgtaagacatgggagttttgtgtccggttcattgagattggtcggaacttcaatcgatctgcttcagcaccctgaccaaagggatcatacttcgtttcattgtagtgtgagcttaaaatatactcaacgtcttcgacactaatcttatgactagtccgacagataaatggtaaatcactagattgcggatcttgttcgatttctggattcaaataacgttgcccaaaccaaactcgtggcgtgttatagtgtcgatccttttcggtatccgttccaaaaatatgccggaagttccagccagcttggtccggattcaagtgattctcagtaacgaagtcttgaatcccatcagaaaacataaagttatcgggatcatcaaaactcacctgttgaatagcaacttgattagccgtaatggcataggcatcatcgggaattcgttgggcaacccaatggtgtccggtgacaatctccatataccacacttcatcatgatcggagaataacacaccattgccttctggcgatccgtattgcttaatcaactgccccagataacggacaccatcacgagcagagttgatgtatggcaagaccatcgtctgcaatgagtcttccgccagcccattttgaactagtggatcaattgctaaagcagctggattgccatagacactctcggtcgcgctcatcgccacgttcttttcattaaagccactttccgcgtagaccccttctttatcaacttcaacgttaggagttgctaaataccgatacccgtcgctcggaattggcgctgtaaatccattttgattagacacccacgtccgcttaggttgatttttttcggctggatgcacgtaaaatcgctgtggcgttaagggtaaaaacgtgtcatcattacgggcaatcatcgttgacccatcaactgacgcttgcttacctactaatactgacgtacaagccgacagatgcttggctactttcatacattgaccactccttattataagtacatcccacagtgtaccgcttttcttcgggtaagactagccgatccaattttaacggttctagcaaaaaaatgtgacactttttcaaaagtgttgactttttcgctgaattgtttaaaataaagttgtaatcaattgatttttttatttgcagtgctttgtgaaaattatctcaataaaatttgttttgggaggcaacattatgaaagtcacagttgttggttgtacacatgccggaacctttgcgattaaacaaatcttggccgaacacccggatgccgaagtgaccgtctacgaacgtaacgatgtcatttcatttctctcttgtggaatcgccctttacctgggggggaaagtcgctgacccgcaaggcctcttttattcaagtcctgaagaactccaaaaattaggtgccaatgtccaaatgaatcacaatgttttagcaatcgatcctgatcaaaagacagtgaccgttgaggacttaaccaatcatgcacaaacgactgagtcatacgataaactagtcatgacgtctggttcttggccaattgttcccaagattccgggcatcgatagcgatcgcgttaagctctgcaaaaactgggcacatgcgcaagctctaatcgaagatgctaaagaagccaagcggattaccgttattggtgccggctatattggtgctgaactagcagaagcctactccactactggtcatgacgtaactttaattgatgcgatggcccgggtgatgcccaagtactttgatgctgattttacggatgtcattgaacaagattatcgggatcacggtgtccaacttgccttaggtgaaacggttgaaagctttactgatagtgcaactgggctgactattaagactgataagaacagctatgaaacggatctcgctattttatgcattggctttagaccaaataccgacctgctgaaaggcaaagtcgatatggcaccaaacggcgcgattattacggatgactacatgcgttcttctaaccctgatattttcgccgctggtgacagtgctgctgtgcactacaacccaacccatcagaatgcttacattcccttagcaactaacgcggtgcgtcaaggtatcctagtcggtaaaaacctagttaagccgaccgtcaagtatatgggaacacaatcatcttctggtttggcactctatgatcggacgatcgtctcaactggtttaacgctagcagctgcaaaacaacaagggttgaacgctgaacaagtgattgttgaagataattatcgcccagagtttatgccgtcaactgaacccgttttgatgtcattagtctttgaccccgacacacaccggatcttaggtggtgcgttaatgagtaaatacgacgtttcacaatcggccaacaccctttctgtttgcatccaaaacgaaaatacaattgatgacttagcgatggttgatatgctcttccaacctaactttgatcgaccattcaactacctaaacatcttagcgcaagctgctcaggcaaaggttgcccaatcagttaacgcttaacttgagttacaactacttctataattaagcaatttgaatcacaattaaagaggccttcccacggaattcaacgttcgtgagaaggcctcttattttttctatacgcggtcgtctagtaggatttctgtgccactatggcgtatcgtttagtgtccaagtcaactgactttgatactgaccgctcacactggcactgccgacgtccaacaataaaccagtctcgtcttgccaatcactcacaatatctttttcatcatcgttactcgttgattgtccactggcaatattcatcggggttgtcgtcaccgccgtttttcctgtgtcatcgtggaagtacaggccaccggccaattgtcgcccgtccttggttgtaaacgcggtcgcactgacttgtaagatccaagttgccccagccgttcgcgtgtccaagacgttaacttgccagtcattcccccgcttcacctgttgttggctacccgttaaggttgtgctttgaaatgaactggcttcagccacaccattgaagagcacttgccccgttaacgtaatcgtcaccttcaatgggttagactcattaccgtacggatcagccaccgtaataatcaacgtattgtctcctgccgttaattgattcggcttaacggtgtaatcaaaccgaccgctttcgttgtcatcactttctggtatcttaaagtctgcttgggcccgtccatttagcgttgatttaaccgtgatatctgtattcttcaagttggtactgtctggcacaacgacacttcccttaaccgtcacatctccatcatcggcagaaaatgtggtcccgttcaaagaagctaataaaacttcttgggtcggattaagggtaaagtcgactgtcgaggcagtttcaaccccattaaccgcggtaaatgtactcgttaaacccgttacagaagccggttccgtgacttcatccgctgtccccgtaaaagaaattgttgctgtctgattattactggaaagagccttagctagttttacggttaattcccgctcactatcaaggccactcagatccaccgccgtactcgtcccgtcggcgtacgtaatggtgcccttagtaaagctcaacttgctaggaagctttaattgcgcaacaacatccttccattcctgtttaccgccttcataagataattgatagtctagtcgaactttatcgccgcccttaacgataccgtcattatccaccactttattctgcgtcatatcagtcaaagtagcgttagcatccacctcaactaaccctggaatttcttcaaaaattaccagattgttttcataactatcacccgtggcaccagtgaagccccatcgaacttgtccagtattgttggggtcaatcttggttgtatctagcgtcacgctagcactcttcccagtttgctttttaccggtatttgggtctttgtcatcaaacgtatacgtcatctgtttggtactagcctgccagtcgattgtcaggtgatgccaagcgccgtttgacaacatagtgtagtcacccgtgatggttccggcatgggtctgcgtcgcatagtacccaacgctatagatgggtaacaacgtcgacgtccgcaccatctcataggtgctcacctcacccggataattactggcaatgtgggggccactgatgcccacatcaaaagaatcagcatctcccgtattgccgtaattagttgacgtgtttaaatgtgtatcaaattctaatgcccagctattttgaatcgccgtactggctagcttatccggtgtcgtttgcttcttgtcggtatctacgccccaaacacctaacgtctctcccgaaaccgtcttaccataggtgggcgttgccgctagtccccgtgtatcattttggaaaactagcgccatgccatcggctgctttctttcctgtattgccaaagtacatccacatagaactcttcatattcttggtcagatcaaaatgattgtcagttgttgaccataacgcgccaaattgttttttgccattattaaccttagctgcttgcgtgcctgtaatatcaggattagccgtattcacaatcgatgcttggttattactagttgtgcctggaacaaagatattatccagcgaaataccttgaggagcggtttttaatgcctgatcataatccgcatccgcactagcaaccatccccgtcgctaaaacagttcccagtccgagaaccgttagcacccacttcaaatatgtcatatttttccgctcctcccgctctatttaacagattaattaattagttacaaatccattaaactggttagtccccaactatcgacaccattttaacatgctgccgtccagcaagtcgtgaataatcatttttggaagcaatcacttcgtaatttgaaacttttctcctataaacaacatggcaaaaaaaataccccggatctgcttgcaatccggggtagtacttatttaaacttttaaagtttagcggtcagttcaacgtcaggatatttatcctggaaccaacgttcggcaaagcgattttcgaaaaggaaaaggggtgccccttggctatccttcaccaataggtttcgtgatgaggacattcgttcgtctaattgatccggattaatccaccgggctgtctttttgcccattggctccataataacctctgagttgtattcattttgcatccggaactggaagacttcaaattgaagttgtccaactgcgcctaagatataatcaccagtcgagtacgaggtatacagttgcacagccccctcttgaaccagttgattaatccccttgtggaaggatttttgcttcatcacatttttagccgctacccgaacaaagagttctggcgtaaattgtggtaatttttcaaacttgatcttcgttttgcccgtgtaaatggcatcgccaatctggaaattcccagtatcatataatccaatgatgtcacctgcaacagccgtttcaacgttttcgcgcgtatccgccataaattctgtcacattagacaatcgcatctttttaccagtccgttcctgaatcacgtccatgccacgttcaaactcacctgaacaaattcggacgaaagcaatccggtcccggtgattggggttcatatttgcctgaatcttaaagacaaaaccagagaactcaggatcggtaggtgctaccgttgccccatcaggcgtttggtgactagccggttgtggcgcgtactccaagtaagtttccaggaaggtcttcacgccaaagttagccaaagccgatccaaagaagacaggggtttggtcaccactagcaatcttagctgcatcaaattggttacccgcttcttcgattaataacatattgtcgcgagcttcttggtacaggccatcttcttccaactcattagcagtcgctaggtcgccatctgcgttcagtggtaaatactgatgggcgtcatcttctgggcggaataaggcaacccgctgatgataccggtcatacaaccccttaagctctttacccatcccaattggccaattcatggggtaaccttcaattcccaaaacatcttccaattcagcgatcaagtctaaaggctcacgaccatcccgatctaatttgttcataaaggtaaagatcggaatgccccgcatcttacagatctgaaataattttttagtttggggctcaatccccttggctgagtcgataaccatgacggccgaatcgacagccattaacgtccgatacgtatcttcagagaaatcttcgtgtcctggcgtatccaagatattaattcgtttgccctgataatcaaactgcatcacagaactcgtgactgagattccccgcttttgttcaatttccatccaatcggacttggcaaagttcccactcttacgggcctttaccgttcctgcttcacgaaccacacccccaaataacaagagctgttcagtaatcgtcgttttcccggcatcggggtgggagataatggcaaacgttcgccgcttatcgaccgctgtcgctaaagtcttttcgctcatattttttcctcacaaattatattttcgtctgacacctgatcgtgacattcttaaatgacacagcgctttaattttaacacgtttaggcggacaattcacggttgttgcggttattctcttgacttccctcatttcgtggtatgatagaagaatgaaatttaattagaaacgggtgacaacatgtcagcatctacggaggccatcttaatcgatctcatttttggactaggcgctctaattgtgattgctggtctaatcggcttactttcttctcgtcgccataaacgctcactgcggccaatgatgtccgtgattctttgtggcgttggcattgccgtgatcgcactactactcaacaacctcttatttaaaacctacgcccaactacgggtcaagaaaacccagtattatgaaatcacgagtttaaccacgaatatgcatcaatcgttagctagtagtcgaacgccccatcaaccgattagcccgcaggctaagaaagcgagtcgtaacgtaacttatttggtcaaacacaccaatcagacgactaaaaccatccaattggcacagcaggctcagcattcactcgctagtcaacatccacaagtagccctcgttcgccacaattaccggttaatcttaaaccgtcaattcgccaccctgaccaccgataaatctgcggctaaacaggctagccaccacacttatcaacaagtcattcattacaattaaggtcaaagccgcatcgcctcgggaagactcccgtagcaatgcggcttttgtgttaattacccttttcaatttgttgcatcacgtagttcacaattttaagtgaacttaacccgtcgtcaatcgcacagaagcgacgatagaagtccatgaatttctgattaccgctcatatcaggtgtttgtaatttttcacccactaattgcagcaattgcttttcatcatgcgcaatttcgccaggcagatctgcctcataatccaagtaaaagccccgtagttcatccttatacatgtgataatcgtatggatagaatagaattggccgcttgagataggcaaagtcaaagaagacggatgaataatccgtgatcagcatgtcactaatcaagtatagatcagaaatattcggatgattagagaagtcaaaaacaacaccctcataaccactgatgtccaaagcattagagatcaagtaatgcatccgtaaaaccaatacggcatcttgaccgtatttcgcccggaaatcatccagcgagaacggtaactcaaacgtatactttcccttttccgcaaactgattatcccggtaagttggcgcgtagagaatcacttttttatccaatggaattcccatagattcttttaaagccacaacgtcttccggcgtgctattgatgagttcatcattccgggggtagccaacctttaagatctgattgttaaaaccaaaggctgaccggaaaatccgagtagaataatcgttaggcgataccaatgcatcccaacggttcgcttctttcacaaagttagcatgatacttcgtcgtcgtcgttccaggcattgacacgttctcaatatctagtcccagctttttcagcggtgttccatgccaagtttgaatataggtcacataattgggcttacggacccaagatgggaaccgcgcattactaatccaaaatgtggctttctctaacgtccgtacccacttagcggtccggcgcacgacaaacggaatgccattttccttacagaaggctttttgggaccgatcaatcgaccagatacacgtaaagcccggatacaattgacggaacaactgataaatcgcgtagggcgagtcgcttacttgccgaccaccaaagctctcaaagattaacgttggttgatcatagggacgatgcccacgcttgaacagccgccgcatatagaacaggttggccttatccattagcattgacaataaccgggttacaccaccgactttaccaggaacactagctagtcgttcccccattgtcggtgccgccatttcctgcacgcgaatgccattatcaaagcgcttctcaatcatcactaaccggtgattagccgtaatcgtttgtgtaacctgccctgctaatgatttggctaagacgactcgctgttctaagtcttgaccggcgacagtcgagcggatgaacagttgctgcgtactatcagctgccaaatcagataaaggaatcgccgccgtaaagaggccatgtaaactcatccgcgtaattggccattcagccgaactcgcctcattaacatttttcagcaccaaccgttgattttgaatgggttgatgattgatttgactctgaccaattacctgtaattggtcatcttgcaagttgattgcactaatcgtgaactcggattcggcctgttgtgtatgcatattaaacagtgccatcccgttcgcatcactattcacttgatagtagctagttaacgacaattgatgccgatcacttaagtactcactttcaacctgaatcagaccccgtgtattttgttgacgtaggttcagataaagttcccaactgaactcgctttgcccggcatccgtaaactgtaaagcattaggatccagccgcaaacgaactacctcggcactgacgacctcactgactggcaacgttaatgatgccttggtctgtttttccaagaaggtcacggccagatcgtcaaatggttcggggacatcgatcagttccagttcgagttcctgtaaattctttttatgatgtaatccagataaaatcgcacgcacgatggaaaaactccttagtagttaaaaatcaattgatcaggcatctgaggggccaacgccgcattatcagccagatccacatacaatcgggttgttgaggtcattaaccgcgataacagtgattcgtagaacgcatacacttgaccaaaacgctgatagttagaatatgcgagaaccccgtagtaagtttccgttgttttaataatcgaggtctgatcggccacctcggccgctgctcgatctcgttcacgcttactcatattcatcatcgccgctgcctgctttgcttcggcgaattgtgttgccagcattgcggacgttgcactgaggttatagaccttttctatcggtcgttcgtgccgtacaaaccgtaatactgcctcacccttttgattcaagacatagctggtctgagcaacctcatctactatcttttcaatgccgacaacccgtccggacagatcataagtgtcaatttgtaccaactgatcagtctgatactggcgtaaaaccatcggggtttcatcatccaactgccgccgttcagcaaccaaatgtcccacgtttaagtaccgtttaacttgctcttgaccatcaacaaacaaccgttcatcaaaagccactaagtcaggcatatttcgttcgtcactagtcaatgtcaatcccgattcatctttaaataaatcagctaatgtcagcaactcgatttgcttaacttgcggctcagtctgtgctaaccgatttaaaaacgcacgcactgtccaggttgcttcaaagtcaatcaacgctgccaagataacaacccgttgtccttgttgcagtgcctgtaataattgtttcgtgaagttgggtttatgcatcccatttaaggacgtcactaaaaagattactcgctgcattcgtttgcctccatacttaactcactaagaaaaaatccctagtcatcgactaaggatttttacggttactctttttccttccagtcgtcttcgtctgtcaggcctaagtcatgcttaatttttgtcgttgagatgccttccgttcgtggtaaataaaccacttcacagtaatctttcaggaagtcaaacttacctttccaatcatcacccataacaaagatgtcaatatcgttctcctgaacatcacgaatcttttgatcccacgtggtttctggaataacgtgatccacatacttaattgcttctaagatatacttccggtcttcgtacgacgtataagcccgcttgcccttctccgcgttaaactcatcggaagagacacaaaccgttaaatcatcgcctaaggcctttgcgcgttttaataaacggatatggcctttgtgaatcaggtcaaacgttccgtacgtaattacttttttcatgtagactctcctactttatctggttaatctccctggtcttgaccacggggcacaaaattcaataacactctaaatagtagcatattcagcggtcacgtcaacttcaaaccacaaacgttagtcttttcttgataactttggtgtcttttcggccggttccggctctgaatgatctaattgccagatattgtaaagatactgtaccaccgttttaacaaccgcatataatggaatggctaaaatcattcccatcaacccagcaatatttccagcagccaataagatgataataatcgtcaatggatgaatctgtaatgaccgaccaataatattggggtagactaaattaccatctacctgttgaaccacaacaaccacaatcacgacgtataaaaccatgttggtgctaatcgtaaagcccacgattagtgctggtaaaataccaatatagggacctacataaggtattaaattacacaacccgctgaaaacacctaacagcaacgcatatttcaggccaaaaagcatatatccaattgccgtaaacgtcccgacaaacaggcactcgacaatctgaccacccacataacgggcaatcgtttgattcatccgactaagcaattccacggtctgatcggcatgcttagcgggcaaccagcgctgaaccgctggcatgaatcgttcgccatccttcagcatgtaaaacaacatcaccggaactgtaattgccgtcaccgtaacggttgtcaccgtcccaataaccgcgccaattcccgttgtcagcccactcataaaaccttccgcatacttggcaaacgcgctttgaatctgattcaaatattttgaaaaatcaacattctgtaataagggatgtttcatcagcttggccaaaaccgcttcgctagatttggcaaaatccggaatgctccccaccaaggttgaaacttgattgaccaaccggggaatcaaccagacaccaccggccactaggataccaattaacagtaaaaagacaatggcaactgctcccgtccgattaacgtgaaactttttccaccgaatcttttccagcagcttaaccaccggattcaatagatagaacaacacaccggataataacagtggaatgaagatggtcgataaaaagacgccaattggtgagaataaaaagctaatctgggtacacacccaaatcaatgctgcgacaataagtaattcaacggaccaaaacattagtcgggaattcgccgcttttttcatgaacagtcccctttctttaaaaaaaggagctagccacgaatggacttgctcctggtggtacggaagacaactcttactgatcggttgatcgtcgcaataattcctggtaacgctgataccaaaggtcaacgtaggcttgggaaaaaggtcccttatgatgattaatccaatcgactagcgttaacacattagcctttaaaatccgatcagtctcctcaccataatgccatcgctggctaaagtcctcgtactcgtcgacatctaataaccgcttctcaccatctggaaaaacttttacgtcgagatcataatcaatgtacttcaacgcttctttatccaaaacgtatggggacgccaaattacaataataagacaccccattgtctcgaatcattgccacaatgttaaaccaataatgcttgtgaaaataaacgatagcgggttcacgagtcacccaccgccgcccatcatcttcggtgaccaatgtatggtcattcacgccgatgagggcattttcgcttgttttgagtaccatggtatcgcgccaagttcgatgcaaacttccgtcgtgcttgtagcttttgatcgtaatgaagtcgccttccttaggtcctctagcttcgcgcgtcatgtctaaaccctactttctaaagtaacgggtaattataaaaattcactcaacattataccagattcagggctttttggataggttcagaccgattctggtcaataaaagctagagaaccttcccgatttacggtaaacttagaatgttaaagaggtgaagaccgatgccccaacctgcactaagtacctttgaacccatgattccacaagttgctgagttgttagctgatgatccccaactactcgcgttttttaatcatctaacacttggctatcaacgtgaatgggcgcgttacatcttcggcgccaaagctgaagcaaccaagcaacggcacattgccgacatgcgccaaattttggccgccggttataagtctaaacgagcctatggcagtcgtccgaaaccgtaaataaccaccaaaaagcccagcacccgcagaaagtattatctgtggatgctgggtttgctattataacgacatatgacttcctaaccggctacaactcagacttctatgacttgagttgtccagccgatagtaaattccaaatttgcattgcgggcgtttgcgatagctgattagcccggtagtagttgctgagtagtacgacgccatcttgtcccgtcttgctaaccaatgccgttgcttcatagccataagccaagccgtgcacccgaatgtagttaggatagacgtacgcgccacccccatacatagacgatgaacccggcgtcaataagatattaacgtcactggctgggtacagctttccttgcagcatattgcgctctgcaacaaataaatcatgaaccgacatgtacacctgccccgttccaaactgatagaacattgacgcccgtgattccggatagcgtgaattataagtagccgctacgtcagccatatcactgttttgatagccttgtgagtaggccctacgatgggtcatattgaagacaaatccagtgtgatttaaatgccatggccggataatattatccgtaaagtactgacgatagctctcaccacttacctgttggataattcccgctaataacataaaattaaccggtgaataatcccatttaccaatatttcggggttggctgatcacatttttctgaacaaatctgagcatgccattttcagagttcagcttatcaggaaaggcaactaagcgtaacccgctcttcatatccagcatatctcgtaaagtaattcggcgcgcccctttaattcggggatagtatttagccagcgggtccgtcaatgccaacttgttttcagcagctaacttcattaccaaccccgcggttaacgatttttggacggacgctaattgataaacactattgacgccattagttttgtgacgggtggcatcggcatatcccatgccttgttcatagatgattttacccgagcgaactaccagtgccgtacccacgaaccgattagcccgcaaaatagcatcaatctctcgcgttgccgctgttgcctttatggtcgatttaggtcgcggcttagctttcttttttggctgtggcttcacaggcttcaccatggtttgacgattagccgttgtatctggcttcatttgcgcttggccattaaaccaccaagctagtccaccaccaacccctaaaactagtccaacaactaccaaaatccccagagttctccgttgcatagttttcacccctactctttaattgtggctttactgcgctgattcccctaaatcagctaaccaacggctaatatcatctaaattaaaccccttacgatataacgcctgttttgtcttatactgacgttctcgcatacttaatgtgcgataccgatgccacaacttttctccttgcttgactagtaaggcccattgctcatcttcatcaggtgttaagtctaatgttgctagcatcttggtagctaaatcattatcaaagccccgtgtcaacagcccctgacgaatcttttgctgctgcgtcccaaatggttgacgctggtatcgcttagccaacttagccgccactgctgtccccacagtcagttgctcctcagttgtatatagcgttaatgcttcatcaatcggttgttctaaaacccctttgtgtcgtaagttttgccgaataacgcgcggacccttatctcccgtatgcatcatcgtccgaacgtaactcgccgcgtagtgggcatcatcaacgagggctaacgatcgtaatctctgtagcgtcgctgcaatggtctccgcgggaatttccagatcagccagcttatctcgtacttctttttccgtccgtaactgctgtgacaggtaatctaacgcgcgattatacgctttcgccacattatcagcatcgattagctgtgcagtcaacgctttgtcaacttccattcccttagctaagcgaaagtccaccagaacactttcactcaccggaaatgcgtaagcgccgtctaagtaaacattataacggccgctacgtttttgtgcctcaatcatggtaatgacggccactaaagtcaccccttcttagtcaaaacgtcttgcttaaacgttcttggtcccattttaacaggttggccctatcgatgaaaaggggggtgtccgcttagttagtcaatcatcttttcaggtgcacgatcatctacccgcgcgaccgttgctggtcagcaatctaacgacctgctataatcaatactaaagaatactttaaaaaaggagtgactttatgccaactgctcatgtcgtttttgcaactattaccggaaacaacgaagacgtggccgacatcgtgactgaaaagctaagtgccttgggctgtcaagtgactgagaccgaaatttcgcaaaccgacgcggccgaatttgaacaggctgatatttgcgtcgtttgtgcttatacatacgatgaagggtctttgccagatgaaggcttagacttttacgaagatcttcaaacacttaagcttccgggaaaaatctacggtgttgccggttccggtgatacgttttatggtgaatattacaatacgaccgttgatcactttgaagcggtctttcaacaaactggggcaacacgtggtgccactagtgtcaagattaacttagcgcccgatcaagcagctatcgatgaattagatcactttgccgaacaactagtagcagctgttcaagcctaatacaaaacgagctcaagacatttttgtctcgagctcgttttaggttaatctttatttttcttcaaccgatactttaatagcttggggattcccattgcttcttgctcctcgattctccctaggatcatatcttgaattgccgcatttaaaaccgcgccaaacattaagatcaaccctgtgaaatcaagccaaaacatcaacacgataaatgtcccaatcgtgcggtagctatccatgttatgcacaaaatacttcacatacagtgaaaacgcttgagatagcaataaccagccgaccgtagcagttaaggcccccggccacacaaagcgccactttaatttagcactcggaacaaaatacaacagaatcattagaaccaacagaaccaccaaaaatgtgactggccacttagcggcattaatataaccgataatttcatgaggcacgtgtaggtatggggccagttgttccaaaataatctggccaaaactaaagaacaacatcaaaacaaacagaaacgcaatcaacgcaaccatccaaaagaaagcgacgatacggttcactaaagcattttgattcttagccacaccgtaggccccattaaccgttcgctgaaaagctgctactgctcgggacgacgaccataaggccacaatcaccccaattgaaagtaccccgccacttcgagtattcaagaatgaatgaataattggttttaacatcgagaagatactttcggggaccattggttcaatactctctaaaacggtttccgtttggatattaaggtaaggtagcagactagcaataaccaataacgccggaaataaggataataacgtgtagtaggctaatacgacagccgaatctgacacgttggccatttgatagtgtttgctaatggtttgaatcacgtgtttaatctgactcgcgcgcttgcgccattgaatgctcaccgtgtctaatcccccttaaaatgtgccatactcttcggcaaatttgagtgtgcctaccattttatctaacgtcttacgactaaaccgaactcgcttggcctgacggaacgtttcaataaaagttgccagatcctgataattagccactgccgtgcagttataagcatcgcgcggattgagcttggttttattaccaattaccagcgaattactgtgttcataacggtcatagtaattgtaataaaccagtggtttaacgaaatcaatgatccgatcgttcttattttccaattgcttgtgcatggtgatttcactattaatataccgcaccaacaatttcgatgagagttctgcttgcgttgccggattactaatcccggtgtgtaacgtaatcgaacgttgtccacgtccctcctgctccaaactcatggtgtatccttgcgttaaggattcattttcctctgacaaattgggcaaaaagaaccgatctaaccgattggtcaacgcgctcgcgggtgttttttcgtgactcgataaattaaccgctgagaaatcatccaagctcgacgaaaacaattcttcagcaagatcatggaaaatcattccccgccaatacttactttcgacgttaatgaccccaaacgacgtgatcagtagattatcaatctgcatcacacgccaagagtctccatcgttcatttcttgggtcacaggatttttaaccttattggcaaagtgcacattacgcaagattttataatcaaaccgctcatgattcttttccgcggccaagtggatgtctcgcatgatttctgacaactgttccgttgttttaatctctgcccgatcataagctgtttcagccattcctctgacctccatcaaacgtcgcctgaatcgccgctaaaatccgttctgaggcccggccatccccataagggttcttggcttgggccatccgttgataggcgttctcgtcagttaacagactttccatggcagtcgttacgcgtaacggatctgtgccaactaactttaacgtgccatttgtaaccccttctggccgctccgtcgtgtcgcgtagcactaagacgggtttattcagcgacggcgcctcctcttggacaccaccggagtctgtcatgatgaagtaactacgtgccgctaagttatgaaaatcaaccacgtccaacggatcaatcaggtgaatccgcgccataccatctaattcttcatgggccactgcttgcacggccgggcttagatgtacaggatagatgacttcaacatcatcatgggcctcaacaacttgacgcacagctttgaagaccgcgtgcatgggagcaccctgattttctcgtcggtgcatcgttaataagattaagcggtgacccgcttgaacctggtccaacacgtgatgatgatactgctcactcacggtttgttttaacgcatcaattgccgtatttcccgtcacatagatttgattggctgggtgcgcttgctttaataaattgtctcgtgacaacgtcgttggcgcaaagtaaaggtcacttaaaatatccgtcaattgtcgattcatttcctccgggtaaggcgagtacttattccatgtacgcagtcctgcttcaacgtgtcccaactttgtttggtgataaaaggcgctgacactggctgcaaaggttgtagtcgtatcaccatgaacgagtacgatatccggctgggcatcatctaagacttcatcaagctgggtcaagacccgcgttgtaatgccactcaatgtttgcttaggccgcataatgtttagatcataatctggttgaatatggaaaatatttaaaacctgatccaacatttcccgatgttgggccgtaaccaccgtaatgggggtgaattcattcggccgttgttgcatggctaaaataataggtgccattttaatcgcttctggacgggtcccaaagaccgtcatgacttttatgggtttcattcaaatcttcctccaacgtcacgttagttaggtcaattatagcagaagcccggccgtcttgttatcaattcccatttttcttcaataacccgttatcagccattaaactgatgtcagactttaagcgaattgtaatggtaagcctcccaaatttgaggtaagatggtatcgttgtgtgaaaggaatgtcttatgatgaaaaaaatcagtttggtcgttccttgctataacgaggaggagtccatacctttattttaccaaaccgttagcaaggtgatcacgtccatgaacacccccactccgacggttgaaccggagtatatcttcgtcgatgatgggtcttctgaccacaccttagacgagatgaagcaattacaccaacgttatcccgaaacggtccattatcggtcgttttcgcgaaactttggtaaagaatcggccctcgctgcaggattacaagccacgactggggatctggtggcagtgatggatgtcgatttacaagatccacccgagttactaccaaaaatgttcgctctcattgaaaatgatggctacgattgtgttggcacggttcaaaaagaacgtcgcggtcaaagcaaattacgcgcgtttttatcatcgagcttttaccgggttatcaattggctatctgatgtgcatattgaacccaacgcccgtgattatcgcttaatgacacgacaatatgttgatactgttttgtcactaccagaattcaaccgattttctaagggtatctttagttgggtgggcttcaagaccacttacttggcttatgaaagtcaaccacgggcggccgggacgacccattggaacttacggcaactgtttgcctattctattgagggaatcattgacttttccgatgcgccgctaagactggccacatggattgggagtctctcatttctgctatcaattgttggcctaattttcgtcattgtccgcgcattgaccgtcggtggtgccgttgctggctggccatctctagtcgtcattatgctcctggttggtggtattcagttgttttgcttgggaattcttggtcaatatatcagtaaaatctacttagaaactaagcatcgtcctaaatacattattcgagaagaacaataatcattcgacaccggccagaagtggtcggtgtttttttgccatgtttgaaaaatcatctgtaatttcaaaaaagttaatttttgagtttccttttttgtaggcattttcaatttttgagcggtttggttccttttcagtaatatatattcttttagcgaaaattgctgttccaaatttactgtcattaaaggcttgaataatgaattgacttcctttcgtgtcttgcaagatgcgtatatctcgtttttggtcgaataagaaataatagaatccggctacaaggcttaacccaccaattgtccatgtcccaactgcggcaacttgtgagtaatttttactgacgaaaaaaagtagaattcccgtcatgatgaggcttacgattgttgatagtaaaaaaataaaaagaagtgacagaatccagtgccttataataaagtggatattcataactttatctcctacggtttaatattatttctctaattctataccagaaaaaaataagaatctatactgtaacgaagatcattttaataattttcaattatcaagtataaggggatgacactatgagacagcaagctaaaaacttgatagtgggacttatggcgctcactgtgggtgtcctgatagggtggttggcctgcttatggtaaaacacaaacaaacacccatgtattggcaaaatggctcatatgcgtctaaaacgggccataaaattgaacgcgatttagacccatggtttagagagcagtatgcaaagcatcactcacaaaagagtggtgctttttctgtaggcgaactcacaaaagtaaaggatgagagcaatgagcatcacggttaaacttaatccagaaaacgcagctcaattttcatgggcttattcgtataaccaagaaatagaatatgaaggctctccctgttacgtcacagggatggaaaggaatgtccatggtgatttttatgcccaactaagtcagacgccaacaaatgaactgaccgaaaaacaacggaaaaatttgtttgctgaaaagtttatccaggacacgtttgtataacaaggaggaactatgaaaaatagaaaagtagatacagcaggatgcctagtatcgatcatgacgattggcttagcgattgtttcaattcttattagcggattatatttgatgatggcctggagttgggtaattgtgccaatttttaagctgcctgtgttgaactattggggcgctacgggaatttcgaccatgtggacagctttgttccagaaaaattccagtatcggtgttgattcgtttgatactttaaagcatggaatcatagaaatcatagttgattcagtgtttatggttattctttggttgattggtttagcaatttaataggcttcttataaaaggatgaatacgaatgaaattaagtaaattggctgaggtagccgctaaattcaacggccacattgtacatgataaaaagaaaaagatgattgttgttacagatcaacgtggtgtgatgcacgctcagatcaaagatgactataaggacgtttatttgattcaagcgtgggcagactcaccatttccaactgaattagcaattgcggttgcggagtttgcggggtcacacccgctatttcgcatggatatgaatgtttaaggagtggtgatatggattttggagaagcaatcaaattgatgaaacgtgagaagaaacttagacgctctaactggggttctgaaaaatatgtgcgtaggtttgacccagtagatgatgacggaatggctaaggaaggaacacaactgattatgagtacaagggctaagagttggatatttaagccctattcaccaactgcaagggacatgtttgctagtgattgggaactgtttgagacatcaggggatcgattggcgaaaggaacgaagcaaatggttgataacatgcgagaggctcccaaaaaggctgttaagaagcttattacaaacgcaacgatcaacgtaaaaataaatgttgatgatgacagcttgaaaacagccgttaaaaagattgatgagcatttatcaatgggggatcggcctacttcaaccgtatatctaaaacttggtgatgccaaacatgttcgaggagtggcaatcaaatttaaaaccagttatcctgatcaaattaaggaaattcaagatgtactgcagcaaaacattaatgatggattgattagtattaattaactcgcgacgtttgaatcgaaataatttaatgttttttccgaaacaactcaacacaaatctaatggccggaggtggtgaacttgattggcacgggcacggaatcctaaaagagatgaagcaaagaaaatgtggcttgattccgatggcaaacggcatttgaaggatattgccgaagagctaggagtatcaccaagccaaattcgcaaatggaagtcgctagataagtggtccgatgaactcaaaggtaacgttaccaatgatgacgatgctgaaaaggagcgttaccattcggcacgctacaaccagaatgcagcaggcaatagtggcggagcaccaccgggaaaccagaatgctgttggaaacttaggtggcgcccccaggggcaacaacaatgccttagtgaccggtgagtacgagacaatcgactttgacacaatgtcggaaaaagaacgcgtacttttcgaaggtgtgacggatgatcctttgctgacaataaacactcaaatacggacattgaaaattcgtcagcaccgaatcatggagcgaataaagattcgccaagaaatggatgattctgatgctatggagcgctccgttgatgtgttttttcttggctcaaaagccattcctgaaaagggaaaagtcacacagcccagaaagattgatgacttagctcgtctggattcggcacttaatgcggtcaattctgcacttatgcgggcagtcaagcaaaagcagcagatcattagttctctcagtgatgagcgtcgtagcttgctgggtgttcaggttgaattggctaaaaatgaattactgaatgtgaaggaaaagactggtgaacttaacttgcgtaagcaaatgggccaattatcagttgaggagttgagagctatgcgaaaggggagcgaagcatgattctttccgatttatcggccgagcaacgagagtatttggccgaagaggcggagttcgaactatctcgccgtagttatgaggagtacttcatgatgactcaaaattggggtcgagatgaggatgatgcaaagcgtacggtcatgtacccttacacaaaaatgatttgtaatgcgctgcagcctattcttgatggcgagcggcgctttttaatagttgaaatgccgccacagcatggtaaatcgactactatcactgaaacttttccatcagcttttttaatgaagaacccagataaagaagtcatggttaccagctatgctgatgacctagcacaacgttttggcactcgaaacttagagaagttcgaccaattttctggtcgtatgtatggattaaaagtatctgaccgcaaacacactgctaatgaatggcaaatcgccgggcaccgcggtgccatgcatagtacaaccattcttggggcggctactggtaagcatgccgacttgctaattgtggatgatccacttaaggatatgcagcaagctaatagtcctactatacgcaagaaaatccttgaggagtggcaaggtagtcttaactcccgtttgtcagccgatgcctcaattattgtcattatgacgcgttggcatgtcagtgacttggccggttacttattggccgaacaggctttgccttggcaagaattgcggttaccacttgttgctgaggagcatgatccactcggtcgttcagttggagaaacattagcccctggaaaacctctattcaaagataaaaagtgggctgaggaaaagcgtgtagtatctggtagcaaagtttgggctgcgttgtatcaacagagaccggttattgaaggcgggaacattttcaagagcgaccaagttcactattacttacctaatactgctactgcttcgaagcttggacttgaccatgatgactcagtggcaatcttaccaacattagacaagacgtggtccagctgggaccttacgtttactgacaaagacacatccgactttgtggctggtcaaacttggggcaaacaaggtagcaacttctacctacttgatcgtgttcatggacgtatgagttttcctcaacaaattgaggctatcaagtcaatgagccagcgacacccagaatcgagtgcagtgtttgttgaagacaaagccaatgggtcggcagttattacccagattcgtaactatatttcaggtgtgattggtgttgttcctaaaggagataagacagcacgagctagtgttgtcgttccattctttgaagcagggaacatctatctgccacacccgcgctggcaaccatgggtacgagaaatgctggatgaatggactggatttccaaacatggagcatgacgatgaagttgacagcatgactcaggcacttagccaaaacatggcttcaaagatgccagaagcatcagtatatgagcacagtctctatggaggtgtgttgcattaggaaaagaggtgagttaattggcgattggaattgatcactatcatattcgacagaacgcattgaatcgttttattagtggttatggcgattggaatgaagaccattcacagtttcttagcaaagatatttacgttgatgagaatgacgtattacgctgttctccggactttgatatctctagaaatttcggccagatatacacgttgttgaataattacgataacttacgcgacatttatcatgaaaagatgcgttactacaaaggcgatcacggtaatattcgaactcgtacttacaatgacccgacgggagctaatgcgaacgatgatcggaatcgtgttgtagtcaatatgcctaagaacttagtcaatacttttaccggttacactaatgggattgccccaaaaataacctattcagataatccatcagctgatggcgaacctgatgctggttcgaaggctgttaacgatgatttggcagtgttgtttagccgtagccgttttaatgacgtgatgtttgagtggtcaaagcaagcttctattcacgggcgaagctattgtttagcgtatctcaatagccgaggacagctaaaactaacgtttaagagccctgagaatgcttttgtagtgtacagcaacagtaatgacagtgagccagtatttgctattgactttaatcgcgtgcagggcgcttattatggcacggttcacacgactgattttgactatcaatttaacaacggtgacgtaaaaaaagcacagtcatccgttggctttgagaacagtgtaataggacaccaagggcgggtttctaacccgtttaaaatgattccactgattgaaatggcacagaacgacgagcgagagggtgtatttgatgatgtgatcagcttaattgactcaatggacaacaccatgtcagcgaagattgatgacgttgattacttccgggcagccattctttatatcgcgggagttgcggagctcacaccagagcaaaaagaaactattcgaaagtggcatatcttccaaatcccagatactgtcatgatgactgaaaacgcaacacaaaagttcgatgttcattacctagataagccagatggcgataacgtgcaggaaaatgccattaaacacttaacccatcaagtttatgacacggcccaagttactaacatgaatgaccctgattttgctaactcaaccgctagtggtgtgtcccttgataaaaagatgcagcctatgcagatgatggccgccatcaaatttagaaagatggaagcagctgttcaggatctactgttcttgatttacgcatacaacaatggtgaggcacgttcttatgacaaggcggatgaaatggttcgtgatactaccattcagttcacgccaaacgttcctcacgatacacttcaagaatcgcagattgtgaagaacttgaacggcattgtttcgctggaccagttacttagctatctgtctagcgtcaagagtattcctgatgaaatggcacggattaaaaagcaacaagccgctaatcaaaccaaatttgcgaacgcaccatcaggtgacggcccagttgggccagagaatgaaagtgatccgcaaggtgatgatgattccgaagatgaaggtgatgatagctaatgacattgacgggattacaactcatcaaacggcgcgaacagcaaattaaatccaatgaccatagtgatgatatctatattgacgcgttgcttaccggagctaaaggtaagattgcagagacactgaaatattttcgcgatcactatgcggttgatggtgtgttgtcagtatctgaaatgcgctcaaacgtcaataacgatgattacgaactgtggcaggactttatccagcagtatgggccacggctgatgaaagatgaggctgctagttaccgcttgaagagtgccaagcagcaagcgggaattgaccgtgaacatctgcttgattcaatggtagctatatcaatcgcctatgccgctttaggcgtcaacgactacaatgaccagacactaatgaatgaagccacccaatccatgcgatttcaaaacagcttcatgagaacacgtggagatgcgccacaagatactagtgaattagttgagactggtgcaatcaaactgattaatgcaactacccagggactttcgatggaagaccgcgtgtggttgcgcaccgatgccctgcgtgaccaagtaacggcaacgtttgaccgagcattccaagtgggacttgatgatgcttattatcaaggccatttgtttaaagaagacagtaagagtagcaactcagcgtctaagcatttcaagtcagccaagggttatctagccaactcacttctccgggataagaaagcgggaatggctgcccttgctggtgcaattgttgccgaaaaaaacagtttaaatgttggctattggtacaacgtggaagacgggcatgtatgcgaacaatgtattcaactgaccaatgcgagtccatactcttcgaacgatatacctgatgctccccacaacggttgtcgctgctttattgtttattacaaaatttaggaggaatttattatggcaaatgaaccagggccacaagacccagctccacgaaatgtaagtgctgaacagtttagtgcacttgaaagtaaggttgacaaatttaccggattacttgaaaagtttgtcaattctcagcccgccacgccgccaacaccagagcctaagcgagacccagaaccgccaactcccgaagaaccaaaggagctaggcggttttaatttggaacaaattcaggcgatggctgcggagagcaaagcccacactgaacaagatcgccaaacagctctcactgccgctgctaaggaaaatggcatcgaattagacgacagtctttcggcgatgatcttgaattctagtaaaacgacagatgatattgctgccaatattaagtctcttgctggactgaaaacgtcaacgccacctaatactgacccaggctttagtccggacggtgatcataccgctcaaggtgtgttcggggatgcgttagctgccagtttcggtaagaccactaaagaataggaggattcaaaatgtcatttattaagactcgagtattcggaactggtcgggaaattctgaccaattttagccatgcattgacactgtcatgcatggtacaagacacaaatgctgttgcggatagtaacggcgttaaattcattaaggctggtacgccattaggtgctaccggtttcactgtacgagatcgagaaaaaaaggttctgatcccagttactgatgccacccaagcggtaggtattgctatgcacgatatcaatgtcaccgatggtgtggcgcgggacgcggttattttccgcggggatgttgtcttttataacatggatgccgatgttcaaaagttatttacggcggatatggaaaaggcgttaccacaaattactttagtttaggaggctgaatcaatgacagcaatggaaaatatcgcggaaattaatacccctaaaaatatggcagcatggtatgagcaaaagattttaaccatgcctccttatatcggtgaattatatttcccatcaatcaaggttcaaacagatttactttcgtatcttatgcaaaatcaacgagcaccaatgctgacagcgcaaagctcttatgattcacggccaacaccgattaatcgtgataaatttgagcaaaaggtaatgcacaccaagttcttccgttctgcgatggcaatgaacgaaaaggatttggtcgagcttaaccaagcaattgtaaaccaagatgacagtctagttacgacagcgattaagaagttgtttgataacaaagtacagccattgcttgatatgcgtgcgcggcgtgaatggctcgatatgcaggctctagtcaatggtcaaatctcaattaatcctttggaacccacgttaatttatgagagtgatagtcggttgaaccttgaagccagcaccgattggacagatacggaaaattctgatccatttaaagatattaccgatgcggttgacactttgaagaaaacccatggtattgtgcctaatcagattttgatgaacaccgatacgttacggcttttccggcataacgagaagctaaaagcaacgctgtttgcaaacaatgccaataccaaggacatgtggttacaggaatctgccgtggttaatgccatgctagatgagcttcacattgtcccagttgtttatgatcagggctacgaagatgaaaatggaacgttctatccttatgtgcctgatggcaaggtagtaatcatgaacgcgccaatcccacagtcatttgcgaagaacggcggtaacacgtcaaccggcgtttcaaccggacaaccggtaggccatatggcatttgccccaacaccagaagaactgcaaaaccaacttggcaacattccaagcaaagatatccagttctatgacacagcggtcgcttaccatgaatactttgaccaaggattatcacagttccaaacgatgatctccatgaactgtttgccaacacttgaaggtggtcggacgattgttcggatgacgacctcaaaggcggcatccactgacagcgggaccactgatggggcgagtaagtaacagtgcgagtaagcccaaattaaatgggatcattacgacaccaacaacagccaagattaatctaagctaggaggctttttaatggcagatacagcaacattcgatatctatgatgataagggtacaaaagtggtggatgggaagccatcgcctgatgtgatttcgtcattgactagtaacagcgtcttttcaggttatggggcaacgtatgcgggcaaaaccgcaaagttagcgttacctgacattgtgaccactccgggtaagccaactgttgcggttaccgccggggatggcaagctgacttataccatcacgcctgcaactggcgatggagcagcagaacgttcttatgtggttagccattctacggatggtaaggcctttactgatgttgaaacttcaacggtgaccggtgatattactgggttaatgaatgacacggcttatacggtcaaggtaacggctaagaatgctggtggttcttccactgaatccgattcggtcactggtacgcctacggcgagtaaacccaagctaggaaacatttcaacaactgcaaatagcgccacaattgaactaagctaaggagggtaataagtaatggataagcaaattgaatattcaaaactggctcgctataccgtgcaaaaaggtgatagcgagttttctgttgcagaacattttaaggtgagcgtcggggcattgcgtcttgttaattctcgaagcgccggcaactatttgaaaccgggtcgaaagatttatctcccagtcgaaaaataaggaggccaaccatggctgatgaagtcgatagccatgcaaaactagtgaaaacgatcaaattgcttgcgggggctgatgcttctggcattacagatgagcaactagatgaattcattggtgttgcacaggcttatgtgggcacatttaagccacctgaaacggtgactgaccaattaatcgcattatgggtttgccaccttctagcggcgaaattagccaatctagggacggttaaaattaatagtgtgtggatagaacgagaaagttcggcaacaaatgcttggttcgatcagttttggacgctaataagtgctttaggacttggaaaagcgacggtgatcggattttgacgaaagatataaatagcattgatcggattcttgtggaatatcgaaagctgaatcatcttactgtgcgtgttggggcgttgagagccagtaatggtcactctgaacagcaaatggagatgatagccatggctaatgagtttggggtgccccacattaccccggttcatggtcaatggctgaccattccaacaaaacttgctgggagccagagcgcaagacaaattaatgggctttttaaaccacatggtaagaatgtacttgcaaaagcgaacggaaatggtggtcttgatgtctattttgttttagtcaaacagatcacaattcctaaacgcccgtttctaacaagtacctttaccaacaagtttgaatcttcttggtttgaattagccgaggtcaatatttcaaaaataggtgtaggagaaatgacggctcacgagtgtatggctgatattgggcgccacatggcacgagatgtgcaggcaaggattgcgagcatgcattcccctcacaatgcgccggccactgtcgcccgaaagggtaaggacaacccgttgatggataccggcgcactttatcggtcaattagctggacggaggatttatatgactaatccactattagcacaaataccggctatcttcccactgatggctgaaacatttgaactgttgagggtaggagaagcacagtctgatgatgcaaccgggggcttttctgggcctaacgaagagacttccaagctggaaccaatcggaacaatttgtgaaccaatgattcccgaatcgaaggctcaatcaatgcagatgggtgagggcgggagctttacagattatgcttaccaatggttttcaatgactaagtaccccaaaggtacgttggttcgctatgatagcctgacgcttgaagttgttgagattgagccgtactggtcacaaggcggttttgccatctactacatgcagaatagaagtgatactgatgtacaaagctaagacctacgattgggataatttcgctaaaggactggtgacggttctccgtgatatcactgataaccaagttccaatttatagtcgtacccggtctgaggaccataaaggatacccgttcatcgtgtatgatctgcgaccgcaccccgacatcatctattcagttgaaaagactcatgaagtctttgatcgcatcatttcaattgactgttgggctgagtcagacggtgaagctaatgccattgctgacgatctgcaaacgttgttgcaggacttccaatatcgggaacagcttaattcatacggaatcacgttaaataagatcgaagagagagaccatcgcagtgaggcgttggcctcttttttacaagtttcaaattatgggttcgatatggtcgtgcagttggttcgcaactacacgagtaaatacccaaatatcacacaatatggaggttcaaataatgacacaaacaattaatggccgcgtgattgaggtctcctcagttcatgtgacaactagctatgcgcaagttgtcagcgacattggtatgcgcggcgttcaaatgggcgtcgcgggcgacaaggagggcattaagtgctatcgcagccttgctgacctcgaagatgattatgacattgatacacctgtatggaatcaaggccaagcgtacttcggtggtgcctctgatggtgcttttttcgttagaacttatgaccccaactatacggcagcacaaaagcccgctttagacggtgtcaccacaactgataactcagcaagcgtagctttatcaggcaccccagcttccgagagcggatttatccacgcactcgccaagtattactatgcgggagctgagtaccaccttttcccaatcgctagcgaagaagataaggatatggcactcactgtgtcgaactttgtcgaagcacaagaccgagggattttactaatttccatgactacagaagctggtcgaatggcagttgacagtgactttgattttctcgaacaaatcaaggctaaccgagcaactaaaattgtttctttaccaacgagtgatgatccaaataacaccatgggtgcggatgcactgggccatttcgtaggcgatgccgtaggagccaatttcaaatttactaccggtttatctgtatcacctcaagatcgttttgaactgacaaatgatgatttagcagtttatgagaagcggaatattggaacctatgcaactgaaaacggcaaaaatatggtcactaacggccgcatgatgtctggattggcattatcaacgatggtgattaaagattccatcacaaatgacattatccaaacagttagcgactatttgcaaaaaaatcggcgcgttccatatgccacttccggcgtcaaggccgttcgtgggctactgatgggtgttttaggaagctatgtgtcatcgggattaattaagagctacacattgaatgatccggacgctgacagcattagtgaagagaagaaagccactggcattctggatatcttcgcatggaattgggaatctgttccaaacattgatgatgctgagtttgcgcaaacgctcgttgtttatgacggccaatagaaaggggattatgtaatggcaattacggactatacagattataagtgggatgcagcctcaacggtattaaccgtggatggaattcaacctactgcttatgcttctggcgatatttttacgcttacctttaccaatgatttagttaccatcagtatggatatttttgggcatgggattacaattatccatcacgatgggtcggctacgttccagcttaacctgactgccttggatgaagtttatctgacgattttgaaaaactacgatccagcggatactcatgttatcgatgtcatgacaccggttgaacacgtccacattgattcggcatatctgcctaagttgccacccgttggtgttggcagtgatgcaccatcacggcagctcgaatttaatacaccaaaagcaattgctgaacctgccgcctagagcggtttttgttttgcacaaaattaaattaggaggaattttatcatgaccgaaactaagaatgaagcagcaaccaaggaaactaagaatcaagaagtagcaagtaaggaagttaccgaggatcagccaaaatgggacgggacatttgaagatgttaccaaccaccaacgtgctttcaaaattaccgaatctgatgggacaaagattgaggttcctttcaattggcctggtcgaacggtagcagaaaacttagatgggttttcctatgggcttatcaatggtgtcacgcgtgataccccagggacttatcacgaagcgctattaggcttatttgggacaccaaaagtggccggtaaggttcatgaaccacttgatatgaagttttttgaagatgctgctaaccagtcagaccggaacaagacttttgattatctgatggataatggggaatcgtttcttacaggcaagctcaactagtctgagtcagcgggctgttcaggcctatttaaattcagacgatcctgatgtgttgaaatggtacgcttacatggagggagccgttaacctaacgttcgatgatattgacaaactcacgattcctgaactgtctgtaatggtctattgcacgaatgagcgcattaagaaccaggcacaagcggaagcggggcggatgattagtggctaataagatgattcgtcacggtacgattggctttagcgtcgcaggtgatctttccaaacttgaacgagctaacaagctcatggacgggatggaaagacgtgctcataaggtcaaccgtgctttggacgcaatgattccacagcgtgcctttaatgaggcagctaatggctttggacgaattagtaagtctgccgacaaatcccgtgaatcgattgacagtgccaaacgaggacagaaagagtatggctatgaggccagacgaacttctaaatccgttgttaagtcttgggatcaagtcactagcgctcaagacaaaacgcgcgttgctactaataaacttggaaccgcggtttcacgaaccaatggtcaagtgggtgcttctgccacacgaatgggtgacaagagtgaacgtgcctttgctaagactcgtactggggccgcaaagactcgtggtagttttgaccggttatatacctcgggtagcaagctaaccaacatgggaagcatggtcactatggctttacttccagttggggcggcgtttaagcaagccgccgaccaagctactgagctggaaaataagtatacgaccattcgtaacttgctgagcactggtggcgagtcacttggggcttcaaaggctgaaaccaaggccatgcagaaagaaaacaacggatttgcactaaagtatggtgtcgatccgtctgacatggcaagtggtggcgaagagcttatccggcgtggctattctggtaaacaggaacttgcgtcccataagtcattcttgcaagcggctcgtgcctctggtgatgattataagtcggtagttaactatggtgcctctgcacttgaaaagtttggttataagaccaaagctggggattccattggcaagatgcggaagtataccagcaaagtcttaaatcagatggcgtatgccgctgatatgacggccactgattttaccggaattggtaacgcgttaaacatggccggtgggacggctcattctactaaccaatcgcttgccagcacggtttcggctttaggtgtcctttccaacaacggtttggacggaacccttagtgggacaggactgcgtaaggttttgaatgcctttgcttcgccttacacttccctcaaatcacggcaaggccaagccatcaaggaatacggcattgataccagcaagttttatggcaaagaccataacttgaaatcactgcccaagctgttaaattacttgaatagcaaaaccagcggattatcggagtcccaaaaactaaagttccaaaacaaattctttggggcaaccggtcaagaagctggtaacttcttaatggccaacactggtcaaattggtaacttgaccaaaaaggttgagcgttctcaggatcaaaaaggcaatgggtacatcgctaatttatccgaaaagaacatgaaatcttggcagaatcagattaaccgaaccaagcaatatcttaacgttatggggcaaggcttcgctaaaaacgtattgccgggcttcactaaggcgttgaaatatgccaatagtcttcttggctatctgattaagctgccaaaaccagtcaaaacaactgcgggctatattgccgccattggtgggtcattagctgcggctgttactagtgttaagctgcttggtaaagctggaagtttcttatttggaagtggccgtgcagcttcacgtggtggcgccacttctaacgccgttgccgatgttgctgatatcgctagttctctaccgattggtggtaaaagtgaaaccagaatgggtcgacttggcaccaggacggaacgattagcaagaacaaaattatttggtagatcaggcagaatggcttcggctatcaaggataatcgactagtacgttttgtgggtagaaactctggattagctacagatgctgaaaaagtgtctcttgcaggcgcaaagcatcttggatcggcaactaagctaaccaaactagctaattttggtaggtcaattccttggcttgatgtagcgctatcagctacttccctaatagggatgaacaagaaaaatgctggcggaaaaattggaaacttcggtggaaccctcgctggaatggaaggtggcgccgcactgggtagctttttgggacccgttggtacagttgttggaggcgcggccggggcggcagctggaggatttgctggttctaaagcaggtaaagctattcaacatgcagttactagtcaaagtaagccgaacagcatgtacgtgccgggagtcggagatgtatacaactctggcagtcgaaaaaagaccaagtctaaacccaaggctgatcccaagacaacgttaggttctgacaagtggaatgaaactaacattggcaaatcaaattataagtacatcaagcaagctactaagctggaacagcaggggaatgttgagtgggccaattcggccggtaagactacgaaaaagctgcgaggtacctataattcgctctataatcttgccaaaaaacgagctgatggacagcttagcaacgaccaaaagggatacagctatttaaaaaaggcaggactattaaacgttaaagctgccgatagcgcgtatagccaagaaaagggtagtgtccaaaagcgggtttcttcgcttaaatcagggctgaataagcttttgagcaacgataagatgagtggcacacaacgtgctaaagccattgataaggtcaatcggcaaattatttcgttgaccgacaaaggctctttgaaacaaaaggcaatcatgacaaagatgatgtcttccaacactcatctaaccactgctggttatgctaaaatccttacttctagcaagaagaatgaaaagcaaaccatcaaaacggctcaaaagacttatagtgctgaggttaagtcggccgataaacgttacaaaaaagccaaaaatttagcagaaacattgccggggctctctgagaaacagcgtaaagccgttatcaaggaagcccaaaaacaacgtgatgctgctaaagacaaagcacacgatcagtataagagtacggtgaaatgggccgaacaacagcggcacgatgttgtcgctgccgccaagaaggaagccggagaagctgctgccgcttttagcacggcagccaaacatgttggtaacagtattccggctcttattgatcaaaatgctagtttattcggtgggcatgctaaaaagcctgtgtctagctatcaggcgattagaaacagtaccaacccaaagaaaaagttagccgatgctgctgctaaacaaaacggtactgctaagaagcccaagaaggatagctttggcatgacaggagcatttgcttctggttctattgatcgctaccctcatgggttgccacattcaatgtgggccacggtcaatgatggtggcgccaaggaattaattattccgccggcaggtcgatcgttcattgctaagcgaatgaaccaaaaggtttggttgcgtaaaggcactcacgtgcttaacggccatgataccaagcgagcgatgggcagtgtgcacctcgcttctgggacgattaacttgtcaccggcccctgcgcttagtggaaaaaaggtcaaaacggggattgagggaactaagaaaaagtatgataaggaactcaagggttctaagcgtgcagtttcgatattcaaaaagtccagcaagtctgactttggaaagattaagtctgacaccactgataaagtttcggatacgatagcgagcgtttcgaaaaaatataagtggttgaagtctaatctctctaacactactgatgacattagcaaggactggcgttcaagctggaagtcactagttaattactttggtgatgtttttggcaagctcaaaccgtacgcccacaaggggatggctggggctatctcttcgttgaatggtggattttctggaattgattcagccttggcacaatttggtggtaacaagcaagtcttaaaaccaattcattatgcgcacggttctcatggaccaatcgcaagtgaccggattgcggtattaaatgatgccaagtccggaccacggcaagaattagttgtccgtcatgaccaattgctacgacctcatgggcacgatgtgctgactcctttgcaaaagggcgatgaagtgcttaatggctcacaagttgagcagatcaaaccctacttacctcattttgctaaggggactggtgtttctaagtccaaacttcgcaagattgctaaggcgaatgctaagcaaccggcagaggcctataatgacgagtttgccactaatgtaaagccgagtggatcaatcctacaaagaggcatcggtcgtacttataaggccgccgctaagtcggttggccctaagtggtctaatgccatgtggggatacattcaaggccttattgttggtagcggtggcggccctgtactacgttctccgggttccggatggtctgtatcatctggctttggaaaccgtggcaaggttgctggtggttttagctcccacgatggcgttgacttttctggctccaaagttgttcatgccttacaggacgcagttgtaaccggagcaggtggtcacaaacgtggttgggaaggcagcaacggaattggccaatatgtcaccacaaagggtggcaagctaagcctgatttatcaggaacttaatggaaaagccagttctggcgcagacattcttgtccatactggtgaccatgttaagcaaggacaacctattgccaaacttggtcctagtggaactcacgttcacattggggcaacaacacaccctatgtggtcaatcggtggttctagttctgctgggtggctggatgtaacgaagctaaaaagcaatgttgcagggactaaaaagccgaagaaaaatagtaagctaactggtttggttaagagtcagcttggcaagtcagcatctaagtggattgaaaagcatctgcaagaatccgatgcgaatgttggaagcttgtctggaagcatggctcatcgggcgaaaacgttagcagcggctattaaggacatgtacccatcagcaacaaacgctggtatcgcagctgtcctaggcaactgggaatttgaatctcgccttgatccaaatgctatcaatcccggcggtggagctagtggtcttggtcaatggttaggcggtcggaagtctaacttaattgcctatgctaagcgaaagggcaagagctggaaagatgctggcgttcaacttagctttgcactgaatggcgatggttcggatagctcggttttgaagagcgttttacgtggcaaggggtctgttgcatcacttgctaacaagttttctagccaatgggaacgtggtgggtacaacgcgcaacatgttgccggcgctagaaaagtggaggcggctttacacaataatggtggctggtcaaagagtggcaagctaaacatttttggtgaaaaggattctgaggttgccatcaatcctaagcgttcaaccgccgatggattgattggtagcgccattcacgaaagggctaaggttagcagcaaaggtttggcgggtcagcttgatcgtgccatgagcgctaagactagaaagtctagcaatcaatcgctttttaaacaggcggtcgctgctatgcgtcagttagtctctactaatagtcgtgcagctcagccagctaagcctaatatcgttattaattcaaccgttaacttcaacggctcagttgataaagatactgctgattatgcggctgatagtattggcaaagttattgatcggaaggtaaatgaagctctgaccaagtatgcacaacaggccggacgtgatatgcatttaactgattaaagagctgtaaagctcttttttcatacatagatttttattaaattatgggaggtgacattgtggcaaccaaaaaatatacgactttaacttctgtaaaaaagttgtaccagaaggaacaagcagctgctgagaaaaagttaaagtcgatcaacaaaactttatctaaaaaccagaaaaaaatagctgctgcaaaaaaagaagttggtaaattaagcggatcagctaaaacaaaaaaagagaagctgattacaaatctgactaagtctgtagccacaaacaaaaagcaagttaagagcgccaaaacggcagtgactaaagccaaggctaaaacgaagaactacaagcattcgcgagaggcttcaaaggtctataaggatcagattcttaccaagatgaagaaatcgaaatattggggtgaacgggcttatatcatgccgaagtatccttgggcgtctacatcgtacgtttttatccgcactaatgatgagcaaccaacgtttagtagcaatttaacatccaatccaactgaaaagggcggaacagttgctggctcggccgagactcaaccaacaacggttgctgttcaaggcgtcttaggtggtgatggtggtaattcacatctagcagggttaaagacacaggccaaacgtttagagcgctgggaaaagaaccacacgcctttggaatggcatggcgaatacaccatgatgtccaccaatatttccgatttttcaccagactatagccacgaaataggcactggcggtgaaaatatcattaacttgtcaattactctacaagaagtcgaatatgccgactccaacaagaaggccaaggccaaatccaccaaaaacacagggactaaggccacaacaaaatccactagcactaagtcaaaaaagaaatatgtgatagcaaaaaagggcactacctattggtcggtgcacgttaaaactggggtgtcgttagcgaccattgaaaagaaaaacaagtatccggccactaagattccagttggcgcaaagatttattattaagggggtgtgactgatggccgaaaacgatcggattttagttgatttgagcgatgataccgaagaaacctttgaaaaggagttcaatggcgttaaatataactttaaggcttatcgtaatgcgcaaaacgatcggatttatatgtcgatatttgatgaaaacatggttccaatcattactggagaaaaattgatgtatggcatggaggtttttggcacaatcagtgagccacgtttgccggccttttatgcgattccttatgatgaatccgatcaagtgcacgaggttaccggggcaacgtttcagagccccgtttttattttcttaccgcaggacgatgatgaagatgcagatggctcgggaactgactttaacgatgatctggatgatgacgaagaatcaattgagtccgccgatcaaaccatcagcgatgatgatgccattaatctctatggtactgatcagattgtaggcggtgaggattaatgaagctggtccatttttatcaaaaaataacggtgtggatatctagtaaggaaacatttacagtgatttatcgggcgcgggcgccataccgcattttgattgagcataacaagacttacacgtctaagggtactcccggtaatactgaaatcagtattcacaacttaatcaagtcacatgccaattattttaaaaaagggcgtcgggtaaggctaacggctggctggtataatgccgatgatacagcccacatcatacatcaagtagtagatgataagatttcaactgtgacgccaccaacagagagcgcagcggattcggttgtcacctttgacattacggatggtcaaaaatacgacaatttaaaagcggtcaaggtcaagaaatccaaacgtgtccgcatgcgggccagccaaaaagatttggataaggccattaccgcctacaattcgaaaatgaatacggctcggcgcaagtggattgatgaacacccacatgccagcaagaaagaagttactgcaaaaaacaagtattatagtgacaaaaaaaagagctatgcgaccaatgcgcggtccgcttataacaagcagcgcaaggagcttaataacaaaaagaaatatcagatcaaaaagagctatgagtatctgagctttaagaaaaacactaaggcctcgacaatcgttaaaaaggtggctaaggaatcgggaatcaagctggctaaggtcaacctaaattatgaccgcaagtatacgaatggttatacagcaaagtccaaacctatgaaggtaatagaacagattgccagcgatagtgatacggatattatctatcgaaacgatgcaatttatctggaaaagctagattctaaacgaaaattaaacctatatattgactacacaacgggattgctggaagaaccggagtatcaggctgataacgattcaaaggtggcccaatggcaagtaacgttcttgtaccgcagcttagcggtaggggatgtttttcatttgaagtcaaaagcagttactggttgggtaattgttttgagtgggtcaaattcttttcaatctggttccgcgccatcaacgcaagtcattgttgaactgtattcggaatacaaaaccaaattgactaagaagattaataagaagaaaaaggctgaccgcacagctaaggctaaggcagataaaaagtcgaaagccgcggctaagaaaaagcggacggcgcgtgctaaaaataaaaaaagtaagtaggtgattcgatggtaaaaaacattagtaacaccaaaaaaggcgaaaatggactgacagttcttctaaaactatttggaactgacatcgcacaagccgttaacgtggcatatattgccaaagtcaccaagattagcccaccaacggttagcctacagcctttagctttgacggttggcgataataaaaaagaggcgcttgtcgaaagtgtcccagttatgattccagcaattagcattggcgggaaaacgccaaaagttaatttgaaagttggagataacgttgggtgcttggtattagatcatgatacgacccattataacggtcatggggagttccgacagatgacaaaaacaccgcatttggttaataattcgttagtcattggtaagattgcagaggcaggtgattttagtggcgactgatcttttatacgatgaggtcacaggagaccttgtcatcaacggcggacaccccattgaaattagtggtgttgaagaactagcgcaggcggtgcgatcactactaacgacgcctaaaggaactgccttgaatgaagatgagcttggaatggatatgtcttttctggttggcggctttgacgaaaagatggcagtggaggctgcgaccgaggccattatgcaggataagagaatcttagcagtaaatgatataaccgtagcacctgattataagcgaggtgttgcggtttttaatatcgcctattcttcaactgtgggggatgttggaactccacaaaatacaacagcggaggtgagtttagatgccgttaacggataatggttgggaagaactgacacttgaccaagcgttggcaaacgagcaaacccgcttcaaaacatggctaggtcaagaaacggatttgtcaccgcattctccttggggaaagctgtgtatgaaagaagcacaagatgatgttgacgatgaccagcaattggaaatggtttacgattctggctatgcgtctcaggcagatggtgttagcttagaccgattagcttcaaactatggattacagagaaaactgtcacaagcggccaaagcaacgctacaggttacgggcaccccaggctacttgattgaggcggacacccgcttcatgacgtcagatggtacagagtttttgaatgcctatgatacccaaattggggaagatggaacgacagagctgctggtctattctgatgacgaagctgagtatgtcaacgttgatgctaataccatcaaccaacaggccgaaccagttgaggatatctttggtgtcaacaatgcaacggcggcggtcggtggtgctgaccttgaacaggactatgattttcggaagcgaattttgccgaacgaggttgctgctgaaaacggaacaaaggatggattaaaggttgcaatgctcaacgttacgggtgttagtgacgcgcaagttattcgcaatccagatggtgaagttgatagctatggaaatccaccacattcaatgcacatctatgttatgggcggtgaccctgatgcaatagcccaaaaaatattggatgttgctggcggtgaaaccttatttgtcggtaagtctcagggaacggcgattgatgacagcggacatcaagttatcgaacgatttgaccaagaggaactggttaacgtgaaatttgatattaaaattcaatcgtccagtggcattgacgaagatgctgttaagcaatctgttttagattatcttggtagtttggcgatggggtcgccagtgattatcaacaagctatacagctatctttatcaaatcgatggagttgattatgttgaatccatatctgctggaaccggggacaccatgggggcggaaaacattatattcagcgactatcaactcgctaactcaacggatgaactcatcacgttggaggtgacggctagtgcttaatgacgacgacacgttgcttgatgggacgacttttgccgaatttcacaagaactcgatggctacttttaacgattttcgaccagcatataagggaaccaattttgacaaattgatcaaagtccttgatgctggtcgttttgtacgccgacaaaacatggatgaggttacttcgtctcatgccattgtgaatcaacatggattgcaactggataatacaggtgatgacttaggaattcagcgcaatggtgcggacgatgatacctacgaatttttgttattgtcacgcgcaatggtgcgcaattcaaaaggcacactcaacgatctaattcggattgctgcaaacctacttggctgtgaccccaccgatatttatatgaagcgcgaccgtgattacaacgcagctggaaaattggttggaattccaaatacgattgatttggtggatgttccatacaacaaagtaaaaaacatgtttctgctagatcggttaccggctgagttagaacgtgcggccataggcgacacacgtgtcaacttcgtcaacttatcggttccaattgagcaaaaagcctttataggtgttgctgtttctggatttacagaaattgatatttctgttccagccgcaatcgaggttaaaacaagtggcaaggttgatgtcaatgttggcaacagcgttggcctaacctattccattgacatttagagaggagtgatcaaacttggaatacaattcaaaaagtctaacccgtgaaggcgcgacaatgctggcgttagctgataaagaagaaaaagcgctaattattgatgaagttattgtttctgaaaaagttatcacagcaggaaccgatatttcagcgttaactatggccgactttgcgaacccactaacgtacggaatcagctcaaaggttcaatctgacaaccagtttagcgttaagtcagttattaccaaccattggcaagactctgctaataccgatcacacgaccaacaaggacttcaacgtggcgttagtcggtgtggttgcacacattgacagctttgccgaccagcatgtgctaaccgtggccgtagggaatgatccgtttgttttaccagcatatcaaggaacagacgtatcgtttgttttcggtattacacaggcctactcagcttcacaaaatgtgacaattaagatggatggtagtgcttatgcactcgcaactgatcttgatgatatcaagaacttacaaggctctataggtatagcgattgatagcaaactggctgattacgtcaaaacggacgatgtaaaaagccttatccctgccaccgtcatcgacggtagcaagccagcggacttcaaggaatccgtcacgcttgaaaagggtgcggtagacggtgctggcaatgccattgcgaccaccaagaatttagccgatggcgacgccacgacactcaaggcggccaaggcatacgcggacacacaggccagcgacaaggtcaaggatgcagacactgttaactggcagaagacaaaggttactggggatgatggtggcaacaaatattcgtttacaacagccaacacaaccgacttagtggctgctattcaggcgttacctcttggctatcatacattttattgccaagccggagtccaaggtaatccgtcatcgcaagccgtgcgtggtattgccgagattaccacggcgggcgctaatcctttgggtgtgggctatttgacagacagtacaggagccttttggtcattttatgtggatagctctggtttgaagttgaagcggtctgccgatgctgatgcgattgacccaagtgtgatgactaaaacgacgccaataacaaatacaacggatttgtttactttggaccccggaacatattttgggaacaatgtgactcctgttaatgggcctgctattaactctttaccaacaactaattacttttgggtaaagttggaaacgccaaaagctaatgcatcaattaaaaagttaatttggacagacaacgggaatcatcagtatgtcaatgaatattatggagtatccgctaagtggcatgactggcagattctgaacgaaaattcgatggtcaaggataatggtgatggcacagtaacggtcgatggccgcaagtttgtgccagcagataccgaccatacaattcccgtcagcgaagcgggtgtggcgggttcggctaacttcgctgctggtacgctcaaggtggacgacttagaggttttgggtgcgaaggtgttcagcgatactgaggattataaaacctttgcggcggcgcacccgagtgctattactattgtcacgcacagcaccagtacgagctaggaggaattagatgattaatttagggaataaaaaggtatccaagctgttagttggcagtagtgtcatctatcaggactcagacgggtggattccgctggaattgccggacggggtcactggacaagtcttttttaaggataatggcgatggtacggcaaagctagcaggaaacctgtgctttgattttatagctaatcaggttgttaagctgctatcaccaccgcaaggttatactttcactagcgcaaaatggaatgttgcccagtccaacggctacgtggaaggaattgtttccatgaatgagctgagagggagcataccaccttcaactggagtggtaagtacagaaatttatgagggatgtattttctgttctaaaatcaatttgggtaataactttaaaagaaccatcgtgctgactcaaagcagtacgattaccggtgagtcaagtgctgaaccagcaattattggaatagccaaagtataggaggaaacatcatggcgaaattgattaaccctatttatgatggggggggggggtagaaccccgctaaaccaccggttctcgcctcttggaggtgaccacgcatgacactaatagcgaatggcgaagaagcgtataaaatcctgataggtgacgacacatttattgaccaaaagggagtatggctaccatgcaaatctggcccaagttttacaaacccaacgcccattcttatgcactatgattcagaatcgggggtaaccagtctattagggcaggcatacctaaagacaccatcaacttattcgctagatgaagatattttcgtattaccaaatgggtatcacttcacaggtattgaccaagcattcccatttggctggggaggcagtttaaccacctatggtgcctatttatcactatctagtaatactaccgtacacgcaaagcactatctgggaaccgggagtgattcgtatctgcgtgcctaccaagtatgctttggtgatgtgatgtcaagtgtgatatctaattcaaaggtatggacgacaacaacaattgcgccagactaggaaggaagattactaatggcaaaaacagtaccagtatatgtcagcgtcaacgcggacaataacacgattaacagccaaccagccgttgaagcggcggatggactcactgaaatgtgggtaacgccagtgatgcaggagtacatcattcggaattggaacaagtatttagtggtagatggcatgtttaagcggacggtagatacactgcctgacttgagtaccgactacttgatccatcaaaatgaggtgttacaaagccaacttgaagcgtcggcctctgacctaaaacaggccaagaaggacgctgctgatgcattggctgaaaacaaggaattgaagtcggctaacgaactcactcagcaagggttgatggaagctgtcgattacttgtcttcacaactaacaccggctggcaccacgaccgacaccggctcggctacaacaagtacagcggccccagctagttcggcagcaagtgaatcttaggaggtgatggcaatggaattttcagcgttagcgcagatttacgcgcaagcaattatggacggcacacggtccattgaagaagtcccagcctacttgcaggacgatgtgaagaatgtccttggctccgcaaaaaactctaccagcaccgattcatcttctacgcctgtggcttagaattgatgattggtgcttttttgatgggattttttgtgggaaagagatgatgtagtatgccaccaaccccttttgggtggtcgctcgtgatagacgctgcttcgcgtatggttgataacccgtttattgaagcgttcctatgggcggttatggccgacctgttgacggggattgttaaatccttttcaccgcgcgctaaacacaaggcagacagctcaatcgggctgtatggcctcgctaaacatttgttaatcatgcttttagtaattactatttatccagttttggacgttctcggatttgacaccatttcaaattcggtcgtccttttttatattgccgaatatgccatctcaattcttgaaaatcttgaagtcatgggtttcccgattcctgactttttgcgaattcgatttaaaaagatggctgaaaatgttggaaaggaaaatgataaaaaatgaacatcaccaaaattatccaattgttgagcgataccggtattttaggcattgttatctttttgtttgtagcatggttcaatcgaattaatccagccgtaaaaactaagattgcatctaataaatccgccaaccagcgtgaagttcttggcctactggacaatttggcaagcaatgtggttcatctgctgtcggcatattatgaaatgcctggcgatgaaaagcgagagaaggccattgccgatgtcactagtcaacttaatggtttgggtcatgatgtcgacccagctattatctctgctgccatcgaaaaggcctatcagctgatgaccactcaagacactgtggcccaagtgaaacaggctcaatttgatgagggtcaggcggccacagagcaagcgttcgcagataaagaggtacaattggccgaacagaaagctaaggctgatgctgtagtcgctcccttaaatgtcccggctactactcaagccccaacggagggagatgctaagtaatgccccgattagatatggtcgatacgtcaaataataacggaatcatgactaaagctaattggctatcgatgaaaaaatatggtgtccgcgcgatggtcgcaaagctatcagagggcactttttttacggaccaaacagctaagacaagtatccgaaacgcagtcaaagccggtttgcacgtcaacggctatcactttgcgcggttcactactgtggcgggagccaaggcagaagctcagatggcggctcgctgtgcgttcaacgcgggactcggtaaagatgcagtgattgtgttggactttgaagctactaactccggttggtcacgaaacgctgcgatcattaaagcatgggttgctgaggttaagcgcatgggttatcccaagatcgatgtctacaccatggggtcttggaccaactcaatgccactcaacaattcgagtcgtggtgggtggattgccaattacccgtcaaaccctgctgggctaaagctttatggtagttataatggttggcagtggaccagtacccataaattccccgggtgctatggtggcttcgatgtgtcccaaatgtactcaaactactactatggcactaccactcatgtagctaagccgaagaaggccatctactaccggtataatcccaagatgatctacgccaggacagctatcaatcggtacaaggatgttgctttcaagtataaagtggacaacttcccagccggcaccgtatttgcgatcgccaaagtagtgacctatggcaagattactcgcttccaattgtctaacggttattacatcacgtctaaccaggacaacgtcaatcgcttatactattctgttgatggcggcgtcaaacgagtaaagtctgtacgcggcacgcatcggtacaaggataaggccctcaagcacgttgttgactggcaaccagctgggactgagtttgatgttgctaagattgtcaagtatggagatacaactcggattcagttggctaatggattatttattagtggcaacaaaaagattaacaaatttgtcaaataagcgtatagtacaagatatacctgtacgttactgatttagaaaaagcgctcactcctaacgggggtgggcgctttttttgtacaatatcaatataaatcttgatattacgctgtaactaatggctatgttgtatttgaatttgtgggataataagcaaaatacttgcatcattttttctaatgtttaagcttaccttaagaaagggaattattgaatatcagaaaggagtttttatatgtttggatggctatggtcaattattgttggagctattattggggttatcgcaggagctatcacaaataaaggtggatcaatggggtggattgctaatattttagccggtcttattggttcttggttaggtcaatcattactgggaacttggggaccatctttagcaggaatggctttagttccatcaattttaggtgctattatcttggttttgattgtttcaacaatctttggtatgcgtggcaagaccaaataaggtggtgattcaatgcgacgagggaataaggtgcttttaactattttgggcctaattctactagctttggctgtccttcaagtcggttggtggttaccgatcccgggtctttcggcatggagtacagatgtaagttatactcaaatgttctggttaaaatatgctttggctggagcagtaatcattgttggaatcgttggtctagtatttatgatgatgggcatcttcaaaccaattcgtgagaagcaatggcaatttactaatcaaattggaatgttggaagtacctcaagctgcgatagaaaaggcattacgccaacaattggctgaacaagttggcgtaattgacccacaagtaacaataaaattattacgtcacaaacgggttcgaatgaaagctgtggctcaggttagttcagcagatcaaattgactcgttggcagaacaggctgaacaagtgattgaaaactatttacagcggcagttagatttgacggtcaccaaaccagtcgttcagctatcaccagttgatagaaaacagcatgtatcagttgtgtaaggtaaaggaggtagtgccatgagcaacggtgcatatggagcactatggggcctagttttaggactcgtatgggtctttcaaagctttcccgcgatgttgttagttgcagcagctggcctagtgggttggggggttggaaggtttgttcgcatcgatctgtcagctctaggtaaacggattgagcaactcttgtcaagataattaaggaggggtcttatgaccacggaaaacacaaaattgaccacaaaattgacatttgaagatgatgtaattaagaagattgccggattagcatcacgtaatattgatggtgttttggcgttagaaggcggtatgattagtaatctgacaaatcgctttcgtagtgattctgatccaactcaaggggtcgaagcacaagttggtgagaaacaagttgcactggatatgacaattaccgttgaatacggtaaagatatgcgccaaatctttaatcagctttgccagcgtgtacaacaagatgtcgagcgattcactggattagaagtagttgatatcaaagttcatatcaatgatgtgatgagtaaacaggaatggcaggaacaagcatctggtaaaccaaattcaacagttgacactgatactaaaatcaaataggtgaggagtcgatagatatggataaacagtcagaaacaaagaaaatagttacatttgatgacacggtattggaaaaaattgcgggtaagactgccagcgaagtcgatggtgtgttgagcttacaaggaaatctaattgataatttatccgatcgactaacagcaggtgatcggccacaatcaggagtcgatattgatttggacgatcagcaaaagacggtggctattgaattagacgctatcttagaatacggtaaacgtgccgaagaaattctcacaaaagtaacgagcaaaattagtagtgcggtgacaacgatgaccggttatcaagttactgaagtcaaacttcaagttaaagatatgctaactaaggatgaatggcagcaacggcagcagtcatcgagtgataagaagaaaaaatagcgatatgatataaatagggcatatggagctattgttgcggtattagcatagaagagatgtaaaaactgtttaagagttagtgcgatagacactaactcttttcgattcttctgatagaagactattttcaataaaaattttgaccgctgactttgttcgcgtattttgttgtcaacatttggatgcaccaccgttttttatgataaaaggcgatcagttgaggttatcctttgtttataattaattgagctgtaacttactaaccgccatattttctcctatgcgcttacttttgtagatatgatcgcatacttgctaattacgaattgttttctatcattataatgtccgtagagagcgacatgtgaattgagtgtagcctgataaagaaaattgagcccatgttgatgaactaagcaattgactcgatgaccagaatcatcttcaattttaacgaaaagaagtaggggggacagttttagaactttgggttcagatacaatatggccattaatcgcaaatcgattcatacatactcacctcagctcttattatacgaacaaacgttcgacgcttcaagtggtaaaatatgactgtcaatgtcgacaacttgtcgacatggtaggcaacgaaaaacataaaatggtgaaatgcctacgatttgtcggcacatgagagaaacggcttagtcgagattaggtttccttagtgtaggtagagcttgtagattccagataaatcgtattgtaaaaaaacagattaggccttcttggaatggcttaaatcatcttagaactaatcgtccgacaggaagcgttcatggccgttttacaaactgacgaagacgaaactaagtaagaaacgttgttatatcaatgctaaggtctggttatggttggtaaattatcacctgaaaccggacctttttctgttttcccacattcttcccacgacggtttccaattgtgggaagaatcacgcttattctggcatattgattaggcattatgggaagtcttcgaaagtgtattgtcaaagatgttagcagtctcacgctgcttctcctttgttgcatggacataggcatccataattgaaatacacaagcatatgttctttgagcgagttaaagaaaagcccagttaagaactgaacttagttactacttgttaggttcttgagggtctgctgggaatgaataaaggtatttttttagcatactgtctacgctgtttacttttaaagttagtttgtttatgagcatcctgatcattaataaaaggtgctgatggatttagaatgacggttccagttatactatcggaaataaaaagttatcttacgatgtatcttacagttcggaacaaaatactcttgaattcaagcttaatcaagcaaagtcgtctcggcaactaaaacatgatgatattgcgggtaagagcattagagtgggaaatacctatcgcaatgtgactgtgagggtaaatgatccaaatgatatgagttatacagaaaaattttatagtgaatatcttgagaatcatccttatgaattaaatttaccgtggataattagtatacgtaacttgccgacatttcaaattcaagctttcgtctcaaacggccagctctttgaacagcagtctctatcaatctttccgtctacagtgatctttaaccagataatattcgattcaggcccaacatcagacccaacacctaaaccagataataaaccctctgtgaagccaacctccagaaaaaaggaacccctcagaagagaattacacgtaggcaaggaattaaaaaatattagatgtttaaagaggctgtgtctgtaaagagaagcagtcagttatcaataactacagataaaaaacaaagcagcgagagccatgatgcaagtgccacaaactagtgacagtacaggattagctgtaactgttttgggattactactactcataacagctctggtgatcaaaaagaaagggtaaatcggagttttgtgtatgagactattaaatttttgattggcaaaattacatcaaagatgtaagacaaaaagcacttaccttgtaatgaggcgagtgcctttttgtatagctagctattaaatgaaatataaaattattagtcttatatattaggcgctatcgatgtttttcacaccgtttgctgtgacaattacacttttattgtctttgtagagattaataaagctcggtttaatagtacctagagaaaaatagccaaaaattgtaattttgaattgtttcaattgtagaaatttttgtttttgtatacaaaaatagcttggcaaattttaggaagtgcggtaaactatagtcagccaaaagggaacgtatgttctcgatatggcaaacttaatagttttattattttttgtgtcagtattgtctgactgtgctattttaaagttgtaaagtaaatagcacagtgcctgttgatttatttatcagggcacaaaaaaagagggaccagctcccaaaggcttgtcaagaacgccaattcttgacaagatggcgaagttggtgccgcataacgtgatcagacacgttagcgaccgttgccctcctgacacagcctagcacgtcttggaaacgataggccatgccaaaaccattatatcattgctaggtcgttcttacgatactcttatttacgaattcgagagaatactggttgatggttagttttaacgcgtgattaacgggttaagtgggtttggtgggttcaatcaaaacaagacaatactgacgctgtacttaagtcggggggtctcacgctagcgcgtggggcccctctttttgtgtcctgacaagtaaatcaacggcgcttagataaatgtttgtggttgttgactagttcaaggaggtaaaggacatggagaatgcgggaaggcgtgatattacgtcacaagctgaggaaacgagtgcagttgagttgagccataatttgaccactgtgacgacggagattaaggcgtatcaatcaattgggggccaggcaatttttgaaattggtcggcgtttgaagtgggtgaaagagaatgatttggcacatggagagtacatgaaatggcttaaggaatcagtcaatatgaatccgactacagcacaacgatttgtaaagatagcatctgagcttccaaatcggtactcgagtactgatttgggttggaaagctctttatgagattgcgactatgccgcctgaagagcgcgacaacccccaacaacttgattcgggtgaaactaagaagccagatgagatgacggttcgcgagttacgggaaacgaagcgtaaactggcagcggcttactctgagaatatggcgaatcagacgttgctaacgcaggcggataagaaagcgcaaaaactgcaagctcaagtgacgaagttacaacaacgtgatccagagattaaacaagttgaggttgaaccagctgattatcaagatacgaaggctgatttgaaagccgctaatgagaagattgcggatttacaaaagttggttgatgacgctgtggatgatcacaatcaacggttggcttatgaattggaattggaaaaagctaaggctgatcaggaagaaattaaggctgatctgaacgatcttgaggtcaaacggcaaaatatgttgaaacagaatgcgcaaatacgcgaagttcagaagatggtcaagtcgattaatgaactcctagataattttgcgatgctgcggaaccgccttgatacgacaatgttgcccgatgagagttcgttggttcaagggctgacagaaatggccgataagttgattgaaaatgggcaagttttacatgatgatttggctcatccataccatgtctaagggcttaattcagaaatcagtggaggaggaaaaaatcgtgacatacggcttaattgatattgatgcggggactcttgttggtcaattatttgtgactgagggtttggcttttcagtggttgcgtcaacataaactggaaaccggagatcaagatacttatcgcatcgtgagtttgaaagggcaagtgacgagtatttcaccacaattattggaggcattggcatgagtgatttgggaaataagccggcaacttgggtggttgtgcagctgtttagtttagatcaggcggacggtccgatggtttgtcgcgtggtgttagatagatcagatcatttattgtcacgtgatggggtgttggtagctgttccgggtgttcccgtgctcttggcaggggtggtgattgatagtgcctctgatgatcaaattaacgaggtgaaaggacaaattaaggcaactgagttacccattattgtgcagcgaattccattggctttatcaaaagtccggttacgggtagctgaagggttacggtacttgattcgagacgtgggaacagttccccaagttgaccgtcaggtcaatcgactggaattaaccggaacggtggtcacaaaaccaatttttaaacctaagaataaagcccgatttacggccagatttgacttacagtttgggactcaaaaacaggtcgtttgtttgtttcacggccaattaagtgagccgctctatcggacagttaacggccttgaatctgggcagacggtaggcataacgggtcaacttggtagtcatcaaggcggtctggcagtggtgatttcgcagttggatgtgttagcgacggggctaacctcagaggtgggctaattaatcaaattttgattttgattattctaatggtgttggtagaagtggtccatacagtaatggagaagtgagcatgaaaaaaagaagattaaagcgctggcaagtcgtgacgtggattgcaggtagtgtaatcgtgatgggatttttgacgggaattttggtgagaaatcgagcggagaataaagagtatgttgaatcgtcacccgttaccattcaacgcacgttatcgcgtaagaccagtcgaagaattgtgttgttattttatcggccgggttgtcgttattgtcagcaaattaagcgtcaggtaaaccgcaatgaggcccaagtgaagtcaagtaggcagaaagaaacgggtatgtttttgaaagttcgaacgaccaatccagccaatacccgagtattagatcgataccaggttgaatcgataccaacctttatggtgataaaagacgggcaagttttaaagcaatatagcggcactaatccagccaaaattgatcaattgatgttaagaggtgacgctaaatgaggcgactaaaagagctgtggttctggtggcgtgaatcagcacgtcgtcgcaggattattggtttgggcctttttatattgatctgtggggggttactcggcagtatcaagtttgcaccaacgtttgccaatgttgatgagacaccattgaattccgcggttagtttttcgacttcaaatactggtgatagtgatgatgatagtagtggccctggtgttgcactgacagcgcgtcaatatagttcgaaaacgcagcgcttagtgatgcaatttcatattacgggggacaatgacgatgccacagaggcttcaatattacctagtgatttagattggtctattaaaacggtgggacaagaaagtgccagttatcaagtggtgccaacgaccacgaatcattatgttttgattgtcgaccatctggatgataacttcggtgccattcaaattacggtggagaatcgagataaaacggtgggcgctaatggtaagatcaccaagggtggatcagctcagttagtgctaaaaaatcatccaagtttggacaatcataacttagagaagttgagcgctaagcagtatgcgataacggcaatcaacaaagaaattgaaaagcaacaacaaaaaatcaagcaaaataaacaagtgattcaagtcgctcaagccgccattaaaaccgataatcaaaagatcaccatgcgacaaaaggacttaaaatatgaaacagattcacagcggcaagccacgttgagcggcatttcagatattcgtagtgaccaggatacgcaacggacgaatattagtgaagcccaaaaagatattgaaaaacggcaaactgaaattgcctatatgcagaagaaacaaacggcaattaatgacggtcgttaccagctaccaaaacccggaaagactcagatttatcagaagtaagtgcctctttttttaattttgtcgggtgattttttgatttgtcggtgttagtcagtttccaatttaggttacttttttgttagtcagtttccaatttaaggacaaaaagcatatttagtttccaataatgagcaatcgcagcaagcccgctgagcgccgacactgtcggcctagcaccgtaggtgctagcagctccccttatcctgttgtctttttgaaccaggggttgagtgggttctgacagatgtagaaagttggattaaaaattgagtcgtttgccagcttaaaatagcggcacatttcatatcgaaaggagcgggttaaatgagtcagcaaacaccactttacattcgcggattaacagaaaaagagttagtggatcttcaaagctttgcgaaggaacgggggtatgcagatcggtcagcgtattgtcgacagttgttgcgtgacgcgttacaacaagaatatgttgaaagctatgcggcaccgttagaaaaatcgatgcaggatcagcgagaagcggagttaaaaatgttaatggcttttagaacctatgccgaaaccaataacgaagcagtggcgagcaatggaaaactagccgaaaaagtttcacgcttattaaatattttagaagagtagataggagccagtaacatgtcaaaaccaacgtcagttcaagttaaaacaaccgcgagcaccgaacaaatgttagaagatattatggcatacgcacgggctaatcccatgatgatctattcagaatatgccacaaaaaggattacgaaaaatgcggtactcaatagcttaatcgcaaacttttacctgttgtttctgagagaacccgaaaaaaattttatgacccggcaacaagaactgatggctgctgatgaaccgttagatgtgaagcaaattcgcaaattacttcgccgaatagatcaactagaaacagaaaacctgatgattaacttaagcagctatgcgagttcaaagtcgaatctgacgccggataaagtatcatcggaaaaccgactaggaaacttagcggatcaagattcgcttattcgtcagtggcataatcatttccgagaaaagatggatcatgatgtgaccgttaaccgacaaacgaactaccggtaagggaggaattagcaatgccagtgaattttacggaaacagatcaagctaatgtagatcaacccaaggacgtaaacgaaactttaacggactttgaacgggggttactcattcaattaggattcttcgacacggtcgaacattcttgggcgacagaaattggtgagtatgatgaaacccaacaagaatttgtgatgagcgacgaacaatatttaacgcgctttccagtaagtgagcgtttgcgaattaaacaagagcgaaacttttatcgtgaactacgccaccaacaacacattgattttcaggcgaacgattatcgccgatcaaccgaaaaagatgatttaattcaagcggcggcgtatggcagtcaagttgatttaagtgaagcggatttaacccgggaacttggattagggaagagttatttggcgcattccaaagaattcaatgaagaacaagtcaaaattaagtggcaagtaaaatcctattatcaacacgcaactaaaccagcttggtggcgaaaggtggcagaattgagaagagtgaaccgtcatgactaagatcaaacgcccccaaaattttgaccccataaaacctatggagaacaaccaagcggcgattgtcagtggttggaagtttaatagtcccggcagtagttacagtggctatttggattatacgagccgtcaacaggcggttgatcaagacggctatcatgatttattagattacacgtcacgcaagacggcggtgcgcttagatggtgataatccggggtcgatgtattcaccaacgttcactacccaagcagattatttatcaccgaaacagatgcgaaccttgcagaaaaagttagcgacggccgaaaaaaataagagcccgttacagtacggctttgtgtctatgtccaccaagtttttggccgaaaataatatttatcagacagatgggacgacgaatcagccactgattaagcaggccattcgagacgccatggctcaactaatgactaatgaaaaattggggctgacggccttttggtggggcaatattcaatttgataccaaccacattcatgttcacttggggctgtcggaattacagtcaacgcgccggaagattcagcgcgggccacacgctggtgaatacgccggtaaacttaatggcgtttctattcagcggtttaagtcaacgtttacacggcagctgattcgtttaggtaatacgcaagaacaggaacgaatcagaaatttacaagttcagattgccagtcatcgcaaagacttaattaaaaaaatgtcgccagatgatcagctgttacagcagatttttctgaagcttccaagagataaacggaaatggtatgccagtcacgatcaaacgccagcgatgcaagcagcaattaaagaagcgcgaacttatatccaacagtatttaatccatgagccggaatttaaaacatttcaggcggaactggtgcgtgaaagtcacttgaatcgtcagttatatggtcagcaggctaaagacacggcaccaggcaagacaaaaaaactagaagaccggttgatcaacgaattgtttaaaaccattcggcacgaggatcaatttcaactttcggttaaaagtctgacgcagcaagttacccctgagttgatggcggataatcgacttaaaattaatgaactacggcggcagcttgatcaggaaaagttaacggacacgcaacaccggttgttaaagcgagaacttattacgcgtaaagtgggttataaattacagaatcgtagtttgaagctggcgggtattcaatctgaatcagaccgcttgcagggtatgctagaaaaagatttgaacgctagtccgagtttgaccactggtgatcgagcctttctggcacaacaacaattatttttagctgattttaaacactgtttaaagacaaataatgtgggcgcagaagcatacgacgatccggtcaacttacaagttggaaaagtctctggtgaaacctacgatcgattgatgaagcgcttagaagttgagttgaggtcagttgatcaagttcattcgcatagtctgttaaaagacgtgtatcaagttccattgacgaagcatcaaataaaaaagagtctgcgagctcaaatgaaagtgcttaagctaaagcggcaactaaatttggaaaagggatcaaagctagataaacgacggcagtatcagcaattaaacaaattatcagaacaagctagtccgacaattcgagcgtttacgcagctaacgcgatcaggagaaattcaggaagatcagcttaaacgactaccgacccggacaatccggcataaactgcgaagccacttgagtggggaaatgaaaaccaccattagcgaattacgacgaagtaatgcgcaactggaaaggactgcgcaagatgaacaacactcgttagaccagcgtttagaagccgaacgacaagaagaaaacgaacaagaacaagaacaaaatagagaaatgagaagataaaaaagcactacaaacgcttgaaacaagcgtctgtagtgctttttgttggcaatattctactggggatagagtatcgttgtgctttgaaaataggaagcttaaagatgaagaagtttttgacactttttatggaagtttgtcaaatggtgttgaaggatagtttctatcctttggagatctcctcgtgtgggagatcttttttggtaaattttgctaattaacgcgtagtgctagttctgtaatatttcgttgttctatacaattttaaaaccacttttaccgttttctagttgttcatgaaccttgatggtttgccataaaagcattgattcaattcggattccaagtcctttcagtgtacgaattccaagatgttcaaagtgtcccactgtatttagattattgaagacagtctcaatatgtcgccgcagattcttaagaagactaacgtcttcttttggttgtttcatatttttacgcacaggggtccacaagcggataccatacacggttaaaagtcgttccttaagccggttgctaagataaccgccatcagctaggatgtgcgtgcaaggcgttgttaaaagcagttcttcgactacttcgcgatcgtcagttgatgctggtgtaagttcccagttcatcacgtaaccttgatcgttcaaaacgatatgaaatttgaatccgtaaaagaaggtttccttagtagcgttgaaccctttgttagcctgggagtgcaaaacactagctgcctgactacgccgggcggaggctagtgtcatcggggcgctatcaaggatttcataagtactaccctgtgaatacttgcgaactaactgccatcgaataaatcgcatgattaacagaagattccgacatcgacgattatagcggctacgctcaggtaagcttattccccacaccagcatcatctgatgaaagtgagtttctgaagggtctctgagttgaatccgcatgagcatcgtagctaaaataaccagatcacttaccttttcctgcctgtagtttcgccgtaggcggactgatttattgagcgttaggtaaattggttcaataatctgtatgaatttctttagtttaacttgaatcggattagaaactgcgataaatttagactggtccttcaattgggttaccttctttgccgaagtttcctccaattgtggggctttttgttttcaatggattaatataagcttcagattgttacgtaactagcactacgcgttatctagtctcaattcacaaaatattctgccaaaatcccgcctattatttatggacgggatttttaatgtccaccacttgacttagcaattaaccgtttagaaaattaacgttgtaaatgcttgcaaaacgattcgtttctcctctatactaaccatgttgctggtacttaggtttgtgaagggagctttttagtatgagtgaagaaaaacgggttgcagttgtaacgggttctggtcgtggaattggtaagggcattgcagaacgtttagctaaggacgggtacgccgtggtcatcgccgattttgatgccgacaccgccgcagccaccgctaacgaattaaagcaaaacggattcgacgccgtcagtgtcaaaggtgacgtctccgaccccgaagcacataaggccttcgtcaaggctgccgttgacaactttggtcgcttagatacttatgttaacaacgccggtattgcccaaatcaagatgctccaagacgagacgcctgaagacatgcaaaagattttcggcatcaacgtcttcggggacctttacgggattcaagccgcaacggcccaattcgaaaagcaagacgatggtgacaagattcgtaaaatcatcaacgcttctagtatcgccggccacatcgcttttgacttactgggcgcctactctgctactaagtttgccgttcgtgggttgacccaagcagcggccaaggaactcggtaagaagcacatcaccgtcaacgcctactgcccaggtatcgtcggaaccagtatgtggagcttgattgatgaagaaatggtcaagcaattaggcggaaccaagggcgaatacctgaagaagtacaccgaatccatcaccttaggccgggttgaaactcccgaagacgtcgcaaattacgtctcctaccttggctcacacgactccgactacatgaccggtcaagccgttcaaatcgatggtgggattcaattcatctaatgacgtcacaaatcacacacaaagagttcgggacataactcggattctataaaaaaacaggaaggaaattctcgatttgtgagaatttccttcctgtttttgtccatgccctttaggttggccgatactttggccaactttaccagattattggccatcaatgcgatgcccacctcgttccaagttgccgataatcctcgtaccgagaatcgtttgaaccctaaatgagccttcaagttggcaaaaattggctcaacatcaattttacgttgtccgtatatttgatggccaatttcacttgaaagctgttctttagccttattcttaaagtattcccagttagcattgatactgatttgacgtggtcgaccactttgcgtggtcgccagttcttggcgccgcgggtcttcaaaataatcaactgcccagtagactttaaactttcgttcagtaccataccggtcatgacggacactgtaattatgaaatctaaattcgataccatctagatctgtatatcgatcattctgttcatcgtaatcccagttagcgacctttcgcttgtccttatgataggcacgagtctgttccttttcatacataccataaggataattattactttttcccatttgtgcgctttctcgtttttgacaagttttcgtttatcctttctcacaaagactgaggaggtaggctaatggcaacgaatttagaaaataagttggcaaagctacagcgagctaacgaagaatatcaggcggccaaaaagaaactggcacaagatattggtctgtatgcgattgaaaaaatggatattgattctttgaaagattttaagtcagccgtcgctcctttgttaactaatccagcggtagcaaagccaacggtgaagggtgatgacccacatgtctgagattcaagactatatggattgggcgggcataacttatgaaaagagtggtcattggatttggccgactgatcgtgactcgatgcgggtgaacttaaacaaagattactttaaccgtttttcaacgggggtgtggggtcatctacgagagtttattgctgaacatgacgatttaacgccagtggaagcaaaaaaacgattagccgagtttcaacaggctaacccacaaagtcgacgggttgatcgagcaactacagttgattcgcagccgtttgatttggcggcactccacgcagaaaagcaattgtccacgaagtgccgggactacttagttaagacacgtaaaattccagcaaaattggtggatcagttagtgaaacagggacaaatcatggaagatacccaacaccataaccttgtttttccctggtatcagggcgacaaagttgttggggctgatctacaaggcacaacctatatgaaagacgcacaccagggacgacactattttaaaggcattgcgcggcacagtgcgcacggcttcggatggacgcaagtggtgggcgagggtacgccaacccgtgcgataatttgtgagtcaccgattgacgccatgtcttatagccggctatttaatgctcaagagccgactctgatcgtgtccttgggtggagttgagaaaatgggagtgttttcgaacatgattgcggagcggatttacgcgccgggtggtcaattgaaagaactggtgttggctactgataacgatgatgctggccgccgattcattcaacagtttaaggaagccggcattcaaggtgataacggtcaggtcaaagtgaacgtcgccattccccacgaaaaagattggaacgatgacttgaaggccgatcagaagctacaacagttgattagtctcgatcatttttttaattcgacatctgagactaagattcaagacgaacaacctacgaagcagtcaacaccagcagacacaccgaaaccagtagcaaaagatactccaaaagaaagctatacggatagacgtcgaaaggaaattgcgcaatactccaaacaagtgttggcagcggcgcggaaggtgacgcgaacaccagaagatttgctagaaatgactgatttcatggcccgatttccgcagtattcgtttcataatcaagtgctcattaagggacaaaaagcaggggccttggcggtcgcgggattcacgaagtttaaacagatgggggccaaggttcaaaagggccaacatggcattaagatttttgcccccaatatggtcaaacacgttaagatcagtgatgactgggtaccattgaatcaagtgaccagtgaacaaaagcaagctgccaacaagcatcagctaccgaccaaggagttgattaaggggtatcggctagtcacggtttttgatgttacccaaacgacgatgaaagcagctgattatccaaagatttatcccaaccgaccttatgagtttccaagcaatccagaaaacattgctgatttgacccaggcagttgatgaatttgccaaaggtcaagggattacgatacaagaacgcgcttacttgaacagcaagtcagtagcgaagggttactatgcgcctgataccaaagcaattgttattcagtccgggttgccagacagtgaaaagctcaaagttcggctgcatgaaatgggccatgcgttgttggaacatcaggcagataaggtgagtcggccaattgctgagttgcaagcagaacttactagtgcagtagttatgaagcattgtggaattaacgtggaacgagaggcagtcccttacattagcgcgtggacagatcacttacagaaacttgatgaacgtcaattcgggcaacagatgaccattatcaatgacgtcaatcgggcgtcacgaaagatcattgaagggattgatccccgttaccgtgaattagaaaaaagccggacacaaacgatggtacagaaggtgcctacgcttgaaaaaccaggaatggaaccactagatatggggattcagcggcaacattctttaagtcgctaattcagctcattggattgtgtcgagtggctaatgtaagtaatagaagaccacatggtcaacaaaaagagtcatttggacattaaaatagcccttactagctgaaagtaaggactcaatcagtacacacatgaaagggcatctccatgcaatttaagaatatcactaatgaggtagtaataccacccaaatactaatccattcaatggtacagcaggagccctatcagttagatgggctccttttttagtccctgagttgcgtgcgatttaacaatgggacgcactttctccttaaaattggaacgaataaaaggaggagtgacgaatgatgctctgttgtttgactgaaaaaggtaatcaagttgacccctatgctaaggccctaggaaccccccacaaaaaagatggggtcgtgattgtccaaagtgagctgctaaatgatgaggttcattttgttcatgcccagggccatttgttccaacaatatcaaccgcaagaatataacccagcctgggcagatcgtaatgactactcgcagttacccttgttgcccaagcagtttgaggtaaaaccgcaaaataaatgggctaatcaacaatttcaactgattaaaaaggaagtcatggcggctgacggagttattttggcaactgatgccgataatcagggtgaaaatattggtcgggagattttggaacggattcccggtggcctggataagctaaagtaccgtttattgaatagttcgctgacagcagtgggagcacgaaattcgtttgaaaatcatttagtagacccggcgacaactgcggcgaaaggagctgcgggaaagctgcaaaatgagatcaattggttatatggcatgaatatgtcgcgcgtagctatgcaccaattaagagaaaggggctatcgattccctgtttctgctgggacagtccagacccccttactcacgttagttgtggaaaacgacagagatattcgcgagttcaagtctcaccgcttttggttgctgggattagaagataaagccaatcatattaaatttcatcatatcaataaccgccattttaatagtgccgatgaagcgcaaaacgctgcgcaaggggttaataatgcggtggttaaagaagtagaagccaaaaataaggtgaaaacaccaccagcactttttagcttgggtgatcttcaagcttacgcagctgataagtggggctattcatctaagtcggtgctagaaacgatgcaacacctctatgatgatctgcatgtgacgagttacccacggacagagtcggaagttatcgagcgcgaagagttcgactatttaaaggccgggtatcagggttacatgggactcttagataaagattggccgttatccaatcccgagcctcgtgaaaaagtggtcgttgcggacgctggcgggcacccggctttgattccaacggacaaattggctgatctatcaacgctaaagcccaaagaaaagaacctatacctagcagttgtcgaacgaacgatgttgatgtttgcggtcgaccagacttacgccacccaaacggttaagttaaccgacactaccggtgaggagtttgtggcaaaaggcaaacaaattcaagtagctggatggacggaactcgttcatcaaaagccgaccaaagatgtcattttaccagtttatgaagagggacaagtggtaccagttaaaccggtaattactgatgatgtgactaaaaagcctacgcgtatcacagaaagcaaaattattaaacagttggcgcctaagtattcgttaggtacaccggcaacgcaagctggtattttggacgaactcataacgaaacgaaaatatatcgaagttaaagggaaaaaacgtgaactatatcccactgatgctggccgaataacggttgatttttggcaaggcacaacgctgaccgatttaaagtcggctaaagcttggcaagatgtttttaagcgagtcgagaagggcgatattcaagccgaagcttacttaaagaagattaaacaactgttgactaaccaagttgaggtttaccgaaccaaacagccagaaatcagcattgccccaccggaaaaagtgacctattcgacaacgttaattaccccagaagttgtttgtcctaagtgccataagggccagattggtctggtgagtcgaaccgctgattctggcacaaaagagtggtatggctgtgacaatcctaaatgtaaattttcgttgccaaaagtcttttttagtcaggctttagacgaaccgttaattcgtgaactgtgccagttaggcaaaaccaaagtatttgcagacttagttgatagtaagcaacgccactacagaaacaaagtctattttcaattagagccaaaatctaaaaagctaacacctaaattcacgtagagaggaggggtttcatgaactatttagtcacgggtattttacaggattttattttaaccaaggataagacggaattaattatggcggtagacaatggtcacaacctgcatttcatgattgatgggtcaaccgaattatcgatgattcaatcgttagtgggacacgaatgtggtgttgttggtattgtcgatcagccacctattgctggggccaagagttatttagctcaaagagtcttaacggctaaagatgcaaagaaaagcgttcgagacttgatgggaacactgaattcagccgattcccatgacctacaaactaaagaaaaccaaaaggtatcggggttatctgatgctgatgcgccagttgtgttttcacccaagcagacgacaccgtcggcagaagatttagtcgccaaaaccaatttgggaagtttagataccaaggttgatgccactaagctaaacaagcgtcttgatcaggtggcgattccacaagctagcaagccagttgttgtaactactgatgagttggttggtgcaatgcacgacaccaaagaaaaaaagaaaataacttggaatgaccagggaaatctagtggatgccgctgatgagtcagatgaaagtgtagcggaaaccacaactgatgatccattggaaaatctatcatcactttaagataggagagagtgccgttgactgaaagtctactgaaaaaatattgtttgaacttgaactacaaggttaacaatgacttaggcaattacaacactattggtcgagaggcagatatggaacgattgattgcgattctgtccaacaaacgcaagcaccaccccttgattattggcgagccaggagttggtaagactgacttaattgagggattcgttaaaaaaattgtattaggtgaagtccctgccacgatgcaaaacaaaacagtgtgggtactggaattggcccgtttgatgaaacaaaaagatatgccctttatcggtttgtttgagtctttgattgatgagctgaaacaagaccacccagatgattacctattcattgatgagattcatacggttatgggagccggttcacaccaaggaaacagccttgacgcgggtaatgttttaaaaccagcgctagcgcgtggcgagattaacttaataggtgcgacaaccgttgaggaatatggcgacaatattgaaccggatggggcgttgatgcgccggttttcgttgttgatgttagcggagccaacactaccagaaacactggaaattctggaagggttaaaaggccaatatgaagaatttcatcatgtaaaaattgcgaaagatgcgctgccctatatggtgacgttctcacaccgctatatgccggatcgatttatgcctgataaggccattgacttaatggatgatgcttgtagttttgcgaatttaaaagaccaagaagaagtcacccgagaaaccgtggcccaggtattggattcgctgttaggaattcccattcactcgattttaaaggacgatcagcagcgagttacggctgtttctcaggtgcttaaatcacgaattatgggtcaagacaaagctattagcgaagtaattgacgctgtttcaattggtttcacgggattggcggatccgaataaacccattagttcgtttctttttttaggtactccaggaaccggtaaaacggaaacggccaaaggcttggcacaagctttatttgattcggaagacgccatgattcgtttagatatgtcggaatatcaagaaccgcaaagtgcccagcgtctgattggtactaagggacgacgaggaattttgacggaagccgttaagcataagcaatacgcggtcttactgttagatgaaattgagaaaggcgatcaatccgttcaggatttatttttacaaattttgcaagatggcattgttcatgacagctatggtcgggcggtgagcttcaagaacacaattatcgtcatgaccactaacttggctggtgatttgatcgatgatgcaacgaattattcgactacggggcaaggcgaaacgattgacgatcagattgcggcgtttaatgacagtgcccagcaactaactaatgggcaaaatattcgggttggttcggggaaagatgctgatcggatggcccttgattttaacaataagctacaaattgagctgacagattatttccgaccagaattcgttaatcggattgagcataaggttatttttaatatgctatcgaagcccgtggtgcatcagattgcgaagctgaacttaatgcgggttaacaaacggctacaaaaagcggaacacttggaatttatgtacgatcagcgtttgatcaagttcattagtgatgaaggatttgatctgagaaatggggcacgccccattgcttatatgaccaatcgtaaggttatggcgccactagcccgaatgttgattcaaatgaaaactaatggtcgaccaagtggattacggggcattcgagcgattgtccgaggccatgacccgattccaggagaagaccggttcggtaatcgtcgcattgaatttgaggcgatcaactaggcacgtgcgcattaccgaattgaaagtaggtctcaatatacttaagaatagtctaaagcaagggaggagaaaggagcgaaattgtgtcattgggtggtgacttgaccatactatctacaaaaagggtcagaaaataaaaggaggaaaaatatgacagtattaatgccatttgaggttagtcaattattggcaacactcgatcaaaaggcgatcggtggatatgttcatgcagcagtgacctcagctgatattaccggggaacgagaagcacacccgagtgttgagctggcgaatgttattggaattagtgaattacatgttccggggagtcaagaagctaaggcgctggttttgatgtttggtaaagaacaagcgctgagcgtcaaagagtttaaaaatattttagctaaatatcaaggctcccatttaacggtgggttatgtggtcaaagacccagaagacaacctgaatcttcgtttggtgccggtgtttggtatcacaccgggagtaagttcagatgggtgtgaggcggtttatctatccagtatgatggcgtccaaaatttcatttttaggtagcaatggtaagccagctcaatattacaagtaaacgagcggaggtcatgaatatatggaaccttcacgacgaaattttagggatagaggtaaaggtaaattcgttgtttggaaacgaatactgaggactttttttctatcagttgttgtcgttttaccagtggttttattgctctttaccaagactggaaatttgtaccttttaggtaatcaggaacattacatttactttttcagtatttgtaatcttctatttggtgaaatagccgtcagtgcttttggtatttggggagcgatgcgtccgcaaaatgcacagcagcataaacgttcttggattttaacgttgttgcttggcatcttgtggttatcggtaggtgtttttggactcatgagttagaccgggtgcgctttctctttagtttttgaaatttcattacgattataagtatcaattaaggaaggaggaaagttgtcatgaatattttagatatggctatctatacccatttcccaaaactagcgaccgcaatgatttctaatccggttatgttggcttcggtgggtaatgagaaggccgtcaagggaactactagtgtgatcaataaggttggttctgctttacaaatcattggttatgccggtggtgtggtcgcaattatcgcttgtgccttggttatgatgcttgttgggcagagtaagcgggagtccatcaagggtcacttggcgattatcatggggtgtatcgtgttgatttttgccgcgggggctttgggatcatttctcaagggttactccaagtctagtttttaagcggatcaaaaaggccggtgcctgtgagcgccgacctttttttgatcatgttggggtatgttatactaatcaggcaagaagttttatgggcggtggccgtcttttcccttgcgaggtgaggtctatgggaacatggaacactcttcagaaaggtttcacggtcaatgagtgtcttccagacactctcgttgatgttgctgtttggcacgtttttaattgcgctactcagttatatcgacaaacgcaacaaataaaaaagccgccccattcataactttggacagttatgggacgagcttagtctcttaacgtaacttgccaccgcctttaaagcggcttgcaaggactagtgttgatagcgctagtccttttttcatgccttcattttagcataattttgtgttgacttaaagctaaagcaagttatgtgcgatttctcgattgtggtctctttcagcttaaagtgggaccatcatgaaagtaggaggggacgcagatgtccttatttagaaaacgaaaagtcgagttaccagatgacctagttgttaagacagattttactaataatgacaatgaccaacaagagttggttcagaatcaggttacgtctttggaacagattcaaacggaagctaaggaaccatatgttgtgacaagtacataccctgtcatgcgtattggaacggcgcagcggttattgaccaaggttgcggagtccatgtcagcagatatgaacccgattaatgtgaccctggacttcttagaacagatcgatgggcgacatggtgttaatcaagaacatcgatatgatgttgacatagcgattgactatgcttttaagaatttaacggtcccagtgttaaaagatttgtttaacaatgacaactatgatgactgggattttgcgactaagacgcttttggcaaaggcaattgttgataaatgtgcggcaggcaaagatattattgctggggatctagctaaggtgcctgatacggaaccactcaatggcgaagaagtggttattgagacagtcacgccaagcggcatgttgtcgggtgaaaccgcgaatatgaatccatctgagaacacatatgcggattcaggggaccatagggaagttcaagaaccaactagtcaggagctagatactccagcgcccgcaggttcaacacaggtaggcaatatgccaggattgaggcaatcggaagctacagctgagcaacctcaccagcgctcgacagttccgacacctgattcagaaactcaaaaacaaagtgagccaaatacgaaaaaagaggcagaacgtcctttcaatcaagttgctcaagtcgaaatcttgttgccacgttttgaggttcaagatgtaccggcagtttctcctgatgatccggggtacgttcagtaccggatgaatgaacgggccaagcaaaataaccaagctatcgatcaggtcgaaaatcagatcaacgcatcattaactaaaagccaatttgatctgtcagtgaactatcaaaaaattgtcgatcaaaaaatagaaaaacgtgaagaaacagacccactagatatggaacgtattcgccaatctgttttggatcaggaccatcaatcactggaacaagatcaaaaagcgttacaaaaaaaagtcgatacggttcgggacaacaaaattgccgaagcccaagcaacttttgaacgactcaaaaggaaggccgaacaagaggcagatagcacttatagccaaggggcacaacaattgacagctgattaccaaaaacatgccacgaagaaacttatggatgctttgtctgatggtcaaaaggcgcacgagaaagacttagccaagtatcgtgactcattatctaagacgtctgagaccgacctgagagcacaattattggctcttcaagagcaggcccagacaaaaggatctaacattattcagagcttgttagcggggaatgaaacgtttgaagcccaggtaaatagtgaacacagtaatgctttgaacgcagcaaccgctaattatcggtcgcagactaattggaaacatgttagtgatgctgaaaacgaagtaaatcggttgaaagcccaaaatgcagaactgcataaaactaaagcacagttgaagaccagtgttgatgagttgaagaatgaaaagcaacaggagttaacaaaagcgacacaattgaaatcccaggtggagcagctcacgactgataataaagtacaaagtgagcggttagataagttgattagtacggcaaccgggaaagaaacatcaacagcgggtatgtcgaccaatgaactattaaccacaattctgttgggacaatatcgacaaacagggacaggtcaggtccccgcacctacaacgaattcagcgagtaaccccgtaagtaaaaaaaactgggggaaagcggcgggagtgctcatggcagggggcttacttttaggcggtactggtttttggatcaatcaacgtgatcaagagatggcaagtgctcaacgttcagcacaattacaactatctcgtaaactagccatcgttgaatcgcaagctaattcgcaaagtaaggcagcgcaatcgtctagtcgaacttctgcggaaaatcaagcgaaattagaatcggccgaatctgtgtacaagcagcgaatgaaggacttcgaaaagggtgccgccatggcggctaagcagacctcaacacaaagttcttcggctgataccacgaacaccaagtaggggggataaaggatggcacataagattgacttttcctcgattgtaaagatgcaaagctatgctaagcactttacgacagctacggtggcacatagtggcgtcacggttaacgaattttataccctgactatcattaatgattactcaccatgcacttgggttgatctcttacgagaatttagccaggcaacgttggccgcgacaacacatagcttacgatcgcgtttatcgcgagtggttaaacagttggagcaacgaggattggtgcaacgtcaccagtatcaagttgaccgccgttgtcaggagttaagcctgactaaggttggtgaagaaactttaactcaagttgagcaagagatggcagcagcggttggtctttataaggcaacggttgatgatgtttttcctgtgaatcaacgagaaaatagaaaggagtgaccgacttgcgaaaaaatgggtcaggtagaaacagaagaaagatggcgtcaggcccttggtgggcggcgtcacctttttttacttggtctgggctggcaggtttactagtcgttttacggatcatgctaaatgtgatcgtggtttatggctggtcgttgttcatttgggtaaggtctatgatgatcttgctgcttaagcaacagcctgattttgtgaacttcgccaatttaatgcattggcacccgttaatatcacttacagattggcacgcaccgctattcttagggctggcgccgtttgcgatctttggttggtggggttatggcgtcacggttgttgtgttagctatttacttgaatatggttcgccgtgtaatcatgaccacggtgtctttcaatggtaaggagcatggggccgagtcctttgcgacaacccatgaaattaagcagacctataaactaatcccggatcgagttagcagctttccgggcgttggcggtatgccggtttcacacgtgggtaatttagccatgatgccacaaacctgggtcatgaatcgggccaagtctaaacgcatactagggttcaaaacagtggctaatttaatgcgaaagacggttattcataattttcagtattccgattatccattgggaaaatatgcgatcgatactgcgaccgataattcattgattgttgggggcacccgatcaggtaaggggcaaatgacggttttaccgctaattgatattttgtcgcgagctgaggaacagtcctcaatgattatcaatgatccgaagcaagaactttatggacaaatgtaccgaacgttaaagaagcgtaactatcatatcgaattgcttaatatgtccgacacgtcgcgatcgatgagctataatccgttaagcgttatcataagctatgcgcaggagaaaaactgggacgatgtgcaaaatgaagttgagcgattgtcgacgagtatttatgtcaaaggtgacggccaacaaagtggcggaaccgaggcatttttcaacactagtgcggcgaacttactgaattctattattcttgccttgattgacctggcaaatcgacacagtgatgatcctaagagctggaatcgcgtgactttgcataatgcttataagatgttgtcagatttgggcggccaagaaataacgattatgacgaatgggcgaccaactggtcagacaacggaattagtcgagtattttgatggcttacgagagctgaatgcagcttacccagacagtgagggacgccaggttcgtgagatggcttatacagcgttcgcccaaagcaagctttctggtagtgaaacagctgggtcgatttattcaacgatgatggaaggactcaagatttatcaacaaaacgatattgcccgtttgacctcgcttaattcatttgatattaaccaaattggtttcccccgaattctctacttcaacttgccgcatgaattccggaatggtcgcgtcgaggtttcaatttatacggcagagggtcaactgatcgagtccaagcggcgcaatgttaactcagtgggagccgttgcttatcccattaagagccttttgaatggcaagttcaaaattgcgatcaaagccagtgatgcttaccagcggacggcgacgcaatttgaagtgctcggggaaacgattcaccgattccggcaacctaagagtgccgaggttctccaagccagtgaggcgttgttcaatctaaatttagagtattcggagcaaccaacggcaatcttcatgatcacccccccggataaccctagttataatcagattgtgaccttttttattgaccagacctggaattttctaaataaaatggcggccaatacgcaggaacgtaagacctatgttcgtgtgcataatattattgatgagttcgctaatgttccgaagattccgaacatgacaaccaaggtttcttatggactaggtcaaaacttgttgtttgatatttttattcaaagtctgtcacagttagagattcagtatacaaaaaatgaagctgaaacgattcgaagtaactgtgccaatacaatttacattctgagtaatgaagtaaaaaccgttaaggaaatgtcggaagcattaggtcagaccaccattatgagcacccaacataagcgccatagtgatttaattgggaatacggcggatggctatggtgacggtaattctacgggcgttgatgtcatgtccgcagctgagattatgcggctgccgcgcggatcgtcgattgtgttacggacgacacgggacaccaagactggtaagatgatccgtaataaccccatctacaatcatggacgtacgaagatgccatactcctggacgttcttaaaacagacactgagtaccgatggtgcagctgatattgattatattggtgcgcatcaggggctggatttgacagaaaatggatataatttttcagctgaataccatgctttggcagatggtagccaaccaacgactgatgcagctgatgttgtaccatcgccgacaactgaagcgaactcaccagcaagtgaccaacaagtgggtacagttaagctgttaggcaagatgcaagatgaggtaagcggactaagtgatgaagagcttctacagtttggcaaacaactgtataataaaacgcaagcagatcaagactatcatgatcaacttgattccgatgatagtcttgatctgcttcaacagtattcgggtgataaacaagtcgataatttacgcgaatttttgacagaccgttgggagcagttgatcccgtgaaccgcagcagaatagacaaaataaggtgcagaaatgctaaatttttgcactttttttaatggttgatttattttgtaattacatatataattacacgtatgaaggagatgttcgtaatgacagtaaaagctcgaaaacaaggtaattcgctaatgattacagttccagccgacttcaaggttaaagagaacgcggaatatcaacctgttatggatagtaatgggattttatcatttattccgactcacaagaatatctttgaacaaaatcccgattatgactttcaggcagcgcttaaagaaatgaatttggccgataacggagaaatggtcggtaaagaaaatgtttgggaataaaaatgaaatagcgccaaaacagggagatttgatttggattgatgcggaaccccatgccggtcatgagtatggagggcatgataaggaaaagcataatattcgacggccaatgttggtgattagttccgacctttataatcagagaactggcatgattgtaggattccctattacatctaaggttcccagtggttttccaggggcgttaaaaattgagagtaataaggttcatggatatgccattctaacgaatttgttgggctatgattatagtgctcgttccggtgaggttgttgatcatctgagtaaagctttgaggttcaaggctttggaagcagttaaagacatttttgatattttcgagtgaaatggaaaatgaataaaatttgcttaacagatgttgatgatctattttcctcagatttgcgtgatccgaagttcgctaatcaggtcaccgcggaaatgaataaattaataagtgcggttgccgtccgtaaagagcgtgagaattgcggctggacccagcaagaactggcagaacgatcaggagttctacaatcaatgattgcacgagttgagaagggagcaaatatcagcatgaatacaatctctaaaattatgaacgttttttggaaaatcagttaaatggtggatgaagtatagaagatgtattttcggattaatggcagttatggtagtaggggttctgacaggttgtagtggtgtagcaagcaatgttaaaccagcaacaagcttagttgctagttaaaagaatagtgagcaagcttggattgatacttatggattgaaaggtcatgatccagttgattcggtgcttgttttcaaaggaaataagtagccatctacggattcccattaggcgccaaattatcagaatttgaaggtttgtctaatattcagctaattaaaaaggctaaatacctgaattaatctcagtcccaaaagttgtttggtcatgaaaaggctcagcttgttcatatcaaaaagagccaatgggtaagtgctgagagtcagaacaaagaaatcaaagacattgtggagagctggcactttgtaaaaccggtttttaaaaagcataagtataaagttactaaaactgaaagtccggccagcaaaagcgagaatttagacattgttgcgcctgattctagttataatctatttactatgacatcctcgctagatgacttagagggtcagctaggcagtatttcaaaaaaaagttgggaagataatattaggtttaaattagtgaagccggtaatagctgataaatggtcagaatataagatgaagggcataaatgacgaaggccttgggacacgcttaattcagccaggttcacacggagtctcactagataaataacgtatgtaaaaccatgtcattgtatttgatggcatggtttttatttgtgtgcgctttacataagtggatagatttctctttaaaatcagattaactaaatgattttgtgattttggttttggaaaggaatatgtctaatgaatttaatggttaagttagtttttctggccagtgccatgccgattcctgattctctaaaaaattcgggaacgattaagggcctgctggggtggctaacgggaagtgatgtgactacaaagaagccagttatagaattttatcaggcgtggtcagaaactttgggtcccatcagcaatgcaatgttaacggttggctatggcatgggctctttttttagcaagatgttctataacatcggcgaagtattatctgcagtttatgccaaaatgtttggattactggggtttttggtcaaaggaaactatgctgggtctagtcagattagcaatttgcatacttttctcgtgattttaggattctcaattttagtggtggctattattggttggtcaatagcttctatggttaagcgtccggtttttaaagaagcaatggcgtcagttatgactgcttgtgcggttatcattattctgccatggttggttggggaatttaattcaatcacggttcacgctacgacagagatgaactcagcggtgacaggtaccaaaaacgagagttttgaagactctttaaagcatgtcgtcatttcgccatataaagataacaccattgattggctagttatggctgaaaaaaatttcaatacgaatccgaaaaagattggtggaagcaaaggctggtcagattttaatcggatagataccgacaatctcaattcgattaatttcactgtcaacattgctaaagataatattggatatgtctctgacaagaataagttgaatacgaatgtgtttaagtatcagttagataccggagtgactgatacacataacactaaggtcgccaagttagatctccctgctacgcaagttagtggaattacccatatgggacagctggtttaccctcgataccacgtaaattggattgccgttattgtggaattgattttactagacggtttctttttgttagcgggttacaaggttgcaaagtacagtattaagattttcttcctaatgattttatcgcctctggtggcgctattccgagttcaatctatgaagaacgttaaagagcttataagttcgatcatcggtgctagtaccggtattttcgttgaaaatgctggtgtcttcttcttaattacgattattcaagtaacgtcgggaacttctaactttattggtggtttagctggcggttggcaacgggttattgccactttgatgatttatggagccgctattgcggtgctgattgctggcgatcaatatattcagcgttggacagggacgtctacagggcaatctggtagtatgcgtgatctagttgctgggtcgatggctgctgctggactaggtaaggcagctaaaacgactggtaaagcagcattagaaggtattggagctgtagcgggtgcggccggttctgttggtcacggaatcaaaagtgctggcggtaaggcaaagggtgaaattgataaacttcgttcatcggcgcttcaggacgagtccggcgacggatcaaccaactctgctgacacaccgagtcaagacaatagcttgaatgctgcccaaacaggggattcagtcccaagtggggcagacgggtcagaatcggaaaatacggcggataggtcagatagcggacagaatcagcaaccaggtaatgctgcggctgaacggccagaagaacaggtcggagccaatgattatggtaaccttgatcataatcagaattctttagggagttcgaatacagctgatgctaaccctacttctgatgctaaccctacttcaaaggacgtgtcaccaaacgcagcgcagacaatgtcagaagatggagacgctttcgattatcaggaaggtctgggaagcttggacgcaaccgaaccaccggtttcaaatgatgagggtgggtcagttactgatgcaaataatccaggcgaagctgatccaatcagtggcagttcctcgacagttccaactagctcagggttaatgccggcaagtgaaaacactgagttatcacctatgggtgataatgatctgccaaacgatgttggtcgtgcaactggtaatgaggatctcaatgcggcaagcggagcagtttcaggtacatcatcggaatcaactccaataggtgaagatattaatgccgcggctggtggacaatcagatatggggtcaccacgtaccaccggtgcttcgggtgcaggacatatgactaacgttcgtccggatacgaattcaacaggtagtgttcgtccggtcgcaacgacggcggggagtgctaagcaagcaccaatcattccagcaaagcattattcggcatcatcaaatgtggcgtcaaactttaaagcgccccattcaggaactcctgatgtgccaacaactccgcaaggtgatagcggtcaagccccatcgaatggacgagtaactaattttaataatattccagattaaacaagcacttctggcaaaaaaggcatatccaaggaggtatgccttttttgatggtgcggtttatctattgtgctccttgaggttataaggtatagccaacatttattttagccgaaaggagcgaatggatttgcaagatggttttggcgtcacaccagacattcgcacacgcatgaaaattgcgatgttctatgtacgagatctgatgtttttgattatttgggcggggattattttcatgatttcagatatatttccaccagatatgcagttagaaaccgtatgtttttgggttgttggtattggctatggtgtttggttggtttgcccatcgctgggaaatcatggtaagcgtaattgggaattactcatttatgatttctttccgaaaaagacacgatttaaaagcctcgattatggggttttcgttaaacaaaagattgaaggggtgtggaagcgatgatttctgttcgacacagtggtaggtctcaaggaaccagtcgattcgagacgatggacaaagctaaaaaagggcaagacagcaacaaagcgtccctttttcaaccagatcggcagtttcaaatgaccgatttgattgattataagcgattaacacccggctcagatgcgtttattgaattgaaagtattcgggtatgctgaaattttggtcgtcgatgggattgggttaagcagcgttcccgcaacgaaattagaggcagtatcagactcattgactagttttttaagacgatatttgaatgacgttacgtttgttatagcgccctttccagtttcaacagctaagcagcaagccttttggggcgagcggtatatgaaatacacccggatggttcaagaaaaacagtataaaaatagacaagctcatcaagtcttggttcagagacagcgattttgtcaggacaaaattaaagcagctaagggcattgaagaaacgttggaaaaccgggaattctttgcggtagtgttcggtgatacggtacgagaattgcgtagcaatctgaatagcatagatggattgctgggagatgctcaggtgtcagcctatttaaaatttcgaatgttggaacgtagtcaaaaagagcgggtcatggaacggattaataatcctaacgtgcgggtctaaggagtggttaaatgaaaaagcgagagattcagaaattagaaaaacaagattatgatttggcgatgattgcccggacacaaccacaaggcaatatccgaattagggatcgagtcattgagtcaggaactggtgtagaagcctgtttacacgtctatcgctatccaagttccggtttgaagtatttttggttaattgaactgacacagtttaacaacacgattaccacgctgtcgttggggacagaaaacaaggaagctattaaaaaagctttacaacggtcgacagatgaaaaacttagtcaagctatggacaagaatggcaaaacgttaggcaagttgcaagcagataaagactatcgccggcaacttggattacttagtcgcttaggtgacaatatggaagtcatgaagcgggctgacgtacggattttcgtttatgccgacgatgaacaacaactcaataagcggattaaggcgattaaagagaaattggggacttacggtgttgcctgttttgttggtgagcaggattctgaattacgtagtctttggacaccaatgatgaaacaagaactattgccgaacgtgcggcatggtacgccaattgccgcagatgtcttgggcaagggatttccgtttaaccatgtgaagctggacgacgatggtggatcgtattttgggaagagtaccactaatgggccaattatgctgaatccgttactgatcacaccacgacgcttaacgccttacttcatgatcgcggggaatccccgcaacgggaagtcgaccttcgccaaaaaacttaatgatgacgtattcgctcggggcggtaaactgagaatttttgatgttaagggagagtacattaaagccgcgcgagaacaaggcggcacggtgatcaccttggatgggtcgagcgtgcatattaatccatttgaaattttccccactgcgactaaagaaatagatacgccggttacggttactgatgagtatggtcgacaaatgaaaaaagacaaacatgaaactgttgttgatgaaattggatcttttaatgcccatgtgcagaaactgcgtaatatgttcagttttcagaattcggaagccacaactgatgatctaaaccgattggaaaatattattactgactattacattagtgaagggttatgggttaggcaccccggacgtcatttaggagacctacattctacgggattgccacataatcagtatccaaagcttggggattttctcacctatctaaaagaaatccagcgtagctatcttaatccgaatcgtccgcatccagaggtcgaaattacttcaatcaatcggattgtcgatacctttcaaaagatgttgcagtcggaagccattatttttgacgggtttacaacgatcccagatatgactgatacggacgtggttatttatgacttaagtgggttaaaagcccatggtaacgaagtgtttaattcccaagtgtattcagcattatcgttggtctcggctgagatagttaacaacggcaagcgttaccgttacttgtacaacaaccatcagattgatttggtcgatattccttattattgggtctgcattgacgaatttcaaaattacgccaaggaagagttctcagcaggattggaatggctttcaagcctaatggaagaaatggcgaaagacttttgtggaatttcgttgattatgccgaccattaaagaattaatgccggatcaaaactatcaagcaaccaccagtcgttcacaacgctacttccgttcattatctaaggtatttggtatgatgacgtaccgctgtttcttccatctatctgatgatgatattccccggttgtcccgggcattgggtagctcagttacgcctgatgagcttggcgcaattactaagttaccgcaaaagaagctgttaatgaacattcagggcgatcaaaattatgtgtttactgttcatgccacgcctgacgagcttaaccgttatcaaggtggtgttggctaatgttatccagacgggccaaaaaaattggattatggacgattggcttattggtgccattgtttgttttattttttggcgctatgatgttagctttattgtttgctggtggagcggcttcggaatcgggttcctgtagtagtggtaatgcctcgaatgtcgatgttacgacttcagcagatatgaacaagcgagcaaagtctatttatgaatatctacgttcagagctacatgcaactcctcaaggtgctgctggtgccatgggtgtttggcaatttgaatcgagctttaatcccaaaattggtaacaacgctggttctggagctaccggacttgcccaatggatgggcaatcgactgacgggtacaaatggattaaaagcatttgccagtcgcaaaggcgtaaagtgggacagtttgcaaacacaattagactttacaaaatatgaattgaatcatggttatcaaggtgctaaagcggcattgagaaaatctgacgttcataaggctgcttatgattggctgatggactatgaaggtatgagaaataatccagagcaatggtatctcgagaagggcccatcgggacaacctggtcgttatcctgacggtgatcattggtacgccaagtttggcgctaatgatacgggggctgataattctggtgatgtatctgatcccgatgatagtggcggtacaggcaatactggtggttgtggtagtgatgcctcagcagctggtggtgactggggttggccttataagggcggtaagtatgtcacgtcaggattcggtcctcgtgatctagcgggatcaccttggcacgatggggtcgattttgatgcgggtcatggtgccaaaattcgagcggttcatggcggcaaagtcatctttgttggtgatcccatgaagaaaggaattaccgactcttacccctatggtttaggtaaagacgtcattgttactaaagtcgatgacgggtatgaagttatttatcaagaatttgccatgagtgggccaactcacaaggtagcagttaacgatacagttaaaacaggccaggttattgcaacacaacaaacaggacacttgcatttgggcgtgaccaacaaaaagagctgggtaactgctcagggtgactggcagaatccgagcggtcattcatggcttgatccgttgaagtttattgagaagaaggcatcttaaaggggagtagtcagcgatgcaaagaaacaatggaaaacaattcaacaagattcttgtgattataggtatagtgtgtgggatagccgcgttggtatatgctttaacattaaccaaatctaatcgtcaattagccagtagtaatgcggaattacggacggaaattgaagcagctaagcatgataatcaggccataaaagaaaataagatacagaagtatagtgctaagaacttaacgttggctagtaccagttcagtggccaatatcaatacgtttttaaagacgtcattcgaatgggattttaccaactggtcaaccagacaggcgcgagcgcagaagtatgcgacgccatctgtggtaaaaaagatgattggtaatctgaatatgcagtccaagagcacgcagtcttatatcaaatttcttaaaaaggataacgtataccagaagattaattcaaagcacgtctatgtagaaaactctgatggtcagaagatcaatgggattgcgacggtcaattcttcattgattgatggcaacaagacgacgagtcatcaagtccagtggtatcacttcacctatgacgttcaaaagcatcaggtgatccagatcacaccagtgtcggtaaattagtgaaataagggaagaataataatgcagtaacgccaaaacagctaaccgtaaagaggttagctgttttatttgtattggcaatttcgtatagttgtcagagttattttatgcaattctccttgaattaatacccaaatccattcggactgatagccctttatatagccggtaaattctgttggggtgccatttatgtctacttgatttagttgaagtataacggtcttgccatatttccaagcttcagataaacactcgctaatttcagtttgtgacatttccgccctttttttaggtatgggactattcacctctttatttatagctgaggtgtggtcgcttagaaagaagccttgccacttcaacataccacaatctaccaattgactatttattaaataagtgtaaaaattagggctgtatttataattttaagctttggttaatttaggagcgtatgaagaaaatgcctgttaaaaagaatttgcataatcatagaaaacataatggcaaattctataattaatccgaacagaaattaaaaagcccaaagcaatcacttacaatggtagtagacatttaagtagatattcgtagatacaaaacgcccgggacgttgatccgggcgttttttttacaaaaaaaaccagccacagatgagtgtgactggtttagaagtcgttcgtttatgaagacgctaattaagcaactgtaccgacgcgcgcataaccaacagcgtgccaccaaggggcgtgaacggcttccgtcacgacaccgcggttttgagaatcgatcatcttgccgccgccaacgtacaggccaacgtgagagatagagtgcttggaaccgccgaagaagaccaaatcacccttcttaatgttcttgtagctcacatgcttgtacttgttgtattgtgcttgagcggtccgcgggatcttcttggaagcgccctttttgtagacgtagctggtaaaaccagagcagtcaaagcgggaaggaccagtagagccccaaccataaggcttacccaattgggctttagcgaccttgtggatcttgtcgtaagacatcgttgccgcattggcatcgacaggttcagtgatggcaaacccagcaattgcaaaagcaacagtggcaaccaaagtcaagataatatcagtcagcgtcttcttcataaatgtaaacaaactccttaatttttttaatgtcttggtgtattaaatattttccgtttcgaatcaacgtgtttaatactatcagggagttgttacagaattgtctcaaaccattatcaatcggattaaaggtgttggggggattgcaacatttgccgttaattggccgggaaagcgtgaggaaaatgccgacctgccgccatttcaggggtcaatgtgatttgttgcaaacgactcgttgttcggggaataaagaggtacgacttcgtatcaaggtcgcaaattccccggtagtgcgtgtaattatgattccgatcgtggcgtcgttcgggctgataagggagctgaacttcggctaaccactgaaaaaggtgggtgatagccgcgccggtggtggttgctggcggattgccccaacgccggatagccgtgtgaatgaagcggttggtcggcacgggaccgctgggtaacggttggccgctagccagatacgatcgagcggccgcaacggttgctggtgaaaagtctggggcgtcaacggctaaaaagtcattgagatttctcaggtgagtagccaatattggtgtattagtgaggacaccagccggatttaattgggctgttagtgggccaccggtgggttcgatgaccagtgtttgcccggaacggtcgctgagaatccaatgaaacgggtaaacgtagcggtcggtcccccaaggctgatccaccaacgtgacgtgcggcagatcggccgcaattgcggctaaagtggcgtgttcgccgagggcccagttgatgaagtcttgaggggttaggtttatttggcctgctacaggagtgggcgcgtagtcgaccaccccgggtaaataaagttcagcacaactgataccgttttcattaaaaccgtccgctaacaggtaggccgaaaaatcggcggccattcgcccgccaccgagaatggcatactgggtggtccgggtgacatgtaaggccgtttcccagtgatagtgacggggtaagaagacgggccgccaaggagtcgtagtgggaaaatccatcgtccgggcgaaaaaatggtggcccgtggcggaggtgtaggttaaactagtacacacgggggattcctcctttaaagtaataattaggctaagtatacgccaaacttgttgggaatgacgcttgtattcccagattgaatctcgtaagcttaattgataaggctgatttttggaagggaactgggaaaatgaaatcgacttggaacttagtgggaatggcgctgtgggtgctggtcctcgtaacgttaatctggatggtgcatgacatgcgggttcgccgcattcggctcatcgtgaaggaacaccatagtttctcgtggcgcaacttggctatttcgacgattgaactggtcgtttggctactgttttttggggggatgagctacacgacgttctttcaaaatgtgaatcagttaggcgaccgggtgacccaaacaacacgctatgagccattggtcattaacacgggcagtgggagtggctcagcttactacgtgacggtcgataacagtacgggcaagcaacccgtgcagacctatacgtacctgactgagggcgaaaagtacgaggtcagcagtacggattcgacggtttcggatggtaagaaggccattaacctgccagcatctgcatacaaatgggacgctaaaaaggttgcgaaatacgatcaacgtcatcaaaaggcgtgggtgggcgtcgtcgagacaacgtataagaagacgtttgttaatggcatcggtttgcacgcggggcgcttggctagtcgctttacgttgattcgaattcccgatcactcctttatgttacgtaaataaaaacgaaattttggatgataaattaaaaaagcggttcttgcagaacgttaacttctgtaagaatcgcttttttagcaatggtatcgctgattaaagttgttttagtgttacctgattcaaggtagggcgtagtcatctggattggcagtcgctggaccataagcgtccatttgactgtcccgatagtcccaccactcattttcgtagccgacgaatccggccgctcgcattgcttggtctaggattttgtagtggtgttcttgaatggccgttcgtgaggcatcccggtgagcagcggctgtaaagtcgtcaaaggccgtttgcatctcaagttcgttaccgtctaggtcacatagtgtgagatcaaacgtgacacctttttggtgtgagaagttcggatcgggttccgcaacaaagctgggatcgggatagacgtcaaagagccggcgttgggcggtcacgggtcggtaagcatcccagattttcagccggtagccttgttgccggagggcagcactggcagcggccaactttttagctgtgccggtacgggcgatggccgttgtgaaatcatagaccacctggtgagtgaaattattcgtagtggcgtagcgcaggtcgaccaaaatgccggggtccagcgcttgaacgttggtaaaaccagtttctagttctgacatggggcacctccaataagaaattaccctcagtataccggcttgtggcgagaaaagcttgaattgtggtttgcttaaaaagtgggtaaagttgaataacgaaaaagccccccagcaattagctcgggggacttttagggtagtcggaaagcgcagaaaacttgatgcaactttcacactccttagtttacacgtttcactagtgaatttcgagtgaaatttggacttggtaaggtgacctcccaattagcgggcatgttcgactcggtcttgggcgtaaataccaatatcggccacgtgaatggtacccgcgtgttgcttgccaacggtggttaataggccaattttgttgtaagccatggtggtcgtactatcggcaacaacggcaacacccatgacggcaccggtatcagcattaatacctgacggtacgtcaatggcaacggttttggcatcggcagcgttgatggcgttaatcgcatcagcaaatttgccggtaacgtcgcgggtcagtccaacaccaaagatggcatctacaattagagtggcgttaacgatctgattgagatcagctgtgaccgggatattgtagtaattggcaatctttaattgttggctagtttggggcgtcgcgttttcgggatcacctaagagatagatggtgacgtcaattccgcgaattttgaggaggcgtgccacggcgattccatcgccaccattgttacccgtagcagcaacaacgacgacacggtcaaggtcaaaatcatcatttaagaggttgttgaaagttgctaaagccgcccgttccatgaggaccatggcggggatgccaatcacgttggtcgcgtgggcatcgtagcgttgtgcttcggcaatcgtaatcgctttactcattgaaatccctccttagagtcaaataactaatggttgttggcctgttgcttttgtaagacacgcgatgataaccgctgaagctgagccgtaatgacggcgtagtcgaaatcagattgattgggagtcgcctgttgccaccaatcgtgtaagacggtgatggcttgttgaacgagttcttgcccagatggtgtgagttgtaggcgccggttgcggcggtcgcggggatccgtttctttttgaatcagttcgagttcgactagatggtggaccatgcgggccattaatccctcatcgacggccatcgtccaagccgcccggcgttgatttaactgacgcgtttcggaaattaagaccagtaaataaaattcagtgatgttaacgggcattttgtcggcttcaagaagctggttcatcgctcgctgaaattgccggtggaggatggccaaattcgtggtaaagtctaatattgagtcttccatgagttgccccacctccttggcaaaaaagttattttgactatgcccttagtttacaccagatgggggtcaacgataaacgctttagctctaatctgccgctggaagtgatagaatagtagcaaaactaatttatgggaggcaacactgtgtttattcaaataccgatggatatggatgaggtgcaaatgcgccagttacagttaaagcaacacggagaggtcgccagtgaagacgagattattcgccaggcagttttggatatttgccagaacttcttggatcagattgaagatggacactatgactcggtggcttggcaggaagaaaacttgacggtaacggacatcaatggtgaccaaatggcggtgattaagccgcaagggtcatcgttcgtggctgattttcggcagaatgcggatgttacgctacagcggttagaaaaggccgcgattcaagcgtctggtgcacggtaaaaaatggggtagcgctttctgtgattttggattacactagaggagatcaagcgcccttagtgtaatggatagcacatgagatttcggtcctcatgatccgagttcgactctcggggggcgcatttaatttgagatgagacgttggaaacgttgatggggcgctagttgtggctagcgccttttttgttatgatcggaaacataatggaacaggttactggttaaaactcggtcggggttcaattataatgaagtcagttattggttaagaaaatatagaaatgtttctaacgcacgttcctgtttggaaataattagagacccctttggagagaggcgatcagagataatatttgagcgtgcgccttacgtgaacgtattgaacgtcattttttgattttggggagttagacttacaggtaaaacagtaaagtctaagggcgtgggggtaatggcatactttgcgctggattgcataaaccgttcaggtagcaaatggcatcaataagtgaacctgaggtacatcattgattactaagtgaagacgggccgcatagtcgtgatgtggacgtgaattaccagttaaacgaattacgccaagcgacctgtttcattccatgaattagtgggttgtcggttgtaattcaatgaatattcactcataattaaacggttgcctacctatgctagcaatagtgaggaggtgtagtaatgttcacatcttttttcgccccgcttgcggttggactcttagtagccctgtttacggactggttagaccgtagacgccacaagtaaaacgccataggcaacacctaacccacccgtttagttacatagacgtataaaaaaggcctcgactactccacatagtcggggcctttggtgtagcaatgctacatctttcttcgcaaagtcattatagcatgaatggaaaattgatacatgcttatgatacttatatgagaacaaaaataaaaactgctagccgttaagctaacagttccatggtgcttgccgtgtgacacataatcataatggagtcagttgttggcttggattcactggctactggcgttaaggacgtgcgtactgattcccacgagatgctcgcgtggctccgctggattgggccgctgactcactttcgtaagtatagttgtcggggttcgtaacccgtgaataatacttatggctgtcagaaacgtataccatgccggctgcggcgacgttccactgacctgatttcgtgcccgaatgagtggttgaccgggctgtggcgtttgttttatggcttgcactgccggtactgctcctgtaaccgtggtcagagttggtactggttgcctgactggaccggcggctggtcgatttaattggcttggcattgttgctgccggtattgtagttaatcttgataccttcagctgagttgatcacagcgaccgccgtgttgatttgtccatctgatgacttaatgtctacgatggaaccgcgggggatggtttcactgtgataatagagtggtgtcgtttcgtacttgatggtatcactggtgttcgggttggacgcccaataagcttccgcggtctcttcggcgtaacgcatgccaccgtcctggtccgcgccaacattttgtggtcgggtaccagtggtgaagttgttttctgacgtgtaagatttggcgcccagtaagctatcaccgatggaatggctgcgattatagagataaccgtggtaggtacgaccggtgaaggcatagctgatagcgactttgggattggtcgttggccaactacttggttctagtggggaaccttggcgggaaccccgtgaatcggcgtattcgccgtaagtcaaaactgcgcgggcggtgccggcacgcccttgagaatcactagcaaaatggtaatcaccagatttgagatgtttgaatccggtggtgtgggacttacctaactgccaataatagtcctgagtcgggccagccgattcgtgattggtatagctgacaagttttttaagcacctgactatttcgagacgtggttgtcgtgactgttggggttaccttgtgcttagctgtgggatgtttggccgatttatgtgtcgtagccgcatgcttggttgccgtgacagaggcgtcgcttgacgagttagacatgctggccttgtctgagttggtcttggtagttgaatcaccgccgcctcctatgccgatgaagatgaaggcgactactaaggcgattaacacattgcgtccctggtggttagtgttgcgatgaccgattttattgacaacccagagtacgcctaaaataatggcgatgagcagactgagcccgccaatgaatgatgcgaatgatgacatgaaaagttcctcctcgggaatttaagtattttgacaaaatgggtatgtaaacaagcttagtggccattttactaagataaaccagcgccattaaggttaccaatttgtataattaagcataccagaaattaagcagcaaaaggaagatgtcgagaaatagtgcagattaacaatatagaaggtgatagcatactcatgcattgatttttgagggtccttaaccgatacaagtaactacgatgtattggagttgctgtcgacagaatgactgatataataagtttcatgagtaaggttagcttgtagttttatctacgatacataggttttttggaataatttaatcatttaggagacgtttattaatgtttatcaatgtgatacagaaaggccgatcactttttcaagatttctcccaggtaagctccccagacgccgcgaagcgagaagcacttgccaacccattattttcttggcaggcgacttatgtgacctatcagcgaaaaagacggttgtcttaacgcatgatgaaagtacgttagtcgtggcgctagttgatattaatgcgaagaaccggcagacgatggagacacggttttgggaccagttgcggctgctctatcatgacttaggattatcaacggctgattttcaagcttaccaacgcgtatccaagctgtggcaaattaaccaaacggtgagtcgccagcaggtggggcggctgaatctcataacgccggccgtgaaagcctttttggcagagcggctgatggatgatcataagttatcacggaaattatctcacattatgcgaaagacggtcacgggggacaccgttttctgggaggatacaccggccatgttagcaacagatcagctggtttggcatcccgcggagattcctgccttgacggatcagtcggctctccaacagacttgggtaacacttcagaagactgctaaagtcgcgacggctgccttagaaagtgaagacaaccgtcaatttgaaaaggtagcccaccagattcaacgggtcaatcgcgagttaattgcggcgtttatccaatttgctcaaaccaaatatgcagccaagactgtcaaatcatatcagcaagcactggacttttacctaaatgagtatctggccaatcgactcgtgacagtattagatgatgatgcagccgaagtaggtgacttatacctgcacggcggcagtctgacggagtgtaaacgggttcagcgaacaatgaaaaaattctatcagtttctggttcaacagcagttaatgaccaaatcggcctatcaaacgattaggagtaacctggatgagagtgttgaactcgtcttatttgaattagatgaatacgatgatttttacgattaataaaaaatgaaatttatcattgatttttaattaattatcagctatactacttatcaatatttataaaacgttgaagaaaaaagtagcgtggatagcgatgtctagtgagtcacgttgagtgagaagtgaccatctcgtcctagtgaaaatcatttctgagttcggtgctgattttgtaggttaccgtggcagccaccattactaggctagcggatgttggtccgtgatgagtgtggcatttttggaggccacaaaaaggtggtaccgttctactgaattagagcccttttcccgttgatgggagaagggctcttttaacgtttagtaatcatgatgaggaggaatcgagatggaacaagcagaacatacgcaacataacttttggcaattattagtggtgagttcattaattttcggcatgttctttggctcgggcaacttgattttcccggtacatctgggacaaatggccggacaacactggttttcagcagcattaggctttgcggtatctgggtcgctgtttccactgctcgcaattctcgccgtggttgtcactaagagcgatggtctgtatgatttagccaaaccggtggggcgccactatgcggcgttctttttggttatggttcacctgacaattggtcccttctttggtacgccacgaactgcagcaacagcttttcaaatggcggcggaaccatttttaccgcaacggtggacaacagttggtcagtggctctttaccgctggatttttcggattggcgtatttgattgccatccaccaaaatagtttaatcaagtggattggtaagtatctcaatgccctcttcttggcgctcctagcggtgatcttcgtggtggccttttgtaagccgatggggagcttgaaccatacaccaagtgtggcttaccagagtggtgcaactatcagtggcctgttggaaggttataatacgattgatgctgtggcgctgttggcattaagtgtgacctttgttcacgcagttcgggcgttaggttatcacgatcgcgaattgactaaattgactgctaaggcggggacactggctatcgtggttgaggtcttagtttattttggactagtcttgttgggggcctttagcctgggggaattagccctatcggctaacggtggggtggcgttgtcgcaaatcgtgggtcactactttagcaatctaggaaccgcctttttggggatcttagtgacgttaggagttttcaccacggcgttgggcctagtgacgtcatttgcccaagactttcacaaattatttcccaaggttagctatttaacgtggctacgaacgaccactatcgcttcatttctggtcgccaatgtcgggttggataacatcattgcttggtcattgccagtgttaatgttgctgtatccgctatcgctggccttgattctggtttcactaacggttgccaaatgggcacatgctggtttaatctacaagttaacaatcgttttcacggcggtgccagcagttttagatatgttagcaaactcaccagctgtcgttactaattgggcaccaattgctaatctattacgcgtctatcacacttatgtgccgttcgcgagcctggggttgggatggctggtgccaaccttagccggctttaccctagggattgtttgggggcactggcgattagttgcggaacggatgacggaagacgtttaagggccatggatgatctggcggggatcacacggattcggcaccgggttaaaattagcgtttgtacctatcaggccgtatacgcaatccggtataggcggcaaagagtccgagacaaaagtttcggactctttgtgtctcgccacctgatacaaaagcatgccaaaggaacggggaactttgtctaactttaggactataccgattttaatttcaagacgataatgatttgtgaaaaaataccagaaaactatttacaacccgttttcataggtctatcttaataactatattaagagaaaagggagtatacctatgaaagaatctgggggattagagcgtcggattgggacgtttcaggccatcacgattaacatgtcacagatgatgggggccggcccatttatcacgattccacttgttttaacaacaatgggtgggccacaggccatgtttggctggattgcgggtgccgtactagccttgttggacggtcaaatttggagtgaacttggaagttcattgccgggtgaagggggcacttataattacctcaaggccgctttccatgatcgaacgggcaatctgatgccgtttttgtttatctggtcagttctgctagctacaccactaacgctttccagtggcgccattggcttagccaattacatgacctatttctttccagcgttaacgggtctacaaacgaagctaattgccgtggccgttacgttattagcgatggtgctgctttatcggcgcgtcacgagtgttgctaaaatttcgttggtactatggttggggatgattttaacagttatcctgattgtgattaccggcttgctacattttgacccccaattagcatttgactttcctcagggggcatttgcaccaaataaatttttactaggattgggtgctggaatgttactgtcgatctatgactatctcgggtactatacgtcagcgtacatgggtgatgagttgcgtgagcctggaaagacattgccccgttcgattacgctatcaattatcttggtcgcactcattgatctttccatgaatattggcattatcggttacgttccgtggcgagaagccgcgcatagcgctaacgtgggttccttattcatgacccgtgcatgggggccttggggtggtgccattatcaccatcttaattatttggacgtgttttgcctcagtatacacggggctcttgggcgcttcacggattccttataacgccgccaaggatggcgtgtttttcaaaaaatttgcgcatcttcatcctaagatgaagtttcccaattactcactcgttgtgattggattgattatggttatttgctgtttctttgacttgacgacagtcattaacgcgttaatggccgttcaaattgtggtgcaatttatgatgcagattattgccctatcagtcttgcgccggaaacacccccatttaaaccgcccatataaggagtggctctatccgattcccagcatcattgccttcttgggttggggctttgtcttcttctcctcaggggtcagtgctattagtcttgccgttatctggacgatcataggtattctcgtcttttggggccgaacttggtatgttaaccatgtcaaaccagcaatgacgacaggaggacaagacgttgacaactaaaggtgtcttagcaatcgatattggtggaactaaaattgctttggccgccattgacttggccggccattggttagctcaaacaaaatttgtaattgctggcttagatggtggcgctatcgttacgcagctattggccgcgagccagcaactggtgtcgcaggcgcaattaacggttacggggattggtgttagtacaatcggcgtagttgatggtgagcatttaaagctagtaccgacaattaaggggtgggatcacgttaacctcaaggcggcattgcaacgtcaatttacccaaattccagtttggattgaaaatgacgtaaaggcagctacctatgccgaggtcctaaatggtgctttaaaggggacgacggctggcctttatttaaacctgggaaccggaattgccaccggcctatctttgggggatcgggttattcggggaagccacggtgctgctggcgaagtggggtatttattaacgagcaccagcgatgctgggtttgctaccggccacgcgccgtttgaagaagccactggtgggcaagccatcggtcggcaactgaccgcgctggttgggtctccgtattcggccaaggatatgtggtctaacagcgagttgcctcaggtcgtgcaacggtttaaaacccaactgttagcctcatgggcctttaatttggctaacctttgcattacttgggacccggccgtcgtggccatcggtggtggcatggaagcggcctatgaccaaattgccccaaccctaacagccaagttagcgcagagtgttccatttccaccagttttaaagcgcgcttattaccagcaaaatgcgtccctaaacggtattgctttattagctttgcggtcggttacatcataagataacaaaaaggtgaaatttatcattgatttttaatcatccatcgactatactactcatcaatacttataaaacgttgaagaaagtagtagcaaagcggttgatgtttagcgagtcacggtcgatgcaaggtgaccatcagcggtttgtgaaggttaattctgagttcggtagttgctaaggctatcgtggtggccaccattacctggctagcggatgttggtccgtgaagtgcggtgatgatgtcgtcgcaaaaaggtggtaccgttctactcgtagagcccttttcccatagtgggagaagggctctttttgacgtttgtgagttaaaaatgatgcagtaggaggacttaaagatgacagatgaacaagtaacaccgagaaaaagttggggacagttgttggtcgttagttctttgatatttggcatgttcttcggctctggtaatttgatttttccggttcatttagggcaactagctggtgcgcattggtggttagcggcaatcggctttgctatttcgggctcgctttttccgctgctagcgattatggccgttgttgtgacacgtagtgatggcttgttagacctagcgcggccactgggacgaccagtagcggcaatctttttgattttggttcacctgacgattggcccattctttgccacacccagaacagcggcaacggcataccaaatggcgctcagtccgtttatgccacagcggtggactacggtggggatgttaggattcaccggcgcgttctttatagtgacttatttagccgctacgcatcaaggggcgctgttaaaaattgtgggaaagtacctcaatgtggggttcttggcgctcttggcactggtctttctggttgcctttttacggccaatggggagtgccacgcatacgccgaccttaacctatcagacgcatgcgatgattggtggggtattagagggttataatacgttggacgcggtggcgcttctggcgttgagtgtgacgttgattcatgcgattcgggggttaggctatcgtggtcaagcactgaccaagctgacagcgcaggcggggatcattagtatctcgctagaagtgctcatttattttggcctcgtgctattaggggccctgagtatgagtcaactgacattgtcggctaatggcggtgttgccttgtcccagattgtgggctactactttaacaacgttggtacgctattactgggcgtcctcgtcacactgggcgtgctaacaacggcaattggattggtctcttcctttgcacaggactttcacaagctatttcctaaagtcagttaccgcttttggttacgagtaaccacgggtttgtcgtttttggttgcaaacgcggggttaaatgccatcattacgtggtcgttacccgttttaatgttgatgtatccgttagccttagccctcatctttctctctctgacggttgcccatcagagacatgcagctgtcatttacagaacgaccatggcttttacgattttaccagccctgttagatatgttgaacagtgcaccagcagtcattaatgagtgggggcctattcagacggttttggcaggttaccatcaccttctgccgtttgctagtttgggactcggctggctggtacctgcgctggtcggcttcttagggagctggggctggtgtaccttgcggatgcgtcgtcatgtggttgtaccaacaaacgaagagcgctaaaaataaagaccagtaagcagttttcacgtgtcgcatatagtaaatgtgctatcctaaaattatcaaagaataagtttaggggagttgcaccatgaacgataatttatttaatattccaatcgtggcttactgggtgtgggccataccagtcttttttggcttaggttttacgattagttaccggattgaaaaacgtcgattaagcaacggcttgtggttttcgttatttttctattcgtttttagcagcgctggcgatgaccattttggggaccaataataagtggttgattgtgatcagtgtggcgctatttgtcatcttctttctaatcgtgatggtgattttcgcgctacaagcctttctgctattatggaatgcgtggatcgtctggcggcgcgagagtcatacgttagccaacatgttgactttattcttgggcctagccattttactagcaccgttcttttctcgatgggctgcactgaatttgtcaaaacccgtggatacatttattaatttatttccatcgttggtgattacgtatgtcctgttttggttctataattatttgacgatgctggtcttgtatcaatttaatcgaccacgttacaatcaagattttctaattgttttaggcgcaggattactaaatggcaatgaagtatctcctttattggggcgacggatcgaccgcgcgctgacgttttatcgcaagcaacttgccaagactgggcgggcaccgatggtgatcttttctggtggtcaaggtggcgacgaaaccgtcccagaaggccgggccatgcgagattatgccattgcccatggcttgccagccgatcaggctttggtcgaggaccaatcgaagacgacttatgagaatatggtcttctctaagcaactgattgcagccactgggcagcagcgaccgcgcgtgacctttgtcaccaacggctatcacacctttcgggcggggatgattgctcgtaaggcgggattaaaggctaacggcattggagcgcacaccgctaaatttttcctacctaacgccatcttgcgcgaatatattgccatctttgttggtagtaaacggtggcatgccgtagcaatcgtgggtatcttcttattgagtctattgctcacgtgggcgcaatattattaccgttaaaccgataaatgaaaatggtccttcagcgaattgactgctgaaggaccattttgcttatgacgcccaaaactatttgaccaagtaaacatggtcttgaaccaaatcaatctgagtaaaatgatggttgagggcccgagaatctgcattttcaatgaattcggcatggtcccagaactcagtggaaccggtggcaccatggggctcgccaatgacaacaaaatcgacagtggtatgggcggcacgcatggcctgcaggagctcccaatccagcggcaggccatctggcgaccaagacatgacaaccacgcccacttggtcttggtatttatggaaagcatccaccgcgctgaggggttcaattggggtgagtgggtgtcgaccagtttcgttttcggccgtccacgcctgactgtcggttgcaaagacagtcttgtgggcgtctcgcaggccttttgaaatataaccattgcccgccatgacttctaagaccgcccgatcgcccacaaaagtggctaagtcggtcacaaacggagctggggtgtatgcccacatgccgtagtgggtttccaaataatcgcggaatgaacgcaggtcgtggtccagctggggcaacgccgcggttaagtcattccacagctgatcgccggttgcgtcgccgggggcatacagcgtattgatttttcggtaaatctgatcttgactgtcatcaggtagttgtaaaagcggcaattgttggggcagattcccagctgccaacattttatccgccaagagaacgttactgattagtaacttgatggcggggtagtcattaaattggtgataatatgccgtcatccggtcaatataagtggtgggtcgttgactaagcggtgcgtggcggactttctttttgagtttttgcagttttttcgggttcacggagaggtcctttctagccacatgaagacaagcaaacagtcgactggctagcagttacgctgatcagtcgactgttaattaatggtcgtctagatgcagatccaattcttcttgttgattaggttcggggtcactgaagcgattttccttgccatgcaagtaaccgtcaattaattggtaaatttcgtagcgatcttgaccactcagtaactcacggttaaagctgagctgcttacccgacaagaagagccggccaaggtcgtattcatcgcgttccgcttttcccgtcagataatccatggtgacatcgaagtattcggcgagtttgcgaacttcaataaaggagggggttcgaatgccccgttcccaattgccaatttgagaagcagtattggcatgttcatctggtccggccgcttgcgcattaagcgccgctgctagctgttccaacgtaatgtgttggccccgtcgtaaggcccgaagtcgttctggaaacattctcgtcacctgtttctttcgtttacacctagtataccactctgcgtggggttaaacgaccagcagactatttgacgaatgaatcagttaaccgcataaattcggcaacatcgcgcttaatgagtttaacaccagccagccagaagtccggttgcgtgaggtccaccccgagatgcttttgcgcgagcgcttcagtcgacatgttagccgtatcgcgtaacagggcgatatattgatcttcaaagttaccagtctgttgggctttagcgtaaattcccagactaaagaggtaaccgaagacatacgggaagttatagaaggcgggttcgtcgatatagaaatgcagcttgctagcccaaaggtgtggcgagtagctggataggttgtgaccaaaggcttccttttgcgcgttcagcatgagttcattaagttctgcgggggtaacgagtttcttttggcgtagttgatagaaccgggtttcaaataagaaccgggcccgaatattcaaaaacatggctagggggttgtccaatttggcatttaatagcgtgattttttcggcgtctgtttgagcagcctgcacattggcatcggcgacaatcaattcaccaaaagttgaggcggtttcggccacgttcatggcgtagtcttgacgcagattaggtaagtcggccatcacgctagagtgaaaggcatgccccaactcatgcgctaaggttgagacgtcgttgggtgatcccgtaaaggtcatgaaaattcgtgattcgtgggtttccggcgcactttccatccagccaccaggggctttgccagcgcgatcttcggcttcaatccaccgatgttcaaaagcgtgttgggctaacgcagccattttaggtgagaattcaccgtaatgttgaatgataaaggctgcggcttcatcaaaggtgaagtggtgctcgtcactacctggtaggtgtaaaggggcttccacatcctgccaaccagcatgctttttaccaagcagggccgccttacggtcaaggtaatccaataaaaattggtggttatcagcgacaacttgccagatggtatccaatgtagcagcgctgagccgattttcttttagtggttctttgagaaaatcagtggttccgtgcgcggcgtattcggtgaggcggaagcccgccaaatggttcaacgtatcagcaaagagctgttccttgtcggcccaagcctgttcccaggcggggagtagttccgctcgatattgaggatcagcattacccaaaaggttattgtcagcttgaccggcggatagcgtcacggggtgcccattttcatcgtgaaagggaatctgcatggtggcgactaatgagtcgtagtgactactccaggcagccttaccgtctaagtttaagcggttgatcagggcctcagttttgtcgtccagtaattccttgccggcatcgcgcatttcccggagattaaaggcaattggttgtagagccggaagggctaagagtgcggcaaagtagttgtcggggacttgaaccagaacttttttgagcttgccgctgacgttatcggcttgggtttccaagtcacgtaattgagcttccattggggcaacaccgggattgttcacatcggcagaacccacggcagtaatgaagatgccagcctgaccaaggcccgcatcaatggcttgcagttggtcaatgagtttgacgaactggggatattgtggcgcgtcactggctgcattccagcgatcaagtaaatcagcaagggtggcaatcgctgttttgagctgggctagcttggcagctaactggggcgagttgatacccccagcaaaaagtgagtctaaatcccaatttaacgagtatttcatcggcaaggcctcctaggcgtaagttggattcattatagcaaatttcctaacgattgcgttggcgaaaggaactccgtatactaaccagtagcaaagagttgagagaattgaggaggacataacggtgaataaacgactgaaacattggctaattggcctaggaatcgtggtggttttgattttaggtggccttttaggggggagtttgtatttttacaatatgacggtggcaagtggcaaaaagagttttgtggcctccggaacagccttgaagaaatcagacccgctgtatgcacaaaaaaagtggtatcaacaggtacataaacaacgttggacggagaaggccgccggtgcaaatctaaaattagtcgctgattatgttcccgcggcacataacaccaagaaaacggtggtgttggttcatggatttgggtccagtaaagaggccatgggtggctatgtcgcgatgtttcatcggctagggtacaatacgctcacgcctgatacccgaggacaggggcaaagccaagggaaggttattagttacggttattacgaaagtcgcgattatttaaaatgggtcaaacaggttattgctaagcaagggccccaatcacaggtggtcttgttcggcgtttccatgggtggtgcgacaacgatgatgacgagtggcttgaaaacgcccagtcaattaaaagcctacgtggaggattgcgggtatacagacgcacaagccgaaatcacgtatcaggctaagcaaatgtatcacttaccttattggccaatggtgccattgacgagtgccgttgccaaagctaaggcgggcttttattttaaagacgctaatgctgttgcagcagtcaagaaaaaccacaaacccatgttatttattcatggtggggcagattcctttgtaccaacgaagatggtttaccaagttcatcgggcagatgctgggcctaagcaactgctcgtggttccgggcgcccagcatgcagcctcactatcgcatgcaccgcaacgttatacacagacggtgaaggcttttttagcgaagtatattaagtgatgcttcttagcggtttgtcatgatttgctgccctttagtcgcagcaaatgggctggaacgtaccggacacaactttaagccaagcagatcacttgtcttaaagctcggtcttatcctaagcgcgcgaaagacgcgcacaaaggataacgacggtactgagcccatttgccacttcccgtcgggctatggtggtgtagcgtggtcacgttggttggtccaactatgaccattactgtagagatattggacagtgttagcttgaaaccacattgactgttgccaagggcctgacaaggggagtacccagaagtaggcgtttaagtgttggcataggatagaagttattaggaattttggaaggttaacaaaggggatggctaacatggcagaaactacgcgacagtttcgccccgttacagcgacgattctgaccttaggcgcaaccctagtaatggggatgattgatgcggatacgtttcttaatcatggcgcggttttcgtcagcgcccaaacgggtaacctggttgtgtttgcggttaagctaattgaacatggctggggcgccgcgtgggtcaacgtgcccgtttggatcggttattttctggggtgttttggcgcgcagggcttgagtgaacacttagggcgcggcaataatcggcgtcaaatgcgatggttgatggtattagacgttggtgcgtacgtgattttagcgagcctgcaacagacactgccgaccatgtggttaatcttttttctagggattgtagctggctatgagctgactgtctttcggcaggtcggtggcctaggaatcaacaatggcattatgacgggcaataccaaaaatctggcaaccagtacctatcgggcgtggattgtcggggatcaatctgcccgtcagcgtcaaatccgtttggctggcgttctcttgatttttattgtcggatgtggcattggcgcgcgtttagcgatgttgacgccccatggcgtgctctggattgcgacggctgttaaggcgattttactggcttggttgttcctgcccgtagcgatggaaaagcctgtaagatagttggttgggttgtggctagaaatagcgtataattaacaagataagtggccctctaaattggggagcacaaatgaaaataacttaatgacagactgaaatttaaggagcacattcaaattgttaatcacaggacttattattggctgcctgctgattggcttggtaattgggtacgtggtgcggcaacatcagcatcgtcaagaactgttagcggtacaaaaacaagcccgcgacatcattgcttcggcaacggctgagactcagcaaaagattgcgaagctgacggccgacagtcggcgtgagacgcttacttaccaacaatcagtgaaggatgaattagccgagcaaacaagtgatatcgcagttcgcgaacagcggcgtcaacaacgtgaacagttattgggccaaatgggcgtccggttagctgaccaaacagcgatgctggatgaacgaagccaggctaatcgcgatcaacgccaaaagattcgcgacctcaaggcccaggcactccagttgcggactgacagagatgagacgttggctcaacaggcaggaattgatgaacaagcggctaaagaccatgtgttggccgatacggagttggacttgaagcgtgatcgtgatgttgagattaaagcgttgaatgataacgccgtcgcaaacgcggagaggtgggccaaggatgtggtattatcggccactgaaagtggcccgcaagacctccctaaagaacatttggagcatacggtgacggtgcctaacggtgaaattcgtagtaagattattggccgtgatgggcaacacattcgcttgttagaaacgctcacggggaccgatctaatctttgtgccagatgataatacaacgttgtttatcagtacccatgatcctattcggcgagaagtggcccgcgtggcgttgaccaatttagtggctagtcgccggatttcatcgaaccagattgaaacccaagtggaaaatgcccaacgtgatgtgaaccacagtttgtgggaaacgggtgagcagaccgtcagcggactgcacgttggttggatgcaccctgatttgatgaagctaattggacgcctcaaataccggactagttatggtcaaaatgtgttgttgcactcaatcgaagtggcccaattaacgggagcgatggcagcacggttagggtataatacgcgtttggcgcgccgagctggcttactccatgaccttggaaaagcgatcgatcacgaagtcaagggcacgcacgtggagattggaacggagtttgcccagaaatatggggaagatgacgttgtgattaacgcaatcgctgcgcaccatggcgacgtcgagaagacctcgccactggccgaactagtggcggcagcggatgcgatttctggtgcacgacctggtgcacggagtgagtctgtcgaagactacattaatcgattgcgtgcgttggagaaaattgccaacgatcagtctggtgtggctgaaagttacgctattcaggccggtcgggaactgcggattattgttaaaccccaggagttggatgataccgccgcggccaatttgacgcaggaagtggcccaacagattgaatcgacgctgacttatccaggtaagatcaaagttaccacgattcgtaagtcaacggcggtcgagtacgtgggcgatgaaaagaaaaagaagagcaagaagaaaaagaagaaagctgccaatgcgtagcgtattttagggttatggcgaaggtcatagcccttttttatgcgaaatggtgttcgctaagcaacatcagcggtatcataaaatgaggaaaggggcggtcaccatgaagcaagggtcattatttgaaaatagtcagcgtaatacgccattagctagtcgggtccgtccgcaaacgttggaccagttcgtgggtcaggcacatttgttgggaccaggtaagattttacgagaactgattgaaaatgatcaggtgtcttccatgatcttttggggaccgccgggtgtgggaaaaacaacgctggctgaaattatcgcccggcaaacgcaagccacctttctgagctttagtgcggtcgatagtagtatcagtaaaatcaaaaaaattatgcatcaggcggaagccgatcgggaaattggcgagcagacgattgttttcgtggatgaaattcatcgtttcaataaagcgcagcaggatgcttttttaccttacgttgaacgggggagcattatcttaattggtgctaccacggagaatccgtcatttgaagtcaactcagcgttgctgtcacggtgtaaggtattcgtgttaaaggcgttggcaacggcggatattgaccagttgttgcgtaacgctttgactaatccagctggattttctggccgggtgaccattggtgacgctgagttgcgggcgattgctgaatttgccaacggggatgcgcgtatggcgctgaatacgttagagatggccgtgttgaatggtgataagcaaggcgaccaagtcacggttactcaggctgatttgaaacagctgattacccaaaagtttgtgctatatgacaagacgggtgaggagcactacaatattatctcggcgttacacaagtcgatgcgcaattccgatccggatgcggcaatttattggttgacgcggatgcttagtggcggagaagacccgctgtatgtggcgcgacgactggtgcgctttgccagtgaggatattgggttggccgacacgaacgcgttaaatgtggccatcaatgtttttcaagcctgtcaatttttgggaatgccagaatgtaatgtgcacctggtcgaggcagtgacgtatttgtcgctggcacccaaatccaatgcgatttataaagcgagtcaggcggcgcaaaaggatgtccagcagacccgtgatgaaccagttccgctgcaattgcgcaatgcgccaacgaagctgatgaaagacctaggctatggggcagattatcaatatgcccatgagtcggccgctaaattgacgacgatgcagacgttgccagaagctttgcgtggtcacgtgtattacgagccaaccgagcaagggcgtgagggccggttcaaagcccggttggccgagattaaacggtggcaacagcaacaccgtgattaactaaaggagggttccaccatgcaaaccgttaaattgaacaatgaggtcaccatgccccagctaggactgggcgtgtttcaagtctgggacccagccgaaacgcaacaaactgtggaaacagccttagaattggggtatcgtttgattgataccgcggcggcctaccataacgaaacggcagttggcgccgcgctggctgcaagcaaggtgccccgtgaagagttatttgtgacctcaaaattatgggttcaagatatgacctatgcgggcgcccaacgcggcgtgcgcgactcattggctaagttggggttagattacttagatctttacctgattcatcaaccaattggcgatgtttatggggcgtggcgcgccttagaggaactgtatgaagtcggtaaaattcgggcgattggtgtctcaaacttctcgccggcattattggcggcgttcacccattttaaccgtattaagccagcggttaaccagattcccatcaacgtcttccaaccccaaacggcaccggtggattatctacaggctaatggcattcagccagaagcttggggaccgtttgccgagggacggcatgacttgtttaccaatgaggttttgactaagattggtcagcgatatcataaaacacctgctcaagtggccattcgctggttaattcagcggggcgtggtggttattcccaagtcaacccatgagcaacgactgcaagagaatttagaagtgtttgatttcgaattgctaccagctgatatggtcgcaattactgagttagagatgccacagaaccatgtgcggaccgcggctgacgttgagcgaattctccagatcacggtgcatgaagattagatttaaagaaagctgtctggtgtgagctgggcagtttttttaatcacttaaccaaatcatttcctaaaactgattcacttatttagaaaaatgccgtaaaacggttgaattttaaggaagagtaagcgatactgaagttggttggttcactgaaccatggtgcaaatagtgttaccgtttgcaaaatgacgttggccgggatagttagtaattttagttagttggttttttagaactactaacattgaaatgaccgactagtaaatcagaattaatgaggaggggattttatggtccgtcgcagtatgaatcgtaaccaattgcacgatcagaatttaaaatttgtgcttcaacaaatttttaataatcatcccacctcgcggatcgagatttcccatcagttaaatcttaataagtccacggtgtcatcactatataataccttgatggccgatggatacttaacggagcttggcttaggagaggcctcgaacgcgggtggtcgtaagccaacactaatcgaaattaatcgaaattatgggttcacgttaacgtttgatttggggtatcgccacctacatgccttagtgacctatctgaatggtcaggtatggaagtatgatcgcattgagactaaggggcaatccattcatgaaatgattgatcaaatcaatcactacattgcggccgtccaagccgaagatacgaccagccatggcttactggggatctgcttttccattcatggaatcgtcatggacaatcagatcaagacgtcgccctttattgatatggatggcattgacttggaacaggtcttttctaccatgtatcaagtgcccgtggtactcgaaaatgaggccaatttatccgccgtttatgagcgagacttcaatggtgcccgtgatttgaatagtacggttaccgtcagcattcaccgcgggattggtgccggcatcatccttcagcgcgaattgtttcggggtgagcacggcgatgcgggtgaaatcgggcagacggtcgtcagcattgaaatggacgatgcgggtgccggccatccggtccacgcggaagatatcagttctgaggatgcgatcattcagcagttagaacagaaaaaaggaattacgaatctggatcgtacacaactagtggccctttatcaaaaacaggacgctgatacgctggccgttttgactaaatttactacggcaattgggggcttgatttataacctcatgcgtagcttggaccccgacgcgttctttattaactcaccattggtcgaagaaattccaacactcttgatgcaaattcgaacggtatatcaaaacttagcgcataatgcattgaccattgatttaacacaaaatgcccgattagcgacggttttgggtggctgttcactcattacccatcgcgcgctagggttggatcattatgaattgaattttgaacgaccggctactgaaacgacggcttagataccaagacccgacttatcctcgcgatgagttgggcctttttcggttatttcccgggttaatcggtaatatttttgcaaaaggcttgttgatgacgcgacgttacctgatataaccaagctaaggaggtgagattcatgtcaacttatacgaccggagaactggccaaacacgtgggcgtttctgtccgcacaattcagtactatgatcagcgggggttactcacaccaatgacgaccgccggtggccgccgtgagtatacggcccaagatattgaacggctacagctcattttagtgttaaaaagtatgggcctgaaattagcggcgatcaaggatattctaaatagtcccaatgcgactgatgttttacaattgttgctgacagagcaggtacagcgtttgcgtcaagaccaggccgcgacaacgacccaactcaagacggttatcgcagtccaaaaagcgctagctgtgtcgggaccctttccgctcgaatccattcatgacatggatcagctcatgacaaatcaacagcggttacgtcaagttcatggaaaactaattattggtggactagtcatggatgccattgaggtagcagggctcgtatatgtatggctgaccggtaactggtgggtatttggtggtgtgatgctgttcgcttgtggggtagctgggtggttaacctatcattactttcaagcggtacgttaccgctgtcccaactgccataccgtttttcaaccacgatttaagcaggctttctgggccgggcatcatctacagacgcgcaaattaacgtgtccggcatgtggaaagacaacgtactgtgtggaagttgccgcttcgcgagaacaggcgtaaaaaataatcagccattcttctgatgagaaatggctgattattttatttatatttgacttccaaacgactcatccagtaacccagggcaatgcccagcagaccagcaacggcgcttagccccagggttaacggcgttacgccagcataggagatgctttcagcagcgtgtggattgggaaccagaatcagaatggtactggctaccacgatgcccaagatgaagtgatacactcgtgaatggaagcggtggatcagatagtccatggctttggaaaagagcgccattgccagcactgcgcctaaggcaatcggtaaatagacgcccagtaggttaagctgtttaaagccagttagcatgggagtaaagagacctaagattaggagtaagttagaggggcttaacccaggaactaagacccccagggcaattaaggcgcccgccacgatgaagccgccaaagttggcgggtaacgtaccaaaaagatcactcatgaagtataagagccctccactgagcaataaggtaccgaaaaaccaagcccagtcgaccccatctcggggagtgtgggcattagcggtgtgcatcagggcgggcaacgtacccacaatggctcccgcgaagccccacagtacaatgacttgccaatgggctaacagatattccagcggtgccgataatagcgcgacgcccgcgatgccgcccagaccaactggcacaaagtaccagaagtcacgacggaaattttgtcgaaaatgggccatgaaatttaataaacgttcgtataaccctaaaatagcggcgagcacgcccccggaaacaccggggagaatgaagcctagggcgatgataacgcctttacagaaacgcacgatggggtgatcttgccgattagtcacgaataggtcctcctcaagggctaagttagagtcagcttaccaaaaaaatttatgcgcgacaagcttactgcgcgtaaggctagaataatttaaacttttggggcttaagtatctttaagctaagtttgtctcaaaggcaccgtaataagcaaagacatctttacacgctcagcccaaaccatgatgtccggaacgcgatgagcacttcagtttatccaatgagagcgtacaggtatactttttataaacaatcaacgtgtagatatctacccctgttcagacctgaaaggttaacctcaggtgtttattaaggaggcgtgttatgatacgttcttttgagatcaaacaagatctgctgaccccagtacctgacggtgattatcgaacttatgacgttaactatgtctatggcaataacgctaagattatctcggatctgaaaaatcagtatgattttgatttggatgaagttttagcacgggatgatgaagttgtctgtgattatgtatttcaaagcagtggcaagaagttccttgcgattagcttcttattgccagagctcaataaaggcctgcatttagataatctagtcacgccaattgcgctcttaatttttaaagggaaactcattattgtgacggctcaccgaatcgcgtttattagccaacttctgacacagtttcagctacaagatagcagcaattttgtcgttgaagtgaccttaaagcttttgaaaacgagctttgaactcatgacaaatgatttacggcaactaaaagataagattgatgggctggaaacatcgatctctgaatcaggaccagtcaagcccgtgtttggtgagctattaacgctacagaagtatatgataacgttgtcctcgacctatgatgccaataagaagattgttgattttttggataagcacttcaatgatatcgagtcgtttaaccgggaaaacgaaaaaattatcatgaaactctacgataaaattgacaccatgaatcgtattctcaagctatatggtgcctatctggataactttgaaacgatgattaacaatatgtcgtcgttccaattaaattcgattatgaaggttttgacggaaatatcgattgttttaacgattccgacaatggtctatggcttgtgggggatcaacgtgccggtgccgtttgccaaaagtgatgcgggtattttggcggtagtgatcatttcatttattctaagtgtagtggtgtggttatggcttcggcggcgaaagtatctttaaaggcgccaccgattaaattaaagtcagcgtttgataagccaataaataaggttagtgtggttctgtggcgtgatgacatctgtcttgagggccttttttcacgatggcaatgaaccgacccccttaacctgtccgggcgcaagaagatggggctggcagaccttcttgacacgttctagcggcccacgtataatgcaacagtcaaatttatttaagcgactaacgactaaggagggatactattacagaactttgtacacagttaaaaggagctaggattaatcaggggttgtcacaaaatgaggttgcgactattctacacgtgacgcgacagtcaatttcaaaatgggaaaatggacggggatatccggatttagataatttggttcgactgagtgatatttatcagttgtcaattgacgagctcatccgtgagaattccgagttggcatctaaaattcatgctaataatgcagaaattaaagagaaacaggttcaattaaaaaaggtcaacacagagattcatcaaaataccgatgaaggtctgatattgaccttgttagtattagcgtcagctttaattccaccgattggtatggtgctgccactgtatgcgatttggcgaaataccaagtataatagtcttcataaaacgattattgtcatatcgattgtggttatgattgttagcttaatgggtacatatgtgattattgatgataattggattacaccatctaagacggtggtttatcaggttaagtgaacgtaacgtataacttacccttttgcatatgagcagataaagctgcttgatacttaacggtaccaattgaacgagatatagcgttaccttactggcaaaatctttggtcatgtatgtcttagtgatcgcaccaagacgggtactgaccttgatgtttgaaacatttttaattttattacctgaggtaacgatggtataactggcggaccaagataacgccgagctatgagccacatgtaaagttgcggcgtcagcctttactgatccaccgcatagaatgatgaagcaagtgaatacgatagttataagtttacgcatagatttaacctcctgatttgaggttaaatctatgcgttgaagtacataaggaacgccccgtttacaaggggaaacgattggattacgttgaaaaagtaaggattaaccagacccaaagttgatatccgaggcctcatactttggatttagatgaacccggcttacctaacttaaaaacattctctacttgttaaaaataggtggagggataataaagatgggttgcaaagttatctatagtgaggaaactaagtcgttacacctctatatgtaaacatcccgcttctcttaaaaaggcaaacttcttggtatatttatttctgctgacgtcggcacaaagaaatagtaataaataattgaggagttgttcttatcaaattttcaaaaaagcttttaggcttagctgccatggcttcagtgaatattctctacacaaatgttgctaatgcttcagatgcaactggtaattcggatgcagcaatgataacgatttctgactcaaatgatatttataaacaatttgagaaggaagcaaaatcattgtacaatcaggcgttattgcctcaggatctacaggaacaaatgcaagcccttattaaaaagtatgatggtgctgaagtttcatataatattaacgaaaatgacagtcctaacgttaataatcgcgttgagatcatgcgatcaattacaaagccatcctcggtacaagaaaaatttgttgacggcggagttaatgattatgcgaaatctaagttggcgcttggtaagttacgaacctattatggtacatgtgagaacttaattcttgcaggtgggactattgcaggtgcatttgccgggccaataggggcagctgcgggagcatttggcggaaaaatcttaggaaaacgttgttcccaagcacaaagtgacgtaaaaaagatgattaataaaaagcgatcaaaaggaggatgtcgtatgacgctgactgacgaatttccaattggatccgttaactcaaaaaaacaagttagtatctaattcaggtgggatactttaataaggaggatattatgattttactcataacgatcggatttatttacctagttacggttatctcaatccttttttataaacattttcataaagattttgaaatgtctaattatcagaaggctattttaaccgttttaactattttatttcttgtagtgatttattctgccataatggcaactgtaaattagactcttgataggatgggcaataatcttttcagcagtggtaaagaatttctttaatccagccgctttcttgactagccaaccagatacatcaccaatgccatcgccaataccactcatcagattaccgaaccagttgctactacctttggcataatgggtaatcccttgcatacccatgaatagtttggtctcagaggcgtttaaaacctctgtaccagctggtaataatgcttgcgtgtttctgccttggacaataccagattgcccgttaggaaggaatacagcctctttattatctgtctcaggagaatcgttgccatcattaagtaccgccatggtaggcttagtgattgccttacgagtaccagagaaagcaccagtaccagtggcaaagtgtacatgaccaatatcaccaatggctttctttttaccgccaaaggtatgaatgacaccatcaaccagattaataccagaattgatgatatctatcatatcgttcatgccagcctttgccagaccttttaagtccttccataatccggtaaagataccagtaacaccattcgctaggctggtccatccattggtaaagctctttttgaatgcccataaccaagtccccatggatatcccgaataccttggtatgtttcaaatccttgttccaatagctatgaagcttggaccgcatattatcccaatggctagtccatgagtttgaaaaactctttttgaaactattgaagtggcttcccatggacccgaagaaggactgggtattgtgtaccgatgtattccatgagtgtttcaggctggtacctacggctgaccaatgcttatcccagctctttttgaagctggacttaaacttgttccaattccgggagataccactgacaccattcttgacggacttaacaatgttaccagcccatttaccaatggatttaccaaggtgaacaacggacttaaccagcttgttaacccattctctgaacggcttgatgtgcttataagcttcataaaaggctgcacctagagcaccaattaccacgattgcaatcccaattggattggcatcaagtgcaatattgaataaccattgagcggctgtccatagcttggtaatccgaatgacatcactaatcaaggaaacaaatttgacgattttaccaactgcaaacgcaatggcaatagctttaccaacatctgctataccctttttgtgactggcaattgattgggtagccttagcaacgcctgagagtcccttggaggcatccttagaatgacccccgatagctttaatggcaccggctacaacgtcccagacacctttaccaaggcttgaaacgatggatattaatgagccagcaaaggttgatatagccttttgattgttgaccagaaacttgatgaatttcccgatatattgtccagttttagcaccagccttggtaaccaaagcggttaaactagtttttacagcatccaatttaccctttttcttagtaattgaatcaatggcttcttcaacaccagcggttagtggcttagcgaaagccaccttaagattggtgtatgttccttttaatgatgccaatttacctttgctagtttcagaaaactcgtcccaggctttaccagaagtcttggaagcttttaccatgtattcctgcaattgggtaccggtaattttaccagcggctaatgccttgttgaatgcactagtggacatgccagaagaggtaataatggctttctgcaattctggtaccttaccgaacgttctctggaatagactagaggtaaccttagcagagccacttagcttggcaaccccttggctcatctgggctatctcatcaccacttttaccagcggctgaaccataactagccaacacctcggttaatgctcgggctttagtggcggaattagttgtggcatagaacttcttttgcatggcatcaattgctccacccgccatgttagccttgccacgaatatccccaatttgagcggtcatcttagtagcagtaccgtttgataatccgaggttagtccactgcttcttgataactcccccagcttcagctaactcatacccttgttgggtaacaccctttaaccagccgaaagcttgggaagcaccgttagatatggcgctacctagggcgaatcccataccgatgtgcttaacggattctccagtttctttggattccttcttaacgccacccaatttacccttaatggtttccagtgaacgtccaaagaatcccatattttgggacttgaacgctttatctaattcttgctgttccttggtcgtcttagctaaggtggttgccgtcttattaagtcttatctcctgttgtttgtactcatcagaagcttcaccagactcttttttaatccttgctagttcatcggactgtactttgtattgcttaccaaggttttcaacggaattacttaatccaccaagtctagccttctgcgcttcagcttctttaccctctgcttgtaaccgctcaacgtatgagttggtcacctcattaacactcttgaaggacttttgaaggtcacctaagccagacttgtaatactccatggaactcttcgcccgtgattgctgggctgttaatgaagccagtttgttctcagtctgggctagttgagttgatagcttggaatattgctcggaaccttccttagtagaagtatccagtgattgttgtttttctcgtaacttggtcaccttatcctgaacaacgccaatggtttcaccgatacctttgtacctagcttcggcggcttttaagtagtccccagaactcttcagggatacctcattggccttccacgccgaggtactggccttaatagcattgcttagagttttcagactagaggccgctgagacagtatctagctttacttctgttgccattgtgttcgatacttttgccattattatttgcctcctcgtagtctattcaccattgccattgggtcttctgcccgcttatcctttggcttggcttggttaattttaatcagttcatagtaatcttcgttgtccaattgagatggaagtatcccagaattagtcatcatctgttgcttgaagtagttctggtcttcttgggcatcctctaggtcatgaattagaacgttgagacgacccattacttttttgggtcttcttctacctcattttccttcaaagtttgttgccattgctcttcggtcaatccttgaatccgtgccaatacatagctgataaattcagacaattcatcaagtgttacgttattcattaccgtatctgtatccttttcggacaactttaataccgcttgaaggaagtcaaccattgaagtaatagccttctgggactgctccataaccgttaatgggtcggattctgtgtccatcttaaccttgtccattttcagcatcataatctgtaatgctgtggcttcattgacaacttttacggtggtttttacttctgctgttttcttctttaagccaagtttgctgatattaattttcatttatttttccttcttatttttatttttgccaatgaatatggctatgtaaaaagccaccccatgaggagtgacttagaatggttgcttattgtttatccggctgtaccgtggtggtactatcttgggtgggattaaccgttgttggttggggtactactcgcggtatatccaccgaatacttcgctcatcattgccgccttgtcgaatccggtatcagcactggtccagattttgtatggttgaccatcgaatacatcagccttcaatgggtccaatccttggtacgtcaaggtagtattagcatcggtttcagcgttgttgtcggtaccgtgattcaatcctgcttcaatcaattgaccattggcaaagccttcatagatatccacaccaccatatgaccgggagtgtacaagcattgcaacgtgaggcttagggagttgacgggtccagccacccttaccatcggttataaatcccttgagcttttgtagggtatcgaagtcaatatccaagaattccaaggcgacttgtggttccattgcaccgtttgatacccgcttgggaccatcattggcatattgaactgtaccagcggcttccagcccggttacattagcttgggtagccccttctgcgtccccatccaccaagtagataccagtcgtagaaattccctttgtagcatctgcaataattgcacctgttgaatcaactaatccaaaggtgacgtctttaacaccatgtgtactcatttaattacttccttctaaatttagtgtgaagttgcacgtgacggtaaaagtagctgtcacctgattggtgtctgggtctaatgtgttgggttctcgtccagagatattccaaccattgctaatgaacaggttaatcagctgtaattgcgcgtccaatgtgcttccttcaaagttgtttccataaaaaatctgcacttgaagattagcttctaatgcagagggtgtatcattcttaaattgtcccaaaggttccgtcaccgaagtgattagaacgatggtcttgtctcccgttgtatcggcttcctctggtatctgggtaaagtacagttcatcaatccaagggtgcttactggaagcaatcaattttttggcggttactactggtagttccatctctaattgcctcctgttaacttcttgtactctttgaactgggctgtaagtatatcttctttggaatcctcgatagccttgtcgataaaatggtcgcccttaatataccgggtaccatcattaaggaatcgggctatccgggcatgattaattgggtctaccatgtatccaacagtagaagtccccgttttatccccatcaatatcagtattctgactcattaccgcatcggctaaatgcttgaccttaccaacctctcgatggtcgtcatagtgtttacttttggtggcctcatagtaccttttttcaaggatatctgcgccctgcttagtaatttcagccttttgagaaggtgttggtaccagtttagcaattgccttttggtattcttctaattgctcgttgaatcccatttacttaccagctttctgatttaatttcagcgtcagaatatcgtagccaatcacttggttactgtcatctacgctgttatcaattattttgtaaagctgattggaatactgaacgattaattgccgattaattgctggattatgccgaacgaccatttgaatggaatcctcataagctgtaccgttaatggacaaattctgagatagagttcgggtataaggcatggtccaaaggctgaacgatggctcaaaactcgttgtattagcaccggtattttcgttttgtacactttttagtgtcccgaataccaatttctggttaaagcgttccggtgaaaacttattcagtgccattattctcacccaaccttatatattccagatagtccagcatcattattaatcccttggaaaatccatcagttaatgaccggtcataatacaactgggttaccaacgttttaattgcccgattataaataggagacttctggtagctattatctttaccagttgaatctgttgcttggtcaacaattgtttgagcttcggttattaatgcctgaacagttgctatctcagccggagattggtcaacgtgtaactcatccattaattcggttgcatcgaccatcttaatacctcctcctcaatagccgccatcatattagattattgtgtatttattgggcgactagattgtttctatttgtcaggtaataccgttgttggtgctactgtagtttcaggagctactgtagttggtgctaccgtggtaggtgctactgtagttggtgctactgtagtttcaggagctacggttgttggcttacttggctggggtgctactcgctaagttaagagttaacaattggccggcgtcagagtcagcgacaactgtatcttctctaacaattaattgtagctgttgaccatatgtgtaatcatcggtccacttaacccgaaggtccttgaagtcagcaacggtaacaaaggaatgaacagaaccaacaaaggctacttggtcaccatctttatcacctaagcgggaatcttctacgatgtatacgggagcacccaagatggccttaccagttgctgaagagatatcatcttgcaacaagtaccgtccttgtgcatccttaatggtatccaatgcatcaaaaccagacttagtaacgactaccacacggttagaatacttgtaagtgtcattgtatgcctttttaaagtcatcgaagctggtaatagtggaagcagtagctgttttaagagccttggcaatatcattttccaaagtattatcatgaatctgagttgcataatcaccaattaatccagcaatattagcggcgctcgcagcatcatctaacatttcttggctaacaggaatggctccacggtacgtattcagcttgtaatccacgccagttaatgagagctgggctaatcgtggattttcagctaattcagcggcggttgctaaggaaacatcagtagcagacataacaggaagcgtaccagctggtgcggtaacttgaatgtggttagcaagaccagataatgagttactgttagctggcttttcaatggattgaagcacgtcatgtggaattgctacgccgttgttagcagtggtagtaccatcagtgatagtcatatcccgggttaccaagtacttttcaaatacggacttttctgggttacttttaatttttcgcatgttgtctctcttttcttctttaatagtttttgagtcttcttctacatcatcatcatctgagtcatcatcatcagaggagtcatcttctgcatcgtcatcagcagaagtatcatcagaggtttcatcatctggttcatcatcacgtgtatccgtagagtcaccagtagaaggattatcagctgagtcagtagaagagtcatcaggagtatcagattcttgctctttaataccctgtaaaacggcgttaactaactgattaagttggtcatcagataatgtataagtgtcatcatctggaccttgaatactgccttcttgaccttgtggacctttaattgaatccgttggttctgttgttgcatctgttgtgttatcttttgccatactttttctttcctcgtttctaaattgttctaagcttcgctcaatttttactgaagtttcctgataagcggggattggtgttaatgacagctcatacagctctccaatctggttaattgtgtggatttcattaccatccttgtccaatccccaactgtcatcagcaatggtaaagccaaaggataacccttgaatattgccgttctggatattggtaaaagtgtcattacctaagctggtattgggtaaagttgccgtgaaatttaatcccttggtattaacggatacttccagagtatcagcatcaacccgggctaaaatgttactaaaatcatggtcatagagtaattttacctgactaaaatcaacgtcattaaaagccagtggactaacatattcaatgaagggcatcggctcgcttggttggttaaaaacgacagcagtccctgagataacatggctaccatcatcgcttgtctgggtatctcttatttgtagcttaatagaacgaatatctttagctgtttccgttgctatcacctcctatgttggtattaactgggttattaactggcacatcttgaatattgaagctcgatggaagtaaattattttgctttaaaagttgctgagcctgtgccgatgtaatgaccggattagaactgttggttaacgtttgaaccatggtaatcaactgactaccatcaacatcgactgaattacgtacatcaacattaaagtttggcagattaagcttggattgaatctcggaaacaatcggcaagtaatacttggtcaaactttggaggtactggtgactaatatctgagacggaactttgggcgtccccttgtgagcttagaatgtaactggttggtatcccaaatgctgaagcaactcgttcagttgaccaatccagtgtacttaagaagtccgctacattcttgtcaatttgtatctggcttaaggtagctgactggtccatcactatcgtggaactatctccagataagttctgttcttcaaacttgcttctgatgttgtccttggtcgctgaatctaccttagcttctggaatggtaatcaaattgctcggcataattgcccgctttaactgactcaatgtaagcttctgagcctgtgccttggtctgcaactcattagcaaggctatccagtggactaataccaacgtactgacagccatcgaagccactctctgggttacttaatagtcggaagtgtaatacctcagaagcctcagcaattacttctccccggtcatcgtcaaagttaatatcgtactggataacatcggagttatctcccatctcaatcgttacttctgatactggaataatctctagccagtcatcatgaatcagtacataagaattgccggttactaataattgggtaacaacagtggtccagaattggtaagaattggtcatcggactggtcgtaaccgttaataaagtggtgtactgaccggcattaatcgggtgaagcatgaatgaagcgacatctgaagcaatcagattaacaacagagaatacatcactgttcttcaatgccgtagaagcatcaattaaggtgttgggtacaattgaattgccttggacaatgaacggttggtatccagagctgggaatatattggtttctcttagcaataccgttgaaaatatctgataatcccatcacttaacaccgcccttttgtaccgttgctaagggttctgccaataatacggccaatataatcagcagaatggcggttactagtaatccagcaaaaagactgtacatgaatccacatatcatcaggattaagaatccgattaatagcagaattgctggtaaaatctgtaaaaagttgttcattgggcgttaccccccttttttttttagaatgaaaactcattattaaagtagttgttaacgtcatccgtagacatgccatcgaacgggttactcttatcttccttctgaccatgattaggattgctgaagtagaatgccgctacactcatggcatcaatggtggcatccaaagcatcaattttcttgctcattgcttctttgtcaatttttattccgtacgcattggtcacggtaaccgcattagtacaggcggcctgtaatatctcatcatccaacatggtaatgttcccgctgataaactggttacggaggaatactgttggttgattaagggataaactaccttgtcttagcgttatgaatggtacctctggcatgttctggtccagccagtcagtcaatacagaagcttggtacgggtcataaatgaaggctttaaccgtcaaattatggtcgtgtacaaagtcgaggaaccatctaccaactgaatcctcgttgattaatccctgtgggttatcagcgatggttgcatacccttgcttagcggctgaactatactggataccatctgttttttccttggtaagcagattgttattacttctggcaagaggaacgaatgaatgctgaaaaacatgatacatcttccgtccttctttgatgtaagggaagacaaaactgaatgaggtgtcatcagatacatgagagaggtcaaagcctacatagcaatcacgattatccatgctgaatgaaggaatgattgcactttgtacatcgtcaacctctaagtaatggtccttggcagtctgaagccacatgttcaaatttctgttctggaaccaagcaattcttcctgctgtttcttgcttatctttttcagattgcagtcccagcattaatctctcgtgcattgaaggtaaatcaagcaatggattgctttttacccaagtatccggttgttcagtttcttcaaggctgtcctgttcccagcataaaaagaggctatcgtcagcctctcgtttgttatccttttgtactacttctgataatctttcataatctctgtgcatgggtactcgtgggtcttcatatgcactagaggtaacaattagttgcttgttaagctggtggacattaccagaggtcatccggctaataactccatcggagtacatggaatctccgtattcatccagaattgctagggtagcatgtaagctatcaaactttccactaccagctgttagtcgaagtatctgtgacttattagagaacgattgaatgaggtctgcacttgattgaatctgttggctatctatcagctttttaaatggtggtaaattctgtcccagataatcaagggtagaagataagtatctcatccctttttttgatattttgtcgttggtccctacgtagcaaaaatctaggtttttctttccctgattttcaatcaaataggcgtacgtcagcaaaatagctaccaaaaaacttttaccatttgttcgcccaacagatagatatacataagtgaatctcttctcttttgtactcttggagcgccatccgttaatcaggcagagtactgcttgttgccattctaataatggacgtggttcacctgtttcaacgtcagggcatagcttggaaaaattaatgattgacctgacagcgtccagattgtacagataagggaagttatcattaccagctcgtactaagtcattcaaatgacggaacatggcaaattttatcttctgacctgatatctgttgccccgatagaactcggaaggcatactcagtagctgggtcacgataatcttctttgataccatcgaagtaaccatcgttattcagtcgcttaaaagtatcttcgaccgttacacccttcttagtaaagtcaaactcctgtacactagaagtcatccttatcaccaccgagaaggtcagcaattgatacatcatcaccagaactatctggtaacttggcgagttccgctcgggatttagggcttagtcctaactgctttcctaagctatcgagtttagcagttgaagagtccagtgtcttaaccgccggattagccttgtaaccttcaaagtggtggtcgtcaattatctccccttttggcgtcatgacaatcttaaatagaggatattgtatgtcgttctcttgaatgttgtcatatgcttctctgagcaattgataattgaaacaataagactcaacaagcactctatcattttccaacaagtcatttccaatgagcttcatcaactttgtccacatagaacgcccagttgccttcaagtattttggcgggttcgtactcagtttgttcccatttgttgccattacttaacctgacctcctctcattaaaattatgtatcagttggtataccaacctttgtgactacccctgtacatttaccagttgccaaatattgccccgattatgctatcctcattggtattaattgcctgtataaaagggattgcaatgggtaccccccagtgaaaaagtttgagatgaccatccgtatccaggttgattgaatgttgcctgctcttttgatttcacaaatgggggcggggtacaaacgctgtaatatcaacgtttatactcgttttgtacaggatttttcacaaagaattacaagggaaataccctaaaatccttgtgaaattggtatcattgtttcaacctgtaatgtataatcctgaaaattatgtataaaaaagaggtaccagattggtggtatctctgaagaataacaggcaagtaaagaagaataaatggatggtatatggatggtatatggagggtatctttccctcttcactatatatatcgtaatgagcggccactttgaataacaattgtcaaccattaattgcaattctttatcctttcttaatcttttcacttagaactttcttccaccattcctttgagcaatgtttcaactggttatcagtcatcttcttttccatggctgacttaatagaatgaacgtgctgggacaatacccaaaggttgtcagggtttaacttctcttccttactatccaaaagtttcaacggaattatatgatccacgattagtcgttcaccattaaccgctggtaatccggtaacagaatctgaatagaagttggcaattaatacctgcttacgtatctcttgccattgctttgaatgatagaagccattagcgtcctcatctctcctgttcatattgtaatttcgatattcatctcgttttaccttctgactattatcaatggtccattggtgtaatgtcttgtgctttgaacaatacctctcaccttgtttaactaactcacggcaacctatctcattgcaatggctaaccttcatcgactacctccaaactaatgtggataatcttcccgcctagatatgaggtaatccattcaggtacctctttaatattctcgaacattgccgcctgagtaatggttgatgtggtgccaaaggaatagtgtgtattgacatcgtaccagctaaggtaaccgccatcattgaattgtaaaatgtagacagaacttggaatgttgttattagtcattattattacttcctttcagttgctcattaatggagtccagttgctggtacagatattgcaagaacaatcttgagtcacgaccagcaccagtaaagtcgttgactactcgggcttcaaacttcaactttccattactgaattctttggcatcctccaaccaattgtgtagttgagggtgataatcaaagaatgttgcaatcatatcatttaagtcttggtcagtaatcaaaggattatccacatcgtctaatagaacttggattaattgcttttcactttccatgttttttctttcctcggtatcaataattgaagagattaagtctgaatggtcatggcaatacttaactttgtgattaattctgcttcggaattgtgccgaagttaaattgaaagtagccatggtctcttctttacctgaggatagaactgattgcacgaactctcttgaccgattatcggggaatatctttttcattacatcgtcagatagctgagaataaccacgatcagcagaagggttggctaatgagtccatctggtaaccgtcatcaacatgttcagccttgtattggtattcattgttaagcttcctctgtacatcttttctgctgaaggtaacaatccagtcaaccttatctggctgaatatcccggtcatgtacccgttcatagaacctcgatagaataagactattggcttcctctgcgggaatgtgataagtaacacttagtacatgcgattgtgtctggaggttacgactattggttgccatggtaattaattcttcggtggtcattagttgttacctcccaagaatccgggcatatccgaatccttaatctgaatctcattgcttgacttagctggctgatcgaaagtatcaacagagttgacaaacaattggattttagtctgtggatattgttccccggaaactggtacctgatatgattgcattcgaccagatagtgccaatgaatatccctttttaattctgtcagcgttgaatccgaaggcaatgaacggaatataatcgtataccgccttacctgattctttgtttgtgtttctgtaactgctgataatacctaagaccatgttgcctttatctgattgcttggttgtcaattgcatgatttttcccgtcaaattagtcgtgttcattttaatttcttctttcttcttgttattttttatggtattgttattaatgggatagtagatacttttttagtccttaaagaaaacatataagtcatcaatctggttaccgttgtggagtatatgggataagtaaccttgttgcactcccagccaatcagcggtctctgagactgaactaaacagccattgcaccgtatggtcagagctaattacccgtactggtttacggataaggctcattctatgttcttgcaccagattttcatggtgggatagtcgtctcagattaatcaaccgattatctgttctgtcagaattgatgtgatcgatgtcggttaatgagtcatcataatcaggattaaaagaatccattaccagccgatgaactagaatggctttactctgaccatctatggagatattaacctgctggtaacccaatccgttgtcatgcggcttaatcgagtgagccttacataacctaactgataactttcccttacgcatgaaggtgatcgtatgttccttaattcttacctgtcccatattgctgacctcgtataactctgccgataatccattaattcttgcttctacccatttttcattttccattttattaccatccttttttctttttttatccttacatgtattaatataacggattgaccatcatacaaattgctttttactatccaatttaaccaacctgtaactaatcgttattatcttttctttcatacttaccttttaatgtttccaacgtcccacttctacggccgtattcataaccagcaccatatgcaattgcaaaaactaccaaaaacgctgctaagattgccatttatcaagattcctctctacttttcattctatgaaataattgtatcattaatcgggatattattggaaacactacctcttatccccttgtatacttaatttagcggagtgattaccagaattagccatttcttacaaatttttctgaaaacttttccccctcataccatagtataagaagagttatcattcacgattattcttcccaatcatattgctgggctattaccactcatcagctgttttaagcaccctaagagcaatatctgggtgtgctaaggttatcccttcataattatgtatggattggttgaaactaccctgagagcaatctgacagcttctatttaatgaagagataatagaatgggctattaatggattattgctggtacattaatgggctaggatagccgtgagagcaatatacagcaatatctgggcaggttgtggatcaacctttgcaattatgccaagctgggctaagagacggctgatgcaagttttaagggtaaattacagagcagtagaagcatttaggtttaatccatactttgaatattaagttcccattaatagaacgaaaatagaacgggtatgaacccactaatagaatgagtatgaacccactaatagaatgagtatgaacccattaatagaatagataatactcattgataacaggagaataatggtaaacctcaatagaatggataataatggttaaccaatcctcaataatctcttaacaatctatccagggtttttggatagatgtggggtttttaggggcgaacctagcccctgaatggcggcggtcttccgccaaacaattgatagaaaattggtaatagttattaggaccaagtgctttcgggccagaagaaaaccacttctgcctcgacccattagccatgggtggcaaggtgtttcacacctttattcaggagctttgagggagttttagtccattggttacctttctatttttgttctttccatttcttttggattattctttccacttctatgaaatttctatgaagggtttagcactactctgaaatgttgaatgtgactcccgacagggggagcagagcataaagagtctaatacatcgcatattaacttgaaaaaaactccttcaatccctttcatggcgggctttcaagccgtttttaaaaaaggtaatttccatattttgaaaaagtaaaaaactcccctttttaaccatttttagggggtaaaaagtgggacgctaggtaatcttcaaaccgctactctcccaacggattgaagcctattctgttttctaattcgcggttttccggattagctgaattttatctaaaaccatccttaataaaaacttaatatttgttttattagctgaaaacctctctctatctgatgaatgaatgcttttatatcggtattctctattgctatatcattatataataggatatacaataaccttttactggttctaataatttaaggccttgtgctacattaattatgaagaacgaaaaaaggggattaaaataatgaattttaagaataaatctgtcattgagaattggaagacagctactaatatgcctgttgtaatggagttatatgcacacgaggatacaaataagctcgaccttaaaagccgttttgataaatgtgacttagccaccattactggagaaccagaacgagtcaccatccagaagaacggcccatacaagggatatcagatgtatcaatcaactggtaaaggtcataagcgttattcagttctatcattaacccttctagtagtcggtaaggatttcaaagattttattgaaactttcttgggagatttctattacaccgatggttccttgaatgagttggctgacttaacctgttcattggctgatgttgctggtaagaattattctgctattagccggtatggatcaattaagaacaagccattaaagaagctcattggtcgtgaccgtgatatccagaaggtggctttacaaatttatgagaactccctagcattggattggtattgccagccgactaataatgctaatgacgcggttacccgattatcagcgaagacaattgctcagcagactagagtaccaatgacaaaggtatccaacatcattggattattaagattgttccatgcgcttaaagaggtaagtgtccgggatatgagtcggccctatttccaaaagtatattgatattcatgcaacgtacctacacacccctatttacaccatcttcgacttgaacgacccagatattaactgggacttagccaatcagctaggattagatgggtccagcagaatttccatgagtgctattcaatacttcttcggtgaggaatatcttcaggcaatctatcctgaccgtaggaatacaagtatccagctcagtattatgcaagagtttggaagaattatcagtaatggtaatatttcgagaaaagagttgctggaaaaagcctcagaaagttttgacgaaagttttagcgttattaagaatgcttggaatagctatcgtctgtttttacccttgattaattatcaggaagtaacagcaaaagaagctggtattaaggtagggacagctaagggacgagaaaaggtaataatcccagcttaatccgtcaaataagggctgttagagcagtatcagcccctgtgtcagatattaatgggtaatcataaaggatagtaaaaaaaggccccctagttattgctaggaggtctttaactgtgttgaaaattaataaaaaatcgagtaaatccagagtagtacccagccaatcgcacaaactgccccaataaatccccagttagcgaaaatactaatcaggaatatccagaacagacttttccgaagagttttaaggtcggagtatgagagttggaacttaccttccgcttttcttctatctgaccgactagcatgttcatcatggtgataccatctggaaattgccgctatcttgaataagtctctgaacattaattattactttctttcttttacttttaatgtagcacagctgagagattttttataataaataataaattacttattttttattatttattacttattattatcgttaaacacatcagaattgatggcatattttagcattgaatcaattacatcaacgatctttgcatccttgtggtatgcaatatccttaaccatcttataggtactctcgcgtacctgtactggtcgcgtgacctcttttttctgtttgaagggactttcgttgtcgcctaattgttggttagcctgctttgctaattttcctaaaaaatcattagccattttcaatctcctcaattctacgcaattcttcttttaataccatcgtgtacatattaatagcttttttatcccaataatcctcattcttaattccagcattagaaaataacttaacccgttcctgttgccatattctattcgcgaacaccgcttcaccgaacgactcagttgcggcctgtgtgatttctttatcgactttggcatcctttttaacgagataaagaataacaccagcaacatcgaaggaagcttgatagtcgctctttaattgaaacatgtactgagctgttttaagaacggatgtgtaagcttgcttttgagtctgcaataccaaggatatataatcgctggctaggattgcattattcgtgaagatagaaagtgtgggtggcacatcgataataatgtagtcaaattgtgatttgaacttctcaataagagtcttcagtattagcatacggtcatgatttctgattttttcaaccttactaggccacaggctaagtgaccaatcagatggaatcattgaaacgttatcggtaagcttaacaacagaattttttaagtctaattttagcaggccatcgaataatggaacatttggttctgttttattattgtaggtagttcgcataatttcagtggcgttggattggggatcaaggtcaattaaaagtaccttataacctaactcaccaagcagataagtatccattacactcagggtagttttgcctacaccacccttaaaattaaagtgaagcaatgttttgcaagtcatttaatcgcctccagtaatggtagtatagcacaaataattaaaaattaaaaataaataatttgtaataaataatttataatttattatttgtaattttcagtaaggttgacaggcatcctatgaaagggctataatcatggtatcggcaatcctattatatagtgtatcccataaattatttttcgggtttgctgtactattcgtgaaacatggggtacactgtcattatcaactaaagcaacaataaaaaactgcataaaaaaaaagcaccaaccgaaggcaatcggttagagccactagaataacgtatcaagctatacggttattctagcatggccggtgtgattttgcaaccgggggagccaagccctgtaatcatgctggagacagtgtggtccaataactcatgatagtcttacccaatgaaaaaagttagtagcggtccgagagacccgttaggaatgacatccggttatcatgagtggaaaaaagtagacacgtcaaacgagagcgaccgcataaaatcccgttaggaatcctcttattcctactccatgggggattctgaacgtgtgggcggcgtaacgtctggtggtaaagcggtgcattaagcacggagccatctaattagctgatagtcgaacaattaaaaatacgtgttatcagcgtcttctaagggcgcttttttagtggattcagtcgaaaatgtagattgagaattagatggtggtgaaaaccatgattgagttggatagtgacgggcaatgatgaccgacgagctacaatcattttctctaacaataaaatgttagggaaaattatacgctcaaaacaataattccctctaagctaagtggtaacccataacccgtcaagtcaaaatccaaagaaagttcaaaaatactggtgaatttaagggaatggtataggagtaatccaagagaatttcacaaagtataattccccagttaaagccaatctgatacctataccaatttgttaccagcaaatttcacaagcgaaaagttacagagtgttgtttcaacggtaccggatagggttacttgggataatccactttatgtcaactaaaaattggtacacaaaaaaagaccatccaaagaagaggttatgagggtacccttcttgggtggtctttgagaaatgaatggaaattaattataacacttgggtatcagttgttacataaatttttccaaaagatacacgaagattgtaacaacaatgccactcactagtaccccgataacccagttctgtacttgggtaacccggcctatctcatgttcaacttcaattgattttgtcagagctctattagctttgtcatcaatctcatcgacatgattgagtttgtcttcgatgtcttcaacttttgttttggtagcactcacatctttctgaatgtcaatcagcattcgggtagtgtcgtcaaagtctccttgcattacttgccacccgactttctgaccaactttacatagtccttgttagctgagatgtaaccaacatccgttttaatccggtacaccttaccgtacttgaccgctttaccgtagattgtactgccctttgagaagtgaatacggcgcttatcagccttgtctagggctggcttgccatacacgttaacttggtcagtaatcacttcatacaagccattatcagcccagtatgaggctttcttaggcgttgccttggtaaccttacctgaaagtttaccatcaaagtcataactgcaatctacaccgtggaaattgtcggtatattgccaagcgttggcattagctacccccggttgactgacgccataagctgccacccagattgccttatctactaactgggaccgattaatccgaccagcattgaaccagctacctgagccgtacgtaatcacattcttgtacccgtgactaatcaggtatcgaaggaagacattaacctgactggtagttgaatatggtaagcctggtgcttcaacatcaattgcaagtaccgtggacttatctaatcccatcttcttcacccatgatagaaagtattgagcttcagccgttccccgaccatgaaagaagtggtaaacaccaacggtatcaaacactttgaagccattggtaatctgggtaccagccttgggactgagataaccagtaccttcggttaattttaccataataccatcagcaccccacttcttgagttgcttcatgtaggataaggaatcggcttggtatgatgacaagtcaacaatctttttagtcattgtcgtcagtcccttctgatggggtaatgacctccgttggtgccggggtaactactggggcatgattatccccaccagctaacttgtaagcttggtaagccttctcaactaatcctgagatagtttgaatatccaagtcaaagccattggctgttaattgagcattaacgaaacggattgcttccttcttccggtcagacttagataagcctgccatgactgccatttctggaacaatggtattcgccaagtttaagccaacttctaatccttgcttgacgtgggtattcttctccgtctgtaccttgtgagttaagagtggctttaccagcttgtacacggcgggaattaacaccattaagaaggcgaatactcccgcattattaagccaattgaacacatctgtaatttctttgaacattttttatcctcctaattttgggtaaattaaaagcactgactaactggctgagtaactgctagttagtggtgcttgagttgttggtgcttgagttgttggtgctacataatcatctccggtaattgccttgtaatcgtcagcggtaatcccatctggtaatcccacaactgtcgctaacgtttccttggtaattgttttccagtcttggtatgcccacgtataaatttgaaccatattatttcgtctcctttgctgattgactgagtgcaagtgctgtaattgattgctgtaactggttgatactcgttgcggataccgtttgctgttgtgccagggtagtggctgagttaaccgcttcctgactagtattcaacacatcggaatacttggtattcaactcatcaagggataattctggcaagttacccggattgagtaccacctttttatcagtgtcgtaccggaatttgtctgaatgctgggcaaactgggtaatccatgaatccagaatgaacacctttgtgtacccgtctgcttccgtattctggtaagccgtgatgaaaccgtctgtatcataagtgatataaataaacatttaatcgtcctttctaaactaacttattaattgcaataatagcggggtctcccgcagtagccttggaatcaaaattagtcatgaatctattaaaagtcagcaaaaacagtaaatcatcactgttggtccccccaaaaagtagaatattattctcaatttttacgtttatatgttgtatagaagctgatccttgtccagccagggaattttgtgcgagtattccttttatgcttccataataagtccagtctactgaagaaaaagcatatccctctggtggatatatcccagcagtgtaggtatcaataccaatcccaagatgaaatactgccgaaccatacaaactagcactaccgttcccattgtctttaaataatattgttcctcctgtagaagacaatagttttaaaggacgccaagcacttgcttcaacgcttttcaaatcagccgcagttgcgacatcgacacctcctgattgtaatccagcagtgaagtttgtggctttagtagagtcaaccatgtttgcagtagcagtgctaacagccgttgtaacatcagttttagatgccattttttttgagttaggtatcgcccaaccagaccaagtagatgggtatcctgagagtatgttagtttctgaattgttagaaatattagtgtaagttacccagcgcgtcccataggcgatagacttaaccgtaatatatccccagtccttgtcactactattgccgatatttggtagatttttggggacagggccatagactcggtacacaccatcagcaagcgtcagcacatcatcatcagccgtcagcgtcgtcttagccattacacttgggtcaattgctgaggtatctgctttagttgccagctgttgttgtgtcgcataattgctcagatcaggttgcgtaccatctttaccggctggtccttgtggtccttgtggaccggtggctccatcttttccatccttaccagccggtccctgaatctgtccacaatctttccattcattatccgtccatacatagagttcttcggcgactaagtatccatcaccttcactggcagtggctggtagctgggaagtggtgtccactttgcccttaatttctagtccttgcccggtgtcaccctttggtccttgaataccttgtggcccctgcggtccagttgcaccatccttaccatcttttccatccttaccagtggggccttgcaaggttgaaacttgattagttaagtcagttttaagctggtcgaactcctgctgaaactcgtccaaactcataaccgggataacgtccccagaatcactcatcacattatcggtaatcgtgaaaccttgtgggtcatcactcgggaagatggcgttgtacgttgtcgtatcagtagtggtaacactggttataccgtcatcggttaatccttcttgactacccggggtaatcagactggataaggtcacccaaacttcaatcgtataatcatcgggtactaaggcattcataacctcagcatccaccggcatggtaatcaatccagccaatggctgtgtaatggtagtcatatcaattgatttatcgaatacataacccgtgtcgttggcaaccttaacatcaatggccgtggcattagttaggtcgaatgctgaaccgtcttgggtaattgccagattgaaactggccgtagtatcgaggtattttacctcgttgttaccatcggtgaagtacagttctttactcattcgtgccaccacctagggcattcgttgcttcagttttcaaccttgttagtaccagttgtttgaatccagcccacatatcttccttggtagacccagaaaaggctgtagaagcttcatcagccgttgcatcaaagttaccataggcttggtgattggtaccgctaaaaacaaccgtgtagacaacgtgagtcgtgttatcgctgttctgcttaacatctaagcttgtaatcattgaacgttcttcctttctaattgcgtgattcggtagctgagttcatctatccgctggttggacttcttcaatgccgccaataagatggaaatggtattggactcgtttaagaagtaatccccattctcatcagtgctaatcatgtcattggcaatacttgaagttttatctccaattgaattaacatcatcaataatcgggccaatatgctgggagtcagcggagttatcggaatccttgtacttccatttcttcacatccgtattcatgacagctgataaggcttcatctggggaatactctgtcacatctcgtttagcagacaaggcagatttcaatttgctaccatttgaataaacatcagcggcatggatatcggccatgtttcccccacccgcataattttcgaagtaaagtgcaccaccatctccacatgataatgtgtgaccactaatggtgagaccattacccgatacgctattagaagcggctactccaccagttttggtcatgaataagctaccaccattttcttgaatattaattccatcgctatccattcgcatatcgaatgaattattaccggtagccttataatgaaacccgttgtaatccgcccataactgaaaatgggtaccgtcacttgaggtaaagtcttggtcaatagcgctaccggttatcgtgccaccattaatagtacttccggatatgttgacaccattaatattcccggcttggacgttacctaaattggcagataaggctgacagatattcaaccgccaagctagttacgtcccactttttaattgcccaacttccaccagaatagatatacatgctggttgcaacatcgccactcattaccagccacatatcgccatcgttatgttctttaccatcgtcgaatggggtgttggttgattcgataattgtgccatccagtgaggttttgaggtttttaatcttatcggctaaatcatcggcactatctgaagcgtcttgtgctaacttggttgcctcattaatatcaactgaacccgttgcaataatcatccttctaccacctcctgataagttgaaccgtcatcaatattgaaatcagaatcatcgtcactggcactatctgagtcgtcagtatcgtcagggattaccactggttcttctacttctgagttttccccttcatcttcggctgggtaagtgacggctaagtccttgctatcatcacggataccaattggaattgaccataggccagaatgactaatcatgacgctatgagccgcgtctcggtactcgctgacattgaagccaattattagctggtcatgagctaagtcggggtatatcccttctggttcaaagtgaccaccgtactcaatcggtacagtcagttgaatatcctgtgaaggttcaatttggtaattaaaaatgactgactgggtaatgaggttaatgcacattactagtcggtcatccttattattgacgtccccagcggtaaagaaggcgtacggatatgaaattgaattagcttgaatcgtattgtatgttccatcgttggtgaccccacttggtaccggattccaaccgaagtcctgcaatttgaatcggataattgggaagtaattaccagctttcaaatcagaaatgttacatacttctaccgtgccatccatttgactcccaatccataatccagcagttaaatcaacgttaggtctcacgtacgtctccatttcacaccactttgttacggtgctggacccactattaatcacggcatgaggcgtgtatgggaaggttgctaaccaattcttgccaccactcaaatccttaatctgtgagtagataaggttgttggcttcatcgtaaccgaaggaagcgccatgctgaccaccttgtacaatcatcgaatcaattagcttgccatcagaactccagtgcagaaattggcaatcggactgattggacttatcctgagttcctttgtacgcgtagctggcaagtatctcaccactactcataacgtacgagaattgaagcgctccaacatggttattaccaaactcatcagggttaccgtcagtggtctcccataactttttgaaggtaccgtcagagttagtaccagtgtctatccacatctcagactcatctttaacgaaggcgtcatcaattgatacgactaagctaccgacgaatggtggggtaatggtgacttcatagccgtcttttgagtgctgactctcccaattcaaattatgagtcccgtcttgctgaatatactcccaattgaaagccgcggctgataagaaggacgtaacattctcgccttctatgaacaaccgggcaatgactcgcttagaagtatcagtattcgtccatgattgccccagtggggtaattaggctgatacttgcagcattttgattctttttagcgtcttcaaacagcttctttacgtggtcgttccatctctgttccatgtttttaatgaaattgggagtaacgactgtaaccgtactgaactcaccgatgactaccttattttgagtcgggtcactctcggatgttgtccgttggattactctggcttgcaaggttagtactggggacattgtcaggtcgattaccttaatggtatcgcctaattgggcgtcaaaatcactggtaacatctactgaataattgacccgagggtgattgtacagtctgagtgtcttcaatcccagcgataaaagggcatcgggttcactgaccgtagaactggtaatgctaccttctaaccaagtgttggcatcgctattataccgactattagccgtggcatcagtgacaaaattacgaccaccgttacccttagccgtactgattgaggcaccaccggaaccatacacgtacagcttggtaatcagggtagtatcgaccgtttcccgtttaatactaagcatgttgtcaccataagtgatacgtctaccggtattttgtccccgctggtcggataattccaaaatagtatcaaccacaatcccagaactatctaatttcacgtacccatcggcttcacaatcgtaagtagtcaggattgtctgaagtaaagtttgagaagatgattccccatcgatggaaaagtcagtcaacaaccctgaggttgcattatctaccagtgttatccctgtacccgcaataatccagttcatagcggccggtaaggcacactctttaatctcttttttagtgggaattgtcttccctaatcgccagattaagaggttaatggcatcggctgagataaggttagtcccagaggtggtatccatggtctcatcaacggtatatattcggtacactcgccagcggtcatttgcttggtcgtaggccgctaaatgattgcctactttcaagtattgagccgctggactatctgctaccattgttaatccggtaaaagtatcgttccatgacttgctgttagcgttggggtcagaagtattagctaggctggattcagcaatactatcgtttgaagaattatcatcggcaagctgttgctgaatagtttccccccagaatatatttgtatcagttgacgtatctaaggtggcgacccgtttgaggttcttatccaaaatgatgtacacacgtcttaactcctttctatttaatcgctggtttgtattccaaagttatatctgagttggctgggtccggtgtgaagtgcatctcttggctgacatcaccttcaattgaagggaaggtagatagccatgacacatacttatcaacatttctaccagccacggttaccgtgttatcagctgaatcaatgataatttcttcaccagcatgagcgataacatgaggaatatcatcggggtcatcactaccatctgaggtgtatatcttaaggtcagtcagcgtctcaaagtccgacttgtaagccacttttggagtgactaagtcttctttaatatcatgcttcatgaagcaagccgctacgttagccaaggcaaatccaaactttcccgacttgtctaacttctcagtatgaatgtgaaccttaccttcagtatttttcgaatacacgacacctgttttagaattgaactcgttaatctcagccacccaattgtcataaaccttgccaccaatggtcttcttttgacgttccaatgagaactcaccgaagaagtttgagtaagcgtccttgttcatatatgtggtctccatcacataagtcttaatggttttggacttagtcttaaccgttggcttagataccttggtagacttgctcttaccaccagattttttcttggtaaccttcttggttgccttcttcttctttttcttagaagtcgtcttcctagcggcggccttgaatgcttcacgttgaattgttgcttgatacattctggccgatttagctttggctttagctttggaagtagtcttaaccttaacggttttggttaaatgaacctttacatcatgatgatttttaccattaaccttacggccaccttcgttatacaaaagggtgaggtaattgcccttatctttggtggcattgaatgaactacccagttgaatgtaacctcttggatatcggccttctgcataatcggtaatccccattcgtccacaaacgttgccattagaatccagtagataaccttcaaccttgcccatggcccgttcattagccatccgcttgatatggtggaatctcatagataccttccaataattgctaatcttcgggataccttggtggataataacgggaccgtagaataaattcttgtgcttaccgactgtaccccagttgtaatggcctttactatccttggcaaccattaatgctgttgctgtagccgttgctttaccatcattttcccctcgatatacgttaatttcttgggtatcggtaccagcttgaaaccatgtgctcattgagttacaagggtcgtgtacttgcaattcttggtgaggttccaaactagtgacattgccatcagcatcagtaatcgttgaaccatcgtcaacgtgataaccaacggccacatattggtctcccaaggtgtaaccgaagtagtacaggtcagttttgggaatgatatggataactggttgaacagccgtattacctgctgggctgataatctgctcgttactggtaatcttaatgtcccgttgaggtagaaacccccgtgggtcagctaacatgaaggttaacgtagtggtacagtcctgtacaccttcgttgatgaaggttggggtaggaatggcggtaaaatggccgtaatagactacctctggttggtcattgaaccgtaacgggtactgagtgtcagcgtcatcatgcgtgttaattaaagccttggacaaattggtaataatccggttgtaatcgtcccggtcagttggaaacagtgtaatcggaatatctatctgcttttccccgtaactattgcctaaaaaaacgcccccatatctaccgggaacgtcttggaaggattcggttatcgttggggcaattggttttgagacgtgatttaccaacacttccaaatccttttcagaattgaaaccaccggtaccgttctcatcgaaggcatagtcaaaggtattaatatcattgaatgccattagtgtaaccccttcctaggtttttacttagttttgtttttgtactcattctgttgtacccattgtaaatagcattgtcagatacaacagcgggtactggattctgctgaccagatattaattcagccatcaatccgataatctctttaccctgcttaatcaactcagataagtcagttgattgagttgcttgggtagtagattgctgtggcttatccgtcttagcaaactctttcatggtggtgtccataatctggtatgctctggcacgcttggtaatatcccacggtacaattgactcagtcttgttaccctctgagatatgtgccagcttggcaacctttgagataccaccattagcgtaccaaccgatactcttttcgtggttgtaagcttgttggattgaatgataattgccatcgttgacgtaccatttcatccatttcaactgggtgattggattagtcttccagtctgaacctgctcgggccatcttagacgctggtaacgattgaggtaatccataagcaccagtacccggattggtagccttagggttccagcctgattccttggtaatgatgtagttgtacataccataatcagatgttgggataccagcttgtttcaaccagtgcatgtggtccccagaaggtttagcagaacttccagtagtggaagaattgtccccaaacatatcagccaatttagacataaacttgaagaagcctgaaccgacttgggacttaattcccttggtattgccagtccccttcttagaagaggagtcgtcacctttgccaccattcaattgagcaatccgccgtaatccggcaaatccacccataaatcctttgattggtgcagacttaataccatctgttgggttctcggcattccacatacgaccagcaccattagtagaagtaacaatccccacgtggtcactaccaccggcaccccagaaggcaaggtcaccgggaacagctttaccccagctaacagaatgggttgaattgtactcaggtactgtggtggaaccagataaggtaactccaatatgcttaagggcttcatagaccaacccggaacagtcgtagtagtttggtcccaatctacctttggtttctgagtacttgtaattagcccgtttagaaagcctcatggcttcttcaatgaactttttacgggtaccagaaccagttgccccaccatcaccgtctaagtcaaccatggaccagagagaactccaccagttgccagcttgcttcttaacattgttgaacatacctttagtaatgtcctcgacaacaccggcaccggccttggtgtagttaaacatggaatccattattcgtcccgctggcgattatgccaagatgccagttatcttttatattcatggtgctggttgggtatttgggagtgccaaaacacatgacaagctcgtgcgggaacttgctgtgcggacacattcagtcgttgtatttccagaatacacgctgtctcccgaagccaagtatccaacggccattgagcaaaattatgcggttttgcaacaattgcctgaaattgctaaggatgagaactttgatgtcgatcggttaacggtcgccggtgactctgttggggggaacatggccacggttatgacgttgatgaccaagcaacgccaaggcattaagatcaatcaacaattgttatactacccagtgacggatgccaactttgacacgccatcttacaaccaatttgctgataactactacttaactaaagaagggatgcagtggttctgggatcagtatacaacggatccaaagcaacgggcagaaattacggcttcacctttgcgggctagcctggatgagttgaaagacttgccagcggctatgattttaaatggcgaagcagacgtgttgcgtgatgaaggtgaagcgtacgctaacaagctacgtgaagccggtgtcgctgtcacacaagttcaattccaagggatgattcatgactttgtgatggttaactcattggatgacacgcacgccactcgtgcagctatggatttatcaactagctgggttttgcaacgtaacaatcaataacatcttcgataagtaggcgcttaagtggcgagataatttaaaaaaattatctcgccacttttttagcttccccccttttttaacacggagtctgttatgctagagataattaggagggtgataacgtgactgctcaagaaattctcaatgtgttacgcgcagcggtggtagccgatgcgctgggggtcccggtggaaatgaaggcgcgcgggacctttcagctaaccggcatgacgggccatggttcatgggaccaaccgactggtagttggtctgatgattcgtcgatgacgctttgtcttttggcaaacatcaatgagcagggcagttacgccgaccttatggataagttcgaacgttacatgatgacgggagcctacaccccaacgggcaccacctttgatgttgggcggacctgtgcccatgcagtgcggcaatatgcgattaatcatattgaaccgttgcattgtggggatactgccgggaatgccaatggcaatggggccttgatgcggattgcaccgctagccctggtcttaaaaaatgaagataatcaggataaccggtttgcggttattcataattacacggtggtgacacacggccatctccgggccatcatgggcagcttcatctacattgaattattgcgtgacttaatgatggggatgagcttacgtcaggcattatcccacgtgcaggaagccctaataacttttgtggcgactcatgaaaaatttgctagtgaagctgcaacgtaccaacgactctttacgccgcgctttcagcaactaccagctacggccattcgctcaaccggctacgtggtggatacgttagaggccgcggtgtggattgcactaaaccaccacgacttagccaccggtattttagcggcagcaaatttagggagtgacagtgacacagtggcgactgtggcggcatccttaatggcctttgaacggccacaacagtcggtgccgactgactggtgggaccaaacgctgaatcatgagttattagaccacatgatgcagccgttcgcggccaagtttggggaggaaaaatgatgaacttaccagaaaaatatgcctatatggcgactggacagccttataatgacttagacccgctgttgattcagcggcgtgatcgggcaacccgcctcactgatgagttgaatgctactgctgacccagatgctaaggccactttgtttaccgcgttggttggttcggtggggcctcgtcccctggttaatcccaactttcggtgtgaatttggggataacatccatgttggccgcgatttttatgcgaattatgacgtggtcatgctggatggtgctcctattacgattggtgatgccgtgttattcgggccaaaggtgggattatatactagtaatcatttaattgatccgacggaacgggcgcaagggggctgtattgctaagccgattaccattggcaatcagtgttggctagctgcgaatgtgacggttcttcctggcgtcacgatcggcgcgggaacggtgattggtggcggcagtgtagtcacccatgatattccagaacacgtggtggcagccggcaatccctgtcaggtgttacgaccgattacggcggctgaccgcacgggttttgcggggcaagatctgatttagctaaactaaaagagcctggagtgaaggctccaggctcttttgcgttgccaaatatctggtattaaaacgtgcgccagctaagcaccttttgacccacgctctctttcgtcagtgttcagaaaataactggtgagctttggcgtaagtgaaaagccgttctacggctgcttgattagccggggtggtgaggagcacggcacttaaattcgcttcatctaaaaagtagtggaagtcccgataccccaaggtgctttcagcggcgtgataagcagttgccgcaattaacccggtagatgaggtcgtcgtactgatacggaatagttgggcgtcaccactcagtcggcgcaatgttgccaaggagaaagttagcggttgttgacgatgagtgcgtaaactttgcgtgtcgaacgtaatagtgggcataacagcctcctttaattaatgggtgtttcatgtgaaacattagagtagaatcagcaagccgatcgtgataaatagtaacggcgacagccatgtaccgaagcgctcaaagaaacgggttgtcgtgtgagaccgggctagacgataactaacgcctaaccacaccccaattaatacgagaaagataacgaggacaccgctgaaagtagccggtgataatttggtaaaataaggaatgtaaatgcttaggttatcgccgccattgccaatggtcatcgaccaaaccagtggtagactgacgggttgggctaagcggggtgtcgcgattgggccatgacgttcccgccaccactgccagagaccgacgaggcccaacgttaaggggaccaatccaagccagtgcgttagatgggcggcatcgtaatggagcacgccacgactgaccagccaagcgatggcaattagggaaagaatcccaaggtattgtccggcgataatttgctggcgctgctggcgatttttagcggctaaccataatagaagtaatacgaccaagtcatcggtatccgtaacgaaaaatatcccaatggcggtcagaatggcggtaactgacatacccggctcctttttgaactttaagatgcttttattctacacgtcttaaggccgggccactacctgtatagcgaaaggagacaataatatgttaatggcttatccagcaacacggcaagattatccagaactgatcgcgctttggcaagcttcggtgacggcaacccacacctttttgacgcctactgatagccaaaaaattcgcgaacaattaccgacctactttgcagcggtagagttgaccaagtggttagatgggtcgaagttaatcggattttccggtaggcagggcccgatgttagcgatgctcttcattgccccagatagcttccggcgggggtacggtcaccagatcatcgagcggttaaatcaaaaacaaaacctacgcttggttgatgtgaacgaacaaaatccgggagccttggccttttatcaacggcaaggatttcggatcgtgagtcgggatgcgttagatgatgcggggcaaccctatccaattttacacttacgtcgcgattaaaatcgtcaaaaaaaccatcctgttagcaggatggctttttggttaagcttttgtatgcgctttgttattaaagataaaccactttgagaagaagtagttgccaatgacggccaacccgtgaccaatgaccttggtgatggttgggtggaagctcagtagtgagatacctacatagaggataacggcttccaaaatataggtaaagacgcgggtgccgtagaactttcccatatcgcggaagggatgatcggaggcatgcttgaagaccagcagtttatcaacccagaaggcggtttggacactgaagacccaagccagtaagttagaaatttgatattcaacgccaaagatactgttaaagaggtagaacatggcgatgttgacgacaacgctcaaagacccccagagcaggtaacgttgaatttgtttgtgggctttttcctcaacttcttcaagttgttcagcaaattcattttctgtttcggttaattccgcctcgtactcagcttccgtttccggatagtggtggtgacgtaagggcacttgattttccataaagtcgaaagacctttcttaacgttttaatcgaccacgatggcgcgattagctgttttctcagcgccagcttagttttgaaaacgtgtagttgatataacaacttaattataccgtttttgactgtctctgcaatggtgcaagctgagaacttttcaacggcttggggataaaaaagatcacgaccaattaatggttgtgatctttttacatgccgctaacgttaattcgcaacgtaggcttggcgatagtcggcactaccgttaaatttgttgtaaatgacgcctttaaccttggggttaaccaaagtactggtatgtgcttcgtagaggggtgtgacggcttgatcggtcatggccgttttggctgccttgatcagatcttggtaccgagctgatttgttgagtgcgtcagttccttcggcgtgctgaatcgcttggtcataggttcggctgttatagtggcccatattggaattgttggttgacgttagaatttgtaatgactgaatcgggtcagcatagtccatgctccagccagttaggttcatttcaaaattccccttcgagatattgccgagcattgtttggaagggtaaggcttggaccgttaccttgaggcccaacttactggtcaaagaactttggatgaattcggccaaattcttagtcgtgtcatcgtcttggcaagtgagggtcagggttacgtgatgcttacccaactgcttaagggctttttggtagagttgtttagccaatgttgggttgtaatcggccgtgttggctacctgggcatcagtggtgaaatccgctcccgtcttaggatttttcaacatattgtgaatggcgaaagtcttggcaggcttggacccatccttgaggaccttgctagtcaattgctgccgattaattgctagagaaattgctcgacgtaacgtggcgttagcggtgagccggttcttttcattatattgcatgaacccaattcgaccggccgcaagtgacttcaaatcctgattattcttattttgcgtggtctcttcaccattaagggtgactgtatctagctttttagattgataaaggttgtaggcagttgaactggccttaataacttgataattgatactggacagcttgaccgtcttggcggcgctgtaggcaggattcttaaccaacttccagttatcgttggtcccagtccagtttttcaagacgaatgggccattgtaaacggtcgttttagccgagctaccgtactggttaccgtatttttcgaccgcggctttgttaagcgggtagtaggtggtgctggctaacatccgcttgaaataagaggccggtttactcaacgtaatcttgagttgatacttgccgactgctttaacgccaagtgtggatggggccttttttccggccgcaattgcggtggcatttttgatgtttgcgaactggtaggtgaactccgatttagacttcgggttcagcattcgttcccaagaatacacaaagtcctgagcggtcacgggttgaccattgctccatttggtattgggcttcaacttgatggtgtaagtgtggccatcattggtgacggtcgttttagtggccaaggcattttcagcttggctgttggcgtctaaccggtacaggccttcgccgacctgactgagtgtgttggtcgaaacgctatccgtaatcttggccgtatcaagactggcaatggtcgccgtctcataaaggtttagatgttgggcagttgctgtcttagttgacttcgagtgggcggtcacagcaaagatgccgccgattaaaatgatcccgccgcaaacggcgagtgctttcttgtgatctaataagctcatagtggtttcctccaaattgattgaaattctgagttgttacagccactgagcgttgccatcgactaaacatagatgaatccccctaagaaaaaagtaaacaaaaaccgcccttaacagccaatgcgttaaggacggttaacttttaaccgcggtaccaccttaattgaacgcagatacgcaaataagcgtctgcgcccctctccacaggaaactaacatttccctgacaactgacgtatgtcgcacgtcttcccgtactataaattcggggaagccctcggtggtccatttacttacctgcgttcggccgtactctcagcaacgacgactctctttgcgggcatgataagcttgatctccacttcaatggtttgtttcggacgatttttgaattgaggcaagcataccgcttaggggtaaatctgtcaaaccctaaaataaaaaagatttgttattaaccgatttagtaattatcagcgagataataattgatgataggttagcaaggacggtgctgaatgcggtaggcaatgaccctaaaagctatacgggttttcctaatttaatgattaattcttattaagctttaattattaataattaactgatgtttgtaagccaggtaggactaaccaaacgggttcggccaagccaactgacggttaccggtatgataaaagaaaaggggggatttagcatgaccatgacagatgacgaaaaaatcacaaaaattttggccgcagctagtgatctgtttattcagccggggtatcaggtgacgcagatgcagacgattgcccggcacgcacacctagcagttggtagtctctaccggttctttagtagtaaagccgcgttgcgtgatcagcttttcctgacaacattgggtgtgtcagtaacgggcaccaccttgccattgacaacggtggaccagacccaattattagcgcaaactcagacggcctatgaccagtggcaggagcagtttcaaagctgccaacgagctgatgacttagatgatttgctgacaaatttggtgacgacttttcaacggtatggccgttattttttgatactggaacacaacccgaccttgaatcccgcactaactgcgctataccgtgactatcggcaacgactctaccaacaagttggggagtttctcatgcgacaacggcggacggcgaccgaagcagatggcatgattgtggttgacttgattttttggtggtgtgcgcacaagcagtacgatagttttgagaagccagttggtcgccaagcattgccagctgttttgatacaactgcgaaccatgttgcaccgcagctattaaggggaattttgataagccaccgccgtaaccgggggtatttgggagtggatgcgcgtattttccagtggttcggttagactaaggtcgaaattgaatgaaccgttcattcaattttaaacgtcgaagggggatggcgagtatggccttacacgaaatgcggtatctacaccaacatccggcagtgattcgaattttactgggaattttagtggtgccgttggtctatgcagtcacgtttttagcatctgtttggaatccatatggggaactccagcatttaccgatggctgtcgtcaatcaggatcggccggtcacgggaatggcgtggggccggcaggtgacccgccaattggtccgggatcgctcattggattttcgacaaatgccaatgcagcgcgcccaacagcagctggctacggggcacgtctacttggtcttacagatcccacgagaggcatcgcatcagttgcggtatttaccgacggctacccggcccttacacgtaacctatcggacaaatgctggtcaaagtgccgtcgccgccaagatgggggagtcagccatgactaagctacaaatccggttgaatcaagccgtcgttcaagcggagcaacaggccgcccgacaacagttggcgcagcaaacccggctcacggctggtcaattgcggcaaatcgcccaactgacggcggctaaccaggggactgtcgcaaccctggccttatcacggttgcaaacgcagttagcccgtggtgcacaagcgatgacagcagtcacgccggcacagcggcgggcccaggtcacgccaattcgcttgattcaacgggatacccattcactagctaataatggaacggggatggcgccgtactttatgaccattgcgttgtttgtcgggtgtattaccctcaatattatttatgatgctggccagcgtcacggaaaataccgttactttgccttagcgtggttagataaaatgagcttcctatggggcttcgtggtgctagcagctagtgcactgtggctcggcgtctggcaagttaatggtcttcgaccggtacacccactagcgacctatctctttagtttattgattattctggctttctttagtctcgtcacttgttttcgcctatggctggggctgacgggagcgtggctaatgctgctctttatgatttttcagattgggtgctctggaggaacctatccgattgaattgacgaatccactcttgcgcgcgtttcatccgtatttacccatgaccattgcgatgagtggtcttcaccagacgatttctctgggtgggtcgattaccgagcaagttgcgattttagttggcatggtggtggcttttagtttaggaaccttggcgtatttctaccgtcatcaagatgtaagtgcagaataaaagaagatcgaccttcacagcgggtaaaaccttgcgaaggtcgatcttcttagtttttcgtcattatgattgtggatcaaccggtttagtcggatgcggcgccaatccactcttcaaagccgccccgatggctggaatttggcccaggtcggtgacgtggtcgttgggaacgaccaccacattggcgggggacttggcgaggtcactaaaggccgaaatcgattgattttcgaagaactcgcgcgtggcggtttccagactggaattgatggtgtcaatccggtacttttcagcatctgctcgcgttcgagtggccgtggcctcagctgaggcagtcgccatcaaagcatcgtttttggccttggtcgttagttcaatggatttggcttccccttcagcttttgcgatcgctgcaatccgttctcggtcagccgttaattgcttatccatagctgactgaatggctttggaaggtgtgagctcatcaatgttggtacgatcaacgttgatgccgtacgtatcggttaaatccccaatggcagttgccagttcctggttgattttggccgtggagcctagcgcttcgttaagatccattcgaccaataatatcccggaggtgtccccggaccagctgggccattgattcgactgaatccgtgttttcatattgatatttgaccgaattagtgacgtgatagttgagggtgaggctggcggagacatcggcattatcctttgtaatgacggagtagtgtggcagcgccagtggcgtcatcgcgagattaaccgtgcgaattttttgaacccctggtaggtaaaaatgaataccggacgagacgctgtgtttgtactttcctaatgtttcaactaaaccttcgttattttggcgcacaattctaattccaaacatcctgatcgtccccttagatttttttgagcgttaagatattcccgtgactctctgtgatggtatagctggtgttcgggtccggcgcttctggtgactcgagtaagtagcgatagtaaataccggcgactaacaccaagccagagtccggatccagttctttaccagccaaggaacggccaattaattggcgttgttcccagttaccagtgggtgccgaacgggatagcaaatgaacgatataggcgttgatgctccgaccatcagcgtctgccgcggcggatagacgttgaaaaaggtcttcgtccatccgtagtaaaaaccgcttttgtttttcttttgccatgattatatcctcctgttgatagctctatgatatcaccgtgatatcattttggcaattcaatttggattttagcagatcatgggaatggcattagcggttattttctaattttagccgtcataagcttaccgtgagcgctaacttgaaccaattcattcatggtggaatgctttgtcgcaacagcgtggaaggtgatgccgccgctatttgtcagggccattgtatagatattaccatcgcgcttatccttgaaacgatgtgtggaaccaaagcgataatgaaattctttcaaaccactgccatgaccagtatcgacgcggttagaataggaaacatcataatagggcttagaaaaattggttcgttcaactaccacttcgacaccgtcttgtaaattgcggtcaaaaagaccgatacggtggtcgccagttaattccatatataaatcggcttcgtgtttgaattcataatcacgttcgataacatcgtagtagcgataataaactttggttgtttttcgggtaaatttcccactcgtgtttttagagtggctagctaaggccatgtagcctgagtcgtttaataggtcgagcgctttagtatgatagattgtcccgattttaccggtcaatgttttctttgaccaaagatacttgccagtgtgaccgcgtttaccataaacgtaatagacaatgacttttccctttgctttggattttgctactttagtactggcagcggctggcgtgggtgtaacgccaaaatacagcacgctaccgcttagaatgccaatgagtaatagactgcttaaaaggcctaaacattttttaatcataaaaaagtctccccataatcgtttataggctaatcatagcatatattcgtcgtaactaattcatgtttttggataaaatatatagcgataactatttgtaaaggcggtaatggtgaagaatcgttacagactatgtggaaaataaactataaaagattagtattataagtaggagatattcagtagtctagacattggcgggacaccacgttaaggcatgatgtttcatgtggaacaattgacattagccatttagatatcatcatttggtgtggtattctaaactgacaatcaggctaggaggcggctatggtgacaggaataaaacaagtgaaagctatcattgaagaaacaccagcattaatggagatattacgcttaattcaggcatgccacttgcctcaaggggcattagcggcagggagtattcgcaatactgtgtggcaagtgttgagccatcaaccggtggaactcattagtgacgtggatgttgttttctttgatccacagcggccagttgaagccgatctacagatttatacggcactgagacggcaagcaccgcagtatcaatggcaggtgaaaaatgaggtctatatggctcactataattttgcaaatgcaccggaattcacctctgttagtgacgccattggtcactttgttgaggtaccaacgtgtattggggcgtacctagatgaacaacagcaggtccagttgattgcgccacacggtgttgcggatttattagcactgcgctgtcgccccatttccttttaccagcaagatgagcaacatcttgcaatctttcgggaacgtatggctactaaacagtggctacagcgctggccgaaattacaactcaccgaaaagtaatgaaaccaaaaacgacccggttgcagatgcaacgcgggtcgtttgtcgttagcgtgggataacgacaaataaaaaacgtcgcaactactgattggtagcggcgacgtttagttaggttaatctttagatgtttcggtttctaatggttgttcgggtgctggcaccttttggacgagtgataaaatcttacgggcaattgggccaacaattaataattgtagtggtaacgccataaagagattaaaaatccaagtgtggagatacgtcaagaagacgttgcccccaaagttttgagtgacgaccattccgaaaagtgacattaacgtgaccattccggccaccatcattacggagatggtgagggcgatccgaatctgtttctttttcatataatcgttaatgatgtagtggaaaaagagatatttgacaccgggaccgatgatccctagatcgcaaattgcggcgactagtaaggctaaggggtagccgaccaagacttctctgatgaagtgatgaccgaaaccatcagctaaggcgatgttgtaaccagccatcactaggaccatcaggcccgccatgacagcagtaaatagtagttcttctttaaaatttctaggcattgtgttgctcctcgtttgaatttcccacgagaactcagcgtaccacaaattttttcacggcgtaagtcttttttgaaaaccaacgattattttttcattgttgtgagggtgacggtggcctggctggtgagttggtcagcgactgtaatggcgacttgccaggtctgcaaatgatgcccgatatgcagcggtgtagctgtcgcaattaattccccctgggtcacagcttggagatgttggacggttaaattaaccccgacggcgacgcgatcagcatcgagattggcattggcgcctagtgaggccgcggtctcggctaatacgccattgatgcccccgtggacgacgccatagggctgtttgatggcagcgctcacagggagtgctataatcgattttgtcttagtgattaagcgttgcttgatgcctaaggtggttaataaattttccataataatacctcttttgaaagggttgtgaaatcatgataacagcaaattggcaacaggttaaggattaccaagaaattatttttgaacgagcggataaggtcgctaagattaccatgaaccgtccggaaaagctcaatgcatttacgccggtaacgatccaggaaatgattgatgccttcacgatttgtcgcgatgatagtagcattggcgtgatcattctaacgggggccggtgataaggccttttcttccggtggtgatcagactgtgcggggtaacgggggctatgtaggtcctgaccatattgcccggctcaacgtcttggatcttcaacacctcattcgggtaattcccaagcccgtgattgccatggttaagggctggtcagttggtggtggtaacatcttacaactggtttgtgatttaacgattgcggctgacaatgcgcagttcggtcaaacgggaccgaaagtgggcagttttgatgcgggctacgggtctggctatctggcccgcgtcattggccacaagcgtgccaaggaagtctggttcttgaatcacttctatagcgcggaagaggcttaccaaatgaactggattaataaagtggtgccactagccgaggttgaatcagaaacgttggattggtgtcacgagattttgcagaaatcaccaacggcattgcgcttcatcaaggccgctatgaatgctgatacggacggattagcaggccttcaacaattgggcggcgacgcaacgatgctcttttatacgaccgatgaggggaaagaggggcgtgatgcctttaacgaaaaacggcagcctgactttgaccaataccctaagtttccatagaaaggagcaacagtcgtggataattggatcacgaagcaagctcagttggcgccccaaaagatcgcggtgacggatgggcatcagtcactgacatttgcgacactggcacagcgcttaacgcaagtggccggtcaactggcggcggttggtgccttaacgcagccccgagtagcgatgctgactgataactccctcgccggctatcaagttgccttagccttattgggggcggggcacacgattgtctggttgaacaaacgcctaccgaccacagaactaaggcggcaattacaagacagtacggtggcaacgtgtctcgttgccgatgacttatggcgtgaggggttgggggtgaacgcggtacgttttggaacgttattgaccacggccgcaacgccccgcccacttgtcgcaacgtttgatgtgcatcaggtcgccagtatcatgtatacatcggggacaacgggacaacccaagggcgtgctacagaccttcgagaatcattatacctcagcaattgcttctgccttaaatttaggtgttatgccagacgatgaatggctgtgtacggtaccgatttttcacatcagtgggttttcaattatgatgcgcggtttaatctacgggatgacggtgcgcttggtaccacagtttgacgcgccagccattgcgcacatcttgcgaacggaaccggtgaccttaatttcggtagtgccattcatgctcaagaagctgttagatcaacagacccccacggcggcaccttattgtgctttacgaggaatgctgctggggggtggccccattgatcaagccacgttgcggcggtgtcagcagcaaggggttcccgttgtgcaatcctatgggatgaccgaaacggcttctcaggtggtggcgttaaactttgcggatgcgccaagtcatgtggggtcatcaggcaaaccgttatttaccacgcaactccagttgactccacagacgcatgagattctattaaaaacacccgcgctagccgctggatacttagggcagccagcgaagtttgcggcgaagctaacggcagatggttggtaccataccggcgatgtgggccatttagatgaggccggcttcttatatgttgatggccggttggatgacatgattatttctggcggggaaaatatttttcctgatgcgattgaggccgcctatcaatcggcgccgggggttcgcgatattgcggtcgttggtcggtcggacgctgaatggggaatggtgccggtggcttttgtggtcagtgaccatccccttgatgtggcggcgttagtcgcgtttggtcggcagcacttggcccactatcaggttccccaaacttttatcccagtggtggagattccccacaatggcaatggtaaagtacaacgggctaagttgcgtgcgcggttatccgcagctcactctgattaaaagaaaaacggttccttcagtgcgttgtgcattctgaaggaaccgttctttagttggtgatacgttaatcatcctcagctggtcggtcggcagttttgtcggcgtccttagtcggaaataacttgaagcttaatttgtaaaaatagtcggaggcgtaaccaatgacgaaaattcctaataacatggacgcgtacaattggaacacaaagagcgaccaattatgaatcgtcacattggaaataatcagcatcgtagttccccaggcaatcagccaggctggaacaacggtaaacttcatgacggtgccttgaaggaacagaacaacgaaggtcatgagaccaaacatgattgcactggcccacggggaagcaatccaagagacgtgaagcaaccggaaggccgccagtccccatataatccccagagcaaagctcagtaaaatattccaaagtttgtctttgggaaaaccagcaccaaagaaataagaaacggcgataaaagcggcagagcccatccacaaggagaaaccgctcataattaaactatagactaaagtgaagaggcccacgccaattgcgtcaacccagacctttcgtggaatgttcatgattcatactcccctttaacgtaatcagaagcgcttacaataatgatgtaattaatacagtttaaatgatcctgcgaaaacgtgcaaggactttaggtaaaacgttgtatcaaacataaaagaatggggcaatcacttttccattagataggtcttcaactataatagggataatggagatttaagataggggaatcgtcaaatggcacacacaacattgagtccagccgaatttttgacgccgcaacgactggcaaaattatcaagcaatcaacaagactatgccgcaactatcctagcagatgtgttgcgggttcggcaggcggtcggcttaacgggtgactggacaccacaacaagttgccgctacgctagcggctttgccgacaatggttgatcaatcacatcggtattacgtggctgtcgtaccagttttgacagcttatttcaaagcacaggcgttgcctaatgaagccgctttgttgcaggccctaaaagccgcgcggacagcattagttgctccgcatgaaacaacggatcaagagcaggcggcttacgaaacggttgtcgcccaagtggatacttgggtgcagaccatgacgcagcaacccgaagtacagaatctttcctcggctgaccagcaacggtttgctaccattattcatacggtagcggaacttctgataacgggtaagggtttacaaccgagcgagtggacggtcacaacgcttagtgagattatgtttggaccgtttacgcatttattagatgacagcgaacgggttcccgaactttttcacctagtaccgtttgccctgacggcgttattcacttatctcgccgaccaccagttgttacctgctgccaccgagctacaggcgtgggtccgcaaccagcacaccgccttgaccacgatgtatgatcccaagttagaacacttctttgaagagctaacggctgcgatgcaacagcaggggattgatacgcgtgatcggcaagccgttgatgcctttacgcaggattatttgcgcgcccacccaacgactagtcgggctttatttatgaccgatcatcaattaactcagtcacatccagccaagcaattaaaatttagccaaaagaaacggcgtaagcgccgtcgtaaataagtttaatcgtcaaaaaaacgcgtagcccaattaagggttacgcgtttttggttaagccgctatgattcatcggctaagctgtcaatcacgtcttgggcgacgactggatcagaagcatacggggtatctaccccattgatcttttgatatgcgtcttcacccttgccagctaacacgaccaaatcggtatttgtggccgtggtaatggcttgggcaatcgccgtttcccgttgggcgatgatcgttgtcttgaccttcgtatggtcaatatgactgtcaatctcacgggcaatggccattggatcttcatgtcccggatcatcggtcgtcaggtaagcggcatcagcatagtcatttaatgctttagcgaagccttcacgccgatcctcacctttatcaccagtgctccccaatacggcgatcacccggtggtcagggaactgcgtatgcaagaagctcagcaaggcattcatgctgccccaatcgtgggcgtagtcgatgtagacggtcccgtgatgcttggtggtaatggactccatccgaccagggatgcgggtgtgtgccaatccgtattgcatgtcagcgacctgcgccccagccagatgactggccagaatggcagctgccgaattactttgattgaaatcaccggggacggaaacgtcgtaggtggtggcgagagcggctaagcgctcatcgtgcaccgttaagtcgaaatgactgtccgttagcgtggcttgtcgactggtgattgagagggatgcctgtgtctgattgaacccgtaagtgaagatgtgttcggggtccgttgaaactttggcggccgcatagatctcaccaaagtgatcggtttcggcattgataatgcaattgcgtgaatttaacagtaactgcattttgcagaacaggtagttggcaaagttgggatgctcattgaccccgatgtgatcgggtgaaatgttcaagaagatcccaacatcaaaggttaacccgtaaacgcgatcaagcaaataagcttgtgacgcgacttccatcaccaaaaccttttgaccgttgtcgacggcttgtcgcatttctttgaacaggtcgaaagattcggccgtggtcaaatgtgcccggtactggtcttgtggttttggtccgacgatatggttaatcgtagaaaacatcgcaacttgttgggggaaagcgtgggacaagatgttggtcgtcaaatacgttgacgttgtcttacccttggtgcccgtatacccaatgacaaacaggtcgttttggggaaagtcaaagtataattgtgccgctaaagacaaggccttgcggacatttttaaccaagatgaccggaacagacacgccgtagtcttcttcagctaaataagcagttgccccgttttcaatggcactgtggagatagtccactgagaagttgaaccccttacaaacaaagagggtgttcgcttggacttgccgcgagtcataagtgaggcccgcaaagtcagtgtcgtccacttgcagcgttgtgttccgtaagagatcatgttcttggagtaacgctatcagttggtttgctttcatgcaatggcctcttttcgtggttagtcgtttggacgcatggttgggaagagcataacgtcacgaatagatgtggaatcagttaataacatcgtcatccggtcgataccgatacccagaccaccagtaggcggcattccatattccatcgcttcgacgtaatcttcgtcgataccgtgggcttcttcgttcccagctgcccgttcagcatcttgggattcgaaacgttgccgttgatcgatagggtcgtttaattcggtaaaggcgttaccgtattcattaccatcgatatacaattcgaaccggtcggtgaaacgaccatctttcgggttcttctttgccaatggtgaaatttccagtgggtgaccgtagataaaggttgggttaatcaaggtatcttgaaccttttcttcgaagaaggcgttgatgatgtgaccgactttccagtaaggttcacagtgaatgccgttttcttcagccaacttgtgcgcatcttcatcagacattggttgccagaaatcgattcccgtaacgtccttcacggcgtccaccatgtggagtcgcttgaagtcgctgtctaagtcgatatccttgccttgatacgtcaacttgccagatccgttaaccttgttagccacgaaccggaagaggttttcaaccaagtccatgacgtccgtgtaatcggtgtaggcggtatagacttcgaccatgttaaattcagggttgtgccgtaagtcggtcccttcattccggaagtccttgcccaattcgtagaccttttcaaagccaccaacaatcaaacgcttgaggtaaagttccgtggcaatccggagatataacggaatatcaaaggcgttagagtgggtgataaatggccgggcttcagcaccaccagcttctgtttgtaagacaggggtgtcaacttcgaggtagccttcaccgtccaagtattcccggatggctttcttaatcttagtgaccttgaggaaccggtcaaagctttcgcggtttgagatcagatctaagtaccgttgacggtagatcgtttcggggttggttagcccatgatatttatcaggaagtggccgcaatgacttggagaggaattcaaattccgtcatccgtaatgtcaaagcaccggtgttggttttaatcacataacccttggcaccaatgaagtcacctaaatcgagggttttatatagggcgtaagtttcttcgccaagttcgtcttgacgggcatatccctgaacaacaccagttctgtcgaggaggtcgatgaacccagctttaccgctaccgcgcttaccggtgatccgacccgcaacagcaacgtaatgtttgtcttccatcaactcttctttatcgtacttatcgtatttttcaatgagtgactgactgttgtcagttctgtcgaagcggtgaccgaaaggcgcgatgccctgttcttgtagcttgttcattttatcccgacgaacctgcatttgatcgttcagatcggtcggcgtggcattatttttgctgttacccatgttgtgtcctcctattagtaattgtttccaaatttcaatgaatccagacctcccttaaatttagttgattttcatagatttagcaagcctaaaaggcgatgaaccgcgagaaaccgctagaattttcatagcagtttaaccggtaccgctttcatttggaagatctcgtgatggcatgctaaaatgggcgtgtaactagataggaatgaaattatgcgaaaattgattcgtcagctgtggcccctgttgatgctaggtttcttaatcaacacggcttacagtgtgatgtggccattaacgaccatttatttacataatcagttacgattgaatttagtagtgagtgggcttatcttagcggcctattcgggctgtaatgtgcttggcggttatctaggtggcgtgttggccgaccggtattcagctaagcgggttggtgaggtcatgttactgggcctactggtggatgctactgtgggtattttctacaatggcttgatcgcctatcccatagtgctggtcatctttggcttgctgaccgggggcatgctcacgttgatttcggccttgacggcgcaactgagccatgcggatagccggctattcaatctgctgtatatctttattaatttaggattagtcgtggggacggctagtattgggtttttatttcaccatagtctccggcccatcttcgggttactattgatttgttatggtggcgccattggcttgtggcattggcgtgctgggacgtatgaacagcaggcagaaatcccggtgacggtcagagacgaaccggctgaagcaacggccaccttgccattttccccgctcatgattgtgggattgctcgtgagccttgtcttgatgtggctcacatacgcgcagtggatgagtaatgtttcggtgtatattcaagcagagggactggggatcaagctctatagctacctgtgggtgtataacgggatacttctgatggtggtgcaggctgtgatggcccggttcagtcaaccacggtttttaatgcgccagattattggtggtctactggcgattggtgggtctttcttactcttgaccctaacgtcaggcaccggcgctttatttgctgcgatgacgctgttaacgctgggtgaagccatctatgtgccaggggtgccggcactgattaatgcgcagacggtcggcgatgagggacgttatcaaggattggtcaatgcctgctcctcactaggtaaggccgtgggaccggtagttggtggcttagtaattggccaatttgcctcgttttcagtgctgtttttgggatgcgccgttgttgatctgctagtcgttggtggattgggactgacccggtatcactatcgaaccagtgaagcgtctcactaatttgttcagaaacagctaattatgattaattgtagcgcagttggggcagtcttgacctcagacaatcaaaggcaagtgtcaaaattagtcttttttgacacttgccttttactgtctaatgacgtaaaattaattttcgtgcataataggttttgttccattgagatcagttatgacccgttggtcaagtggtttaagacaccgccctttcacggcggtaacatgggttcgaatcccgtacgggtcatcttaataatgggctatagccaagtggtaaggcaacgggttttgatcccgtgatgcgctggttcgaacccagctagcccaattgttacgcctttcgtcgttttatcaggtcatctggccttgatatgacgactttttttgtgcaattaaatgagcggtgttattaagcatgagtcaggaatgctgtggacagcaagatgtgctcaccgtggtgtttcttataagttggtgagtcccattgaaatgagctgccatagtcgttcaaatctcaccgtataatcgggggaataccaacttttacgaaagctggggagtgtaaattcactaaaggccgcgaggatgatctcggctcgcagataggtggcatcatgaaaattcattagatcgtcaatcatcttcatcgaagataaaagaacctcccgcagaatggccggatcattttcaacatataaagtatttaattcaaacatttgggggctgtcgcgataggcagcctttttggcgtttgcaaattgccacagccagtcatgtaagaagttcagtggattgatcacggttgacgcaacatggatattttgcaaaatggcctgttcaaaccagcgtttggcaacggcgaccataatggactgcttgtctgggaaatggcgatacagggcaccgtgggttatgccaactcgatcggcaatatcagtcaaccgcacgttaattgaagcggtttccagcatgatttgttgggtggcgatgataattttttctttggtttggtttgacattggctcacgctccaaggaattaatagttggtaaaaagtaacaatattagaaaaaaattacttaatgacgtatactgatacttaaattatagatatgaggtcattggtatgaaagcggcacaaataaaaaaatatgccaaaaaatcacgcgtaacggttgaacaagttccggtccccaagatcacgccgactgaggtcctgattaaagtgacgtatgcagcggttaatccacttgaagagttgattacctcgggtagcgtgcgactgattcaatcatatgatttcccgttgacactggggaatgagctttctggcattatcgttgctaagggaagcgatgtaaaggactttgaaattggtgatgctgtttatacacgactgccacttcaaaaaataggcgcattcgcggaatttgtggcaacagcggcaatggctgttgccaaagttccacgaaacttagatatggctcaggctgctgccgttccattgacggggctgacggcctatcaaattttccacgaaatattgacagtctccgcgggagaaacggtgtttattcctgggggttcaggatcattcgggcagatggccattccaatcgctaaattattggggttaaacgtgatagtgagtgggaattcatcggccgaaaagcgttctctggaagcgggcgctgacaggtactttgattatcgtacaacaaattattgggaagtgctatccgatgttgattatgtgatcgacactttagggacttccgaactagagcatgagttaagcatcatgaaaccaactggtgcgttagtgtcattaagaatgggacctaaccaagcatttgctgagtcgcagtcgctaccattttggaaaaaagccatttttaaattagctggtagcgccattgaccgtaaagctaaaaaggcaaatgtcacttatcactttgtcttcgtgcatgcagatggggccgctttaaagcaaatcactgatttagtcgaacacaacggaattgtaccggcaattgatccaagaatatttacgctagaccaagtcactgatgctttggcgttaatgtcaacgggacatctatccggaaaagtattgattgctatggatgcgtaacagcaacagcgaagcgccaccacacattatacagaggataataggatgggattctcacagtttgagaatcccatcctatttttgcgttgcgtccaagacctgatctgatcgtttataaatgctggtcacacgctttaccgcgcacacttagaaaaaggccatgttaactagaagtgcgccatacataaagttgaaagtgtctatactaaatttagggccaacggagcacacttaacctgaacttacggacagaattaggagatgggatgaatggaatccagaactaaggaaaggctgggggcaacgttgcagcggctaaccgatgatgaacaatttgatacgatcacggttaaacggctagttttggaaagccatgttaatcgacagacattttattatcatttccaagataaatttgattgtctgcagtatcagttcgatcacgaggcacagcggttggtggggaaagtaacggccgacaactggctggctagttatctgagcttgtttcgctacattgatgcgcatcagaacttttgtcatcacgtcgtcgattctcatgcttattcggaatttgatgattttattttggaaacgatcgatctgatcgtagagcgattaaaacagagtctgaagcaggcatgtccgcagttacatttccgcaatgaatcgggtctattactatttgagtatggcttacaggggattgttcgcaattggtttcgcagtggcctccgagaaaatccggctttggtcgttgaggggatcggaccggttagccagcggcaattggccatgttattagaaacagaaagtctgctcaccaaagtatcagtcaaacaacaactggcatctgtctagcacttatacataacccagtctctgtctattctttatttggtacgtcagctctactcttagggtgttaacacggaatcaccgttggtggtggttcacaattattcggccgaataatgagttcccaaattgaaaccgctgtcacttgtgcttaattgacaccgcttcgtttggttgtgaagggattgtgtagcaagtggatgaaaataagtctgaacagcaaattgatacgcaaaaggcaaatcgaataacgggctttcagttattttccatgacgacttccatggtcatgacggtttacggttttgcggcatttgctaagcaaggaccaaccgctttcttttacctgtttttagccgggatcttatggtttttaccggtgactcggacctcaggagagatggcgtccatcgatggctggagtaaaggcggtatctttacttggtcacggaatatgttaggtgaacgcgccggttggtcggcattattctaccaatggattcacattacggttgggatgaatacaatgatgtatttcattatcggctgtttttcggtaacgtttggcttacccattatcacggataacccgttagttaagtttattttgatgatgatcattttatggggccttatctttctacagcaaaaaggaacgagtgttaccggtaagattgcccaatggtgtttcacgttaggggtgattatcccagtcttcttcttactctttctatttattttgtacctcgtacaaggaaacccagcgatgattcacgtcaacatgcacaccatttttccatcgagttggaatgggagtgtcttagtgggatttgttccgtttatcttggcttttgccggtgccgaagggtcggcaccacacgttaaggacttggataaacctagcatctatcctaaggtcatgatggcactagcagttgctgcgatctgttccgatattatcggcagtatggcaattgctatgacgattccgaataatcagattcagttaagtaatgggattgtttacgcctatggggccttagttgcccgctatggtgtgggcgtggtctttgtcgaaaagctaacagggttcttattagccgttggtgtcttgggtgaaatcagtagctgggtcgtgggtcctaacgcggggatgtttgaagcagccaaggctggctacttaccaccgcgcttctctaaggccaataaatatgggattgaaaccaatgtcatggtccttcaaggggtcatcgtgtcgattgttggggcgctgttgacgtttggggctggcggggacaaggcgagcctttccttccagactgcaatgagtttgacggtagccttatacaccttgatgtatatgctgatgtttattagttatttggtcttacagttcaagtatgtcgatttgcatcgggactttgtggccgctaagtcgcgttggttgcggatcacttacggtatcctagggtttattttatcggcctttggatttgtcgtgaccttcttcccgccagcagatttatccgttgcctcaaaacacacgtacctaatgttgttagtgagtgcctttgtggtcatgctcgttttgccatttatcttgtaccgtttccacgacaaatgggccttgcagctaggtgtcaatgtggatgaagtggcagcaccgaccggtcatgaggcgttggaaaaagaaaccaagtagtgaaaaatgattaaggaggcaagccatatcgcaatacggatatgacgactatatgatgaataaaaacgatcaggaaacacggcagatgattaataatgtggatttagaaaaaacgtttttaggcagtgtcgaagccgggcaatccttacccaccaatacattaccagatgatcccatggcaccggatgttgccgctcaattggtggaacactatcgtttaaatgaagccaaggctaatcaaaacctagcgaccttctgtaccacgcaaatggaaccacaagccgatgaattaatgaagaacgcgttgaataccaatgcgattgataaatcggaataccctaagaccgcggcaatggaaaattactgtgtcagcatgattgctcacctatggggaattcctgacaatgaaaagatttacgatgatttcattgggacctcaactgtaggttcttctgaaggatgtatgttaggcggcttggcgctactacatagttggaagcaccgggccaaggcagctggttttgatattgaagacctgcatagccacaagcccaacttggtcatcatgtcaggttaccaagttgtttgggaaaagttctgtacctattggaatgtcgagatgcgccaagtgccaattaatggtgaccaagtttccttagatatggatcatgtgatggattatgttgatgaaaatacgattgggattatcggaattgagggcattacgtacacaggctccgttgatgatattcaaacgctagataacctcgtgaccgaatataataagaccgcgacgatgccggtacggattcacgttgatgctgcctttggtggcctgttcgcgccgttcgtcgatggctttaacccgtgggacttccggttgaagaacgtggtttccattaacgtttcgggccataagtacgggatggtttaccctgggttggggtggattgtttggcggcacaacacggctgatattttacccgcagaaatgcgattccaagtgccatatctaggtaagaccgttgattcaatcgccattaacttctcacacagtggtgcccatatcagtgcgcaatactacaatttcattcgatttggattatcaggttacaagacgatcatgcaaaatgttcggaaggtgtcattgaagctgacggcagctctgaaaacgtatgggattttcgatattttagttgatgggtcacagctaccaattaactgttggaaactagcggacgatgcgccggttggttggacgttgtatgatttggagtccgagctggctaagtatggttggcaagttccggcatatccactgccaaagaatcgcgacgatgtgacaattagccggatcgtggtacgcccatccatgaccatgacgattgccgatgatttcttggatgatttgaaattagcaattgatggattaaatcacacatttggcgtgacgaccaccgttgatcaagataacaagaccaccgttcgaagttaattcgggcagctgaccggccgaacggcgagtaatggtgagttaatagaggaggaaacaagcatgagtgagaattcgacagtgaaaaagaacgtgagagtgaggtatgcaccgagtccgacaggtttcttgcacattggcaatgcccaatcggccttattcaactacctgtttgcgcggcactatcacggaaccatggttttacgaattgaagatacggatgttaaacgtaacgtcccccatggtgaagatagccaaattgataatcttcattggttgggaattgattgggatgaaggccctgataagcccaatcccaagtacgcaccgtatcatcaaacagaacggcaagacctctatcaccgttacattacacagctgcttgaccaagggttagcttacaaagactacgcaacggaagatgaattaaccactatgcgggaccaacaacgggccgcgggtgaagcaccgcactacgatggtcggtggtatggtcggtcagtagccgatcaacaggcggcggaggcccgcgggttaaaacctagtattcgcctccatttgccggcgaaccatgaatacgcttgggatgacattattaaaggtcatgtggcttttaactccgacaatatgggcggtgatttcattattgagaagagtaatgggatgcccacttataattttgccgtggtcattgatgattacctgatggatatcacagatgtcttacggggagatgaccacattgccaatacgccaaagcaaattgcggtgtatgaagccttaggcttgaagcacccgaactttgggcacattacgttaatttataatcctaaaacgcgtaaaaaattgagtaagcgggataaggaaacattacagtttattagtcaatataagaaccaaggctatttaagcgaagcaatcttcaactttattgcctttttaggatggtcaccagaaggcgaggacgaacttttctcacgagaagagctcattgaacgttatgatccagccagaatgtccaaatcgccagcctactttgaccaaagcaagctggattggatcaacgcggcttacattaagcgcttagacctcgatgatatgacggatcgggtactggaattggtcgacgagggacaaacggatgtcgctaaacaggtaaaggcattgcaattacctgacttacggacattaacgtctcaagtttgcaaaatctatcaaacggaaatccaccagttgagtgagattatggataaggttttgttttatgtgacgattttgcaggaaccactggattatgatcaattacggcaattcgatcggacggcaaccctagcggtactaacggcctttcgaaaacatgttcaggcactgcctgtagatgtcgcaacaccggactttaaaaagatgattcaaaccgtgagtcaggagacgggcgtcacaggtcgtaacctatatttcccactgaacgtggctttcacgggcgatcattcggcaccacaaattgatgaggttctccggttgtttgccaacagcaccattattgaactcttaaccaaagccattgcccatgtttaatggctactcataagaagctatcctcctcaaaaggaattcgtcgttaatggcggattcctttttacagttgagcagatctgtctagggaccggaccgaaatcatacgtactttgctttatttttacgatggttggtgtattgtataattaaccaaataatagaagggagcgttcaagatgtatggtagtgttttgttagcagctggtctgggttattacctgtttgtatataaaggcgtggaccggactcagcaaccacaacagtcggttcaacccgtggctcatgagtatccaaccacccgggcagatgcgttgaagtactacctgcaggcgaagctcccgtgggggacgtccctaggtgaaatgtatgtgtacgcgcgatcttttccccaaaacgagttaccgactgagaaaagtcgagaagccttgtttaagcgatttaagcaaaacgtgaaccgtttacgagaagctggtgaattaccgaagacgccattacgctacattgataaggttgacctgtcattagaattgacgacggtacgggtgatgcaccccgatgatgtggtgagcctctataagcggcaaatgcggtatttggcaatgtttacgcgtcaggctaatccgttcgaaactttacgacaattagttgaaaagtcttcattatatggtcggccatctggaccaaccgttcaatcaccggaacgattttcaggaaccttcgcgttatttctgcaagactactatttctcacaatacctgccaacgcgtaatgaatggcacatttatgtggcccaacaacagcgtaaattggatgaagttgaacacgatatctttacttttctgaacgatggggctgaccaaccggtgaccaatcaggcggggaaagtggttgtgacttgcttttcgacggtgggattggagttaattgccaacttattgaaaccagatcgaacgattgtgccgcaattggaagtttatgaacgggcttttgatgatggtatttggcagaattattttccctatacatgggcagaggttaatcgtaaagaagcaagtgtggcattacagcaatgggctaaacgacttaaataaatggattagagaggagtgtgggtaaccacctccttttatttatgtaaatctagcgtactttatcatagcgtgttcaattaaaagtacggttataccgtatcgtttcatccgatttcaatagcaatatacgtcattgaaaaatacttggttttttttcatattttagttgacgtgtcggtgctcacttggtatagttatatacgttgtcacgacgagtaaccaactagaccaattcgaaaggttgaaattagttgttgacaagtaagacgacgatatgatatattaattaagctgtcgcattgagatagcgaatcaacgagaaacgttgttaaatcaaatttcttgttgacatcaaatcagcaacatgatatgatgattaagttgtttgcgagagcgaacacaagatccctccaatcatattagaaataatcaccgaaactatatcatataggaaacgttaagtcaaagtataaaatttgaaatagcgaagaagaaggcatacactaaattaaagttaagataatcagaagaccgagtgaaacgaggtcaatgtgcacttacaccccactaaatacttgttgggtaaatcgtgctaaagacttgtatcagaagtcgccgttggcgacaacaaaatcaaccaatagatccaaagaaaggcggtgactagtatggcaatttttcatatgagttttagtaatattagtgctgggaaaggacgcagtgcgattgccagtgccgcttatcgaagtggtgaaaaattatttgatgatcaagaaggtcgccactatttctatgcccgatctgtcatgccagagagttttattttaactcctaaaaatgcgccagcatgggcgagtgatagagaacaattatggaatgaggtcgaaagaaaagatcgacgagcaaattcacggtacgcgaaagaatttaatgtagctttaccagttgaactaatcgaagatgaacagaaagaattattgacaaaatatgttcaagaaaattttgttgatgagggcatggtagctgatgtggtaattcatcgcgaccatccagacaatccgcatgctcatgtgatgttaactaaccggccgtttaattcagatggaacatggggaattaagagcaaaaagcaatatattttagatgagaatggcaataaaacatataccggaactagcaagtaccctaagagtagaaagatactgatggtcgattgggataagaaagaaaaaataattgaatggcgtcataattgggcagttagtgtcaatcaggttttagagcaaaaaaatattcccgagcggatcagtgaaaaatcatttactgagcagggaatagatgatacaccaacccaacacgaggggattaatagtaatcggtatgaaagaaaagaatttaaccaacaagtaaagaactatcgcaaagccaaagccagttataaaaacaaccaagaaaaagcaatcaatagaggtcacttagatagcctaagtgaacacttctcgtttaatgaaaaacgggtggtcaatgagttaagccatgaactgaaaacttatatcagtttggagagtttagatgataaacggcgcatgctatttaattggaaaaatagcaccttaattaaacatgcagttggtgaagatgtgactaaagaattattgacaattaaccaacaagaaagctcattaaaaaaggcagatgaactcttaaataaagtggtcgatcgcacgactaaaaaactttatccagagcttaattttgaacagaccacacaagctgaaagacgagaattaattaaggaaaccgaaagcgagcaaacagttttcaaaggcagtgaattaaacgaacgtttaatgaatattcgtgatgatttattgacccagcaattattgacctttaccaagcggccatacgttggttttaagttattaatgcaacaagaaaaagaggccaaaattgatctgaaatatacgctaatgatccactctgatagcttagaaagcctagaacacgtcgataaaggactactagaaaagtattcaccagcagaacagcaaacgattacgagagcagtcaaagacctacggacaatcatagcagttaagcaagtcattcaaacgcaataccatgaagtattgaaaagagcctttcctaatggtgatttagatgatctttcactagttagacaagaacaggcctatacagccgtgatgtactatgatccaactttaaagccattaaaagtcgaaacaatggcacaatggcaagaaaacccaccgagggttttcagtacccaagaacatcaattagggttagcttatttatcgggacagcttagcttagatcagttagagaatcatcacttacaacgggttttaaagcatgacggcactaaacaactctttttgggtgaatgtaaagtcgatccaacgattaagaacagtcagattgagaaaatccaaaaacagttaaaagagcaacaagctaaggacgatcaatatcgaaaatcccagctggcacattatcaaccgttaaattataagccagttagtccaaactactacttaaagacggcctttagtgacgcgatcatgactgttctatatgctcgtgatgaagattaccaacgacaaagacaggcgcaaggtttaaaagagactgagtgggaaatggcgaaaaagcaacggcaacaccaaactcgaaatcggcatgaagatgggggcatgcacttgtaatcggaataaaaaatgcaccgttaaacctggttaaaagcggctgaacaaggcaaaacagaattagatcaaaaattgaatcataaggagtgaacgaacatgaccactgttatcttagctgaaaaacccagtcaagcccgtttatacgtccaagcctttcaaaagagcacaaaaaaacagggttactatacggttagtgaccctgttttgcccgataatacgcttgtcacgtatggtctcggacatttagttgaactagccacaccggataaatatgatcagaaataccagcaatgggccttatctaatttaccgattttcccagacaaatacaagtttgaagtgtcagctagtaaaaaagcccaattcaaggtcgttaaagacctgttaacgaaagccgataccattattgtggccaccgatagtggtcgagaagggtcaaatatcgcgtggtcgatcatgaaccaagcgcatattgatgttaagtcgaaaacgattaagcgcctttggttgaatagcctagaaaaagacgcgattattaccggctttaaaaatcttggtgattggcacaaagactatttggcttataaagaagcccaaacccgtcaaattagtgactggttaattggtatgaatggcagtcctttatatactttgttgttaagacaaaaaggggtgcgcggggtgtactcaattggtcgcgtgcagacgccaaccttgtatatggtttatcgaagagaccaggcaatcaaaaactttaagccggaaccctattttgaactaaatgcggaaattttagccaatcagcaaaaaattgtcgcaaaattagacccctatcagcgatttaaagacgaagcagggctaatgacattcatgcaagctaaacacgttcagaaaggctcacaggccggtttaatcaagaacgtccaaaagcaaggcaaaaaacgagctagtccccaactattctcactatccagtctccaaagtgccatgaataaacgttatcacgccagtgccagccaaaccttagcggctattcaaagcttatacgaagacaaactactcagttatccccgcaccgattgtgcttatatcactgatgaagaatttgagtatttagtggctaatctgacgaagtatctggggttagtctctaaacaagtcgctttaaccaataccaccccaaataagcgctatgttaatggaaaaaaggttgaagaacactacgccattatcatgactaaagtcgtgccgacgaaagagaaactagccagcttgcctaaattacagcaacaagtttatgatttggttttaagaaccacattagcgatgtttgctgatccttacgaatatgaagaaaccaccattgttacccaagtcggcgatgctaattttaaagcaaccggtaaggtcccaactaagcaaggttggcaagctttatttgatgatcacaaagccgaccagcaagaagcagccaccctaccgattgttcaccaaggcgaccaagttccagcgaatctgcaaacaccgcaaaaagaaacgacaccaccggtaccctttaccgaaggtaccctgattacggccatgaagaccgccggcaaaacgcttgatgatgaagaagcccaagcgattcttaaagatgtgcaaggcattgggacaagtgcaacccgggccaatgtgctggaagtgttaaagaaacgcggctatctcgtcactgaaaagaacaagctacacgtcagtgaagccggaattactttatgtaaagcggttgaactcgaacccttgctaactagcccagaaatgacggctaaatgggagcaagcgttacagcaaatcagtaccgaagaacgcactccggataattttttgagccaaatcaagaagtttgtggccaagctaatcgctgatgttcccacacaattaaccggcaatgcagccattaagcaacaaatcaatcaccaacagcaagcgcaaaaaaacgccgaggtgttcttagaaacaccgcaagcgaccgttttaaataaacagaagttttacattgtaaagcctaagcaaggcgaaagctttaccctgcccaagaaatggagcagtaagacgctcgggaagaccgtgatcaaagcactggtcaccaaaggggaaaccagcgaattaaagggtttcaagagtaaaaaaggaaagtcgtttgacgccaagttaaagcttgacggccataaattaagttttgattttgattagaacctgcctaccgccctgcactacgttccggttggtgaacccgtcatttaggttcactttgacaaccctaaaagtaaacccaaacaatgggtgagattagtaaagcaaaggagatcataaaatggatagtaaattagcagtcattgggagtgaattaccagttttacaggctaaaggaacctacaagtatttaaaagaaatcactggtaacggagcctattatcaagtggcttggcaaaaattagctgatggctacatcgccctttatggcacgaccccgattcaaatcaacgtagcccctatattgaatgatatttttgaagatgaggaggggtagacaatgccgagtaaagcagacgttaaagcctggaaagcacaattagtcgcccaagccgaacaacaaatcctaaaattaaccgatagtgaccgatttaaacagtatcttaataccctggctaaatttcatcattatagcgccagaaacattgatttgatttatgcgcaaaatccgcaagccactcaagtcgcgggttttaagcaatggcagacggcttttaaccgcaccgtcaaccggggcgcaaaagcgattcggattgcggctccgatcattaagaagctaacaccagccgagcagaagcatcttgataccaccgatgagcgcgccattgtcggttaccgttatctacccgtctttgacgtgtcacaaactagcggtgagccagtgttaagtgccaaggattttgtcaaagaaaatttagccgatcatcagaatgtaacgagcttatataacgcgttcaaagattatttaaaccagcaaaccgaccttaaagtcagtgaagtgcctttagcgacgctaaatggggctaaggggtattttcaacccagcactaatgaaatcgtcattggtggcgatgagcccgacaatgctttgaaactaaagacgttataccacgaatatgcgcatagccagctacacggattaaaatcagcctttaaagatcggccacgagcctatcaggaaacccaagccgaagcggttgcgtatgttgccatgcaaaatattggcgttgataccagcaactactcactcggttacgtggccacctgggccaaagataaagccgtaatccatggcgctttaagtgagatccagcaagtgagcaacaaagtgattgaacttagcgatggcttaaccaaacaattaggtttacaagaagccccaaaagagcctgcgcatgatctaaaaaagctatcagcccatgatcttaataagtcctatcaaggcttgcaacaacaagttcagcaagcaaggaacccacaacaaaaatcagaactaaaaaataaactaaatgatatacaccatgaaatcagtaatcgaacacaaaaacagctacaagcatttgctgaacagaatccgggaatcaaacaacctgatcctgaatctgatcaaagtctgaaacgttagccagtttttaaagggcatgctataatgaagtcagaaaaaggaagccccgctagaacaggacttcccatgtagagccgttaaagacggtggcagattttaacgatatttaataaccgctggctggccagagctaaggcggttatttttctaccattagtcaagtaaaacgttgattgcataggatttcatatacaggctaagcttgtatatgaggtcttttttcagttgatttgtggaaagcaatgctttgaaggtaaactaaataaacctcttgaaacgttaattttccaagatgctatactgtcttcataggctgtatgagttactgtcttggttgagacatagttggctcataaacttcattgtgcaaaactaggtggaagatcgttctatttagacgactcataaccgcgaccgcaatcttcttggttcccttagactgagaggattgctttttcatttggtagaagtcgttaaagcgtgtcggtcgatatgaggaagcactgataatattaatgactgtacggtacaagacctttcttgccaaagggttcccacgttttcgaatacgctgttcggccgtatagtccccagattggtaagtggttaaatcaataccaatatacgcgttaatggcattggcactatgaaatcgccgaatatcgcctaattccgcgataatacacaacgctgatttaagcgcaatcccaggaattgtcgttaaaattgcaacctcaggcaagtttgtaccaattttagccatctcctcaattaaagattcttttgagcggtcgagacgttcaacttcatatgctaactcggtaactcgcttaagcgcgtatgaatcaatatctactgctggccctgaactcttggccaactccaggagatgttcagctaaatgctgagcccgtttagggcccatattctttgaagtagctttcaatataattgacgttaattcggtggaactatgttgtaacaccagatatgggtgtggaaatatctgaacaatgtgccagtataaggccccctcagtcctacttagaaaatgttctatttccgggaaagtaagctgtaattcatgatgaaggcgattcttattacgcacgacgtcgtcgttgtgctcttgatagattcgatgtagatcacgtaattctgtgtattcaggcttttcttgaaacgatggtgcaaaattgtttctggacatcgcttctgccagaccaacagcgtcaaccgaatctgttttgacaattctaaaactgtccattactttcttagcttttaggggatttatctcagtatacagccaaccgttacgatgaaaaaatgcgcgccacggtcgtgagtagattcctgttgattcaaatataatctttggttccctaaagctgtttaactcatcttcgagtcgctcaaacccttcacgattgcttgatagcttaaattctttgataacttgtctatcaatcaaaacggccacattagctgtgtgtttactgatatcaataccaaatatgcattccatttgatacaccaccttttgaagttgtttcaccgactcactcatctcaattttcaatacacggcgtcaagcgccaacactcttcgatcgagctcattgatgaatctgcgaagttgccagttttttttgcgacgtctttgcgccaaaataacctccgacatgtcaactccgttaccactgtaccaaaaaagcttagtggtgaatcacaaccccgtcggatcatggttcatcactaagcttagaatgtttttttgctgacttttgatcagctcaacaattaatgcgattaaggctacgataaacgtaccgaaagccagcattaactgtaaagcgtccgacacggacacttaggctactcctttcgttaggatttatgggctttaaaggtttaacaccataagcaccacctccgattggaaatagccaccgccttaacttctctactaactttaaatatacaggaggaataaaatattggctaggttacaagaaatcatttcagaagctaaggctaatagcagtttcatttatcgagggtgtgcatttgaaaaatatgatttagttccaactctagctagaaagttaaaagcagacgtcagttttgaccaatataatatttattctgacgttgttaaaaaagccgctgaacgagggtattcagaagtaggtatgaatgggctggcagatggcctttctcaacactacggactcagcactagttatctcgactggagttattcggtctatgtagctttatactttgcattcaccagttatattaaacagtttgttaatgacaatattttggatcaacatatcgatcgtaaaatgtattgtcttagagaagaattcaacaagcacaagtattgcatatatagacttaataagaccttatatgatgagttaaagaatcaatatcctaaattaccgctaatagtatatgatacagatgataaaaacgaaagaatgaaagcacaacaggggctgctatctagcatagatagcgcaaaagtaaacaatgaggctaaaattcgaagctctcaaattaaaatattggctgattggcttcaatctaataatcctgatgattttttgaagcaatccggcaataaatactcatggaataatgaaactcttttagaaaaaataactttcgaactaccgcaaagagatcgaaattatttacaaaaatgtttaaaagaaaacggagccatcagtaccatattatttccggattttgagggtgttaaaaagaacatagagttttcagaagattataatattttgagagattgggaaatcgcctatcaagaatctccttttcattcaaaagctacaaccctagaagatttattgcaaatggcaaatggaaatcaaaaagttataaattcaagtttaaatacggatcgtctaggggaaggagaattttttccttttcaataagttagctttatggtcattagggtataccctattggacgtttttgctttgtgacatactggagtttatatacgttcattagaactgtccaaaaggaagtgttggaaatggctaacatcggttatgcccgcgtaagttctaaagagcaacatttagatcgacagttagcggctttaaaagacgttgacaaactatttacggataagttaagcggggccaacgccaatcgaccagcgttacaaaaaatgttggcctatattcgcgaaggtgatattgtcctagtcactgaattagatcgcttaggtagaaataatcaagacttaactaagatcatgaataccatacaaaataagggtgctaccctagatgtgttaaatttgggtagcgtcaagaatcttgtgtaaatgaaatgccttcgtacatataatatgttagatttaaaagattacttattccaaaaggagaatttgatgttaaatattttacaagcagttggttcaattggaacattgatcatggcaattttatatctcatttcggtaatggtacaaatcagacaaattaaaatttcttttatcccattcttggctttcgaccaaattattatagaacaagaaggaaaaagtttaaaattaagaaatctaactgaaactgatatttactatgtaaatactgctttcaaactagagaactgaaacttgaaagtatgaagacagactgatcccttggtatcacagggcatattttaattaatttaaccatttagcttgctgttaacagcgaaactaaccgtttcggcaaaaatgtgaagaactgattcattatctgaataatttgggctcttcttgcataaacttcatgattaataatcgtttttaacgaatttagaagccataccagtgcttgagacaactcaatatctggcatggcttcgttcattataaagaataaatccccaatggtgcgatcatcctgattttgccgttcctgccaagctaataggtcataagtcatcatgacaattgctaaatggccacaaagcccgtcataattttgaacttgtgatttgtcgagccgcaagtattgcttggcaactttaaagtaattctcaatttgccatcttcgggcgtatagttgaatgatctcttgtggctgaaggcctaactgagtcgttgccagtactaggtagtcatcttgacgggcccgattagccacaaataccaagcgaagcttgaatttttggttcccgacgtgcgcttcgacaaagcagctgtattgataagcttgcttgggttgatattttgaggcctgcagtcgcttgtataatgctctaactgaatattgccgtccgcgatattgatagtaaattttgctggaccgtttaagcatgcccacgccgtttaatcccaacttggttaattcatagaacatttttggtgagctataccagctatcaaataacacatagtcagctagaacgccatttgcgagggcttgcttgacaagttgcaatgaaacgaggttcattttttgctgtgcttggcgacgtctccggccagcaattgttcgttgatcggttgttttagctgattttccaaggacgttttgtggcttcttggaagacattaatgcaaagttgatcggtaagaatgtattggcgtcactccaacccaaagttaaagcccggtatcccttaatatataactgtttgtcatggtcaaagactcgcgctagtaattcggtttgggtggcgtactcacgggaaaagagtgtatcgtcaatgatcaatgctaaccgccgccggcggtcaataaacggtcgtaaatgcttgattaaatgactcacaacttgacaaatcaagcgttgccaattgatccggccatcgttcaaattatttctgacggtgcgactggtaaagttaggtgtttcatgggctcgataaagcgagcgtcccaggaactttgtcgtgagcagccattcaatgaccttcatcaagctgatttctgaatgccggcgataattcaccaacttggtgagtttagatagaccaatgagggaagtaaattgatgaacaatattgtgaagctcgttttctgtatttttttgtcttataatattcatgacgtaagtctcctttgtatcttggttttggtcgactaaagtatacaacgcaggagagcttgcgtttatttttttgccaaaaaagccaataaccacacgcctttggcgtgattattagctttcaagtttcagtttattaatccaagcggaaagaatgacgaaagtaataactaatcccaactggcttgttaatgcaatatttttctttttgtgctgatcaacgtaaactccaataaagggattgaacaacagaatgatgcctggctctaaaagttgaaccaaggtaaatactcctgcattgtggtatgtatgtaataaaagcaaacttacagaaaacataaacgtggatgaaccgatttcggaaaaaaaagacgtccatcctgccgttattagttgtcttgaaataccttttgttttttccataagtatcatcctctttttttattggaataactataacattaaaaagcgatgaggttaatacaaaattaagaaaaagattgacattatattaaaaatgaattagaacaaaactaattcaaattaaaggaagcgataataatgactgaaaaggataatcagcattttgttagtgcggccaatcttgaggctccaatcagtaatgttgttgtcgaaagaggtgtattcttgtccgttaagtgtttatctactgttgtgaaaattacaccgtttgataaacacaagttttcgttggaataaatgacgataccattagttgtggcaacatcaaagcaactgtttcgtatcgtgtgaggatgatgtgcacttaatttagttgtacattgtttgttgtaattaaatagcagtcctggacgattaccgtcgaggactgctattttttggacttttgaaagttagatgcgcttcttaagttccttacccttttcttcaaacccaggtttgccaagtaatgcaaacatattctgcttgtatgcttcaacacctggttgattgaatgggttgataccgtttaagtaaccggaaatggcaaccgcaacctcgaagaagtagatcaaatatcccaatgtgtatggtgtttcgtccgggatgtgaacggccatgttcggcacgttaccatctgtgtgggcgaggactaccgcatggaaggcttcggtgttggcatagtccatcgtgcggccttcaagatagcctaagccatccaagttgtctttttctttagggatgtcaacgtcgtggtttggcttatccaacttgataaccgtttccatgaggtttcgcaagccttcttggatgtattgacctagggaatgcaggtcggttgtgaagttggcagatgatgggtaaattcccttttggtctttaccttcggactcacccatcaattgcttccaccattcggcgaagtaggtcatgtttggttcgtagttttccaataattcagtggtgaagccttttcggtacaagatgtttcggtaggcagcgtactggtaagcctcgttcttggtcaaatcaggatcgctgtattcatcggcagcatctgcggcacctttcatcaactgttcaatgtcagcaccggaaacagcgattggcagcaggccaactgggctcaagactgagtaacggccgccgataccatcggggatgataaaggtttcataaccactggcgtcagcttctttgcgtaaagcaccgtgagctttgtcagttgtagcgtagatccgttctttagcgccttcttcaccatatttggcgatgagacgttccttgaagattcgaaatgcaattgaaggttcagtggtcgtacctgatttagagatgacgttcactgagaagtcacggtcgccgatcaagttaatcagatcataaacgtatgaggagctcaatgaattacctgcaaacatcacttgtgggaatttgcgctggtcatctggcaaataattgaagaaagtatcattcaagaagtcaacggccatcttggcaccgaggtatgaaccaccgatcccgatgacaaccaagactttggagtctgactgaatctttttagcagctgcctggatgcgggcaaattcttctttgtcgtaatcctttggcagagtcagccagtcacggaaatcgctgccggcaccagtgcctttgcgtaattcattgtccacagcattcactaatgcctgcatttcaccgagttcgttgtcgtgaacgaactttgataattttgagccatcaaaagaaatatgagccatattattagtacttcccttcttggaatcattcaatgatttaattataaaacacaaatggggctaggacaaaaagcatttgccccagccccgtttgttaaccactgttatctagctgaaacgtgttccgacgcaactaatgctaacgtgtaagaccaaaaagctttaaatccaagaccaggatttaaatcttttcggtcttacacaccgcatcacccgttgctcgtcacactctgtcctacaggatttggcagaactcgattgtttcttcgttagggccaaggatgttgaagaatttaattcccttatcccagaatgaaggaatggattgaatttcatcattcaccatgcgtaatccctgagctttggcatcagcgaaagctttttcaacatctggtgtattcagtgaaatatggttgattgcaccagctttacgagcagttggatcgccttcccaagtttcaatggttaagttgccaaaacgcatgaatgcgcagcggttctcaccgttatggaataagccggcttgttcaaagccaagtgattcataaaatgcgattgttttgtccaaatcaacggatggaattccaacgtgttgaattcctgtaatatcatctttaattgccatgtttaattgcctctttcatattaattgtgtaaccgcgttcatttacgaggaaacccaagcccaaggaacttccagtaaaaaccagggttgatttttaataaagcaccttgggcaaatgtttgttagccgattttgagattccttcggcttccgaaatacgctccgacggccgggtgaagccctgcctagcctacttggcgacggcccagatgctaacttctaagtgccctttaattaaagtcccaaagtcagggactttaatcaaaggacccttagaaaccgcatctcccgggcctcgtcgcgctctaatcttttcccacgtccaaagcttgatgcttcaggtgagggaagaccttagtatccgcgatcccggtaattccgccttggaataagaacgcaaagatggttccgattcccaagttggtgaattgacgagtgattgcgaaggccaagattgccatcagtgttggtggaatgtatgatgcccacatcgctgtgttggcatttcctttgaaatacttgaaacgcagaatctgcatcaagtcatcggcggggtgcagtaccaggttgacccgctgataaatggagatggcagttccgatcattgcgacacccaagaagttcaagaggatataaaatccaatcatgaatggcgtcttggctggtggaaaaccaccaaacaatgccgggtacttaccaaggaagaagtcttcgaatacttgaatcaacgctgagaagggaaccatgaagatcagatttccaagtgcgcgccgccaatcccagtgtccaaccaggatggcatttaaaattgtgatcacgaccccaagaattaagaatgtccaaaatagattccagccaaacgcaactgccaggttggcttcagcggcggtccaataagccgatcccaagtaggaagggtggatttgggcgctggtaaccaaggtaagcacgtttccggcggagttaatcaccaaagaaatgatgaaaaacgtaatggatttagacatcgagatcgtccggccatttagaacttggctggcggtttcctcattatttttcaaactagtcacctactttaacaactgcctttgaaacgcctttagtctttccttgcaagaatggttcaacttcgtccaagtcgaagacgttgctgatgatggcatcaacgttcaagtcaccgctttggagaagggcgattgagtcttcgaatgcgttagggttgatgaatgaaccttgaacagttaattgcttttggtaaatttcgtaagtgttcatttcgaaatgagcatctggcttaccaacaccaaacatcaatacttgagcacccttacgagtagcttcaacagcttgttgttgagtttgtggtaatccaacggcttcaataacaacgtcgtaatctgaaggaatctggtcacgagtggtgttgtaagtgttggtaacacctaatttttcacggttcaaatccaatttttcgtcgataattccggccaagtcaacttggtggacaccataagactgaagaatttgagcgaataattgacccatgaagccatcaccgataaccaaagctttttggtatggtgttaacttaagcaagtcgataccatgaacggcacatgagatgggttcgataacggctgcatctttcaatgaaacgttatcaggaatagggtaaacgtttgtggcaggagcagtaaaggattcttcaaggccaccattacgagttacaccaacggctgagaggttgtcacaaagttctggacgaccagtgtggcagtagaaacatttgccacaatagatgttagggtcaacagttactcgatcgccaactttgaagccgtcaacatctgagccaacttctgaaatgacacctgagttttcatgaccaaagacgattggaggaacagcatctgctgaacctggaaggccgttataaagggcgtggtcggttccacaaacaccagcataagcagtgtcaacacgaacttcgttaggctttacttctggcttgtcaatgtcttgaatttccatgtgttgttttccagtaaatacgagtgctttcataatataaaaaatctccttttaaaatggcagattgcaagaaataacttgaacgaatttaatgacgtaaattaagcaagaagatctcgattggtgtatgccaattaagacatttaagtggccgtgaattcagataccaattgatttgaaccagttggtaatcacttagttcttcaatggcttgtcccttgggaataaaccgtcgcaaaactcggttacggttctcattactaccgcgttcatgtggtgaataagcatgggcaaaataaacctgagtacctgttagctgttcaattgtctggtagttagcgaactctttaccatgatccacagtaagcgtcttgagcttgtcttgaagttgactagctagttcaagtacggcttgagtcatgaactgactgtcgcgaccatggagccgtttaacaattgtcaggcgacttttacgctccacaaaagtagccacagcttgacctttacgtttaccagaaagtacggtatcagcttcaaagtggccgaattcctggcgagtttcgactttatgaggacgcttctcaattgagcggccgtgactgaacgtaccacgcttttctttagcacgatgacgacgaattccatgatcaggcaaatcgggtagctgtacatcaagccatccttgatcaatccagttatagaccgtcttgtaggcaatccccaccacatgggcaacttgttcaggggaccacttctggacttgaatcttttcctcaatcaagtgtttaaggtttttagtaagcgaagactttcgcccccgttgactaacctttcgttcaaagtcagtttgcgctagctcagcctggtactcaccatttagtcggtgaagttcgttaaagatggtggtcttactaaagtctaagtagttagcgatgtatcgcaaggaacgtccttcattatgaagcgtttcaatgacaacacggttctggaatgataaaatagtggtgctcatcaaggtccttctttctaatggattgtgtggtaacaccattaaagaccttgatgggtttttctgtccacttaaatgttcaacttaaattttacaatctgccaaattcattcgttccgcaaacgtttgtggaacttcccaaaaaaataagttgttacttgttgtattctttcaaagctaaagcaaaatccccgacggttgctgaaccattatccttgaccaatggcatcacgatgtatttatcgagatcgccaacgtcaacgtagttattcatcaactcattaaactgctcgcgaaccttcttcaagaattcttcgctgacaacgccaccgccaaagacaatcttggctggacgcatcatcaaagtgacttgaattgcggcttgggctacgtagaatgccatgatatcccatgtgtggtctgaaagtggaacatcttggcctttcttaccggttcttggttcgaacgttggtccggaaaccaagccttccaaacaatcgccatggtaaggacagatccccttgaaattcaggtcgtctggatgacgtttcaatcgaacatgtcccatttcaggatgtccgatgtcgccaacgaagttaccgttgataattgcaccagcaccaaccccggtaccaatcgtgtaatagaccagcgaattgatcttttcgttgaacagcgttgccatgacgtattcgccataagcggacccgttaacatcggttgtccaactaatcgggatatcaaaatcttctttaattcgacctacaaaatccgtattggcccagccttttttcggggtatttgtaatgtacccatacttaggcgagttcttacggagctcaattggtccaaaggaagaaattgagattgccttgagatccttgaactgcttgaaataatcaacagtcttttgcaaggtctcttttggcgtagtcgttggaaattgtgtccgatccaagatgcgataatcttcgttaccaacagcacatacaaactttgtaccaccggcttcaacactacctaacaacatgtaaatctcaccaccttatgaaattgtgtccatcaagttacttgtgaatgcttgttcagtataaaacatttttgattgaagtgcaaggggtacatggaacatcggtacgaaaagtagcggtagcaaaaaacgaacagtaaagctatattagcttttactgttcgtttttatttttgtgtttagtattaatttttttcaattgtaaacgattcacttctcggtaaaacgttcctgatgaaatctgagctgcctctaaaacttctttaactgaataatccccactttgatacatacgaatggcaacatcgagcttttcttgggctattcgtggccggcccattttaacgccacgcttccgacttgcctcaataccctctctaactcggtcagctaataaattgcgttctagttccgctataacgctcatcatctgtagcattgcacggccggttggcgtttccgtgtcgatgttttctttcaacgaaacaaacttaatttctttatcgtgtagtaactgaatgaggtttaaaatatctagcgtatttcgacccaagcgggagatactttctaccacaaccacatcattggctcgaatcatctgcagtagttgcgtaattccgggacgttcctttcgggtaccagtcattttttcttgaataatgcgctcagcgccgtagtcggtcaactggtcaatttgacgattgaggttttgatcatcttttgaaactcgtgcgtatccaattatcatgatggactccttaattaggttgctgtattaaaattgaactatcttttggcactgtattattataaacttttttacaatgagtttctaaaactttaaaacgttgttatatcaacctatttcaataatagtgaattgtttccagaacctttagtttttggaactatggagaaatgatatgagaagaaaaaatcggctcaagcaagaatttggtattttcgaaggtgtcccgtctgatgatcaactacggctgtactttcaactaacagactttgacaaaacattaatcggtcaaatgagattgccggctacacgactaggctttgctgttcaattaggcactgtgagattcttgggcacttttccggccaatttacagcaagtaccgattgaagttgttaactatattgcactccaattaaatattgatccaacgattattggaacctatacgcgtaaaatgacaattacccagcatatcaaactgataaaagaacagtatcattaccagtcttttagcgattcaaaggttaacgatcgactaactaaatggctgcttgaacgtgctagatatacaactgaaactgataaaatgctctttgatatgctattaaaaaaatgtttagacgaaaagattctgctcccaggaatgagtacctttgaacgttttgtgggcggagttgtggaggatgcggctaattggttggatgatcagctagttgcgattcctaccgaaacggagacaacacatcttttaggtttattgacttcggttggcgatgttgtttacggcgctacgattaaaatggatttattgagaaacccgctaatggacgaaagtcgtaaggaacttcagcgtggattcgatcgtctaaaacaatttcaacagtttaaaactgaaaattggcagttagagtcagttccagcgggtaagttaaaaaatttagcaaattatgcatttaaggctaaagctagtttcattaaacgaatgtctaaaaaacgacagttagcactgttagttgcctttgttgcagagtataaaaaacgggcaatggatgaacaattactcgcactatcacacttctatgaaataacgtttaagcgcgcaaaaaacaaagaggctaaggaacgtctgcgtaccattaaggacttggatcgagcagcatcaacgctttccgaaattgtaggcttatttatggacgaatctattagcagtcaggaagcaagagctagggttttagacacctattcccctgaagtgattgaatctgccagaactcaagttatgcagctaactcataatgagcaggaacccattgccattgaagagttactaagtacctatcgtaaatttcgtaaattcattcctaatatcttggaaacgattacatttgaaggcactgttaacggtcaaaattgtttgaacgtttgggaccttattcggcaacagtttccacggccaatttcgtatcatatgtttgaaaaaatatcggaaaatttttcaaaaaaatggcagtattacattcaaaagaatccaggagtggtcaatcaatgtgttctgattgcaggtattgagttattaattcacggtttaaagcggcatgatatttttgtacgtcaaagtaaccgttatattgacccgatgtcgaccttaattgacgaagttacttggcaacagcaaaaaaatattttagtccaacaacttgatttaccagctacaggtgccgaggcagtgggcctagaataaaaagtgtacaagttgaatagagactctgatttagtataattaaggaagtaaattggaggatcaaataatgacgaagcacagttatgacaaggaatttaaggaacaggccgttcagtattacttagataacaaggatcacatgaccatgaatgaaataagtaagaatctaggtattggggctagtacattacataaatggattaagctgtttactgagactggggagtttggccgtggctctggtaattttgccagcgataaggacaaggagattgcacgactaaagcgtcaacttcgtgacgctgaaggagcgatcgaagtgttaaaaaaatcaatcgggattctgagcaagtaactaccgaaaaggtataccaagaaatggacgttcagcacgctttggaatcccacccttccatcaatggtatgtgtgattacgttggaatctcaagaagtggttactatcaacgagaaaagcgtcataatcaccaatcaccgcgaaagcttcggaagaagtttattcaaggtgaaattaaagcaatttggctcaaaagcctttgtatttacggtgccggcaaaatcacccaagaacttcgctcaaaaggatataagatcgctgaacgaactgttggtaagtatatgcgtgaacttggcattcacgccgtttacctaaccccttggacgactaccactcgcaattctaagtttgataaacagctaataaatattttagacgagcagttcaatccattgcgaccaaacgccgtttggtgcattgacaccacttatatttcagttcatgacggattcgtttatttaaccagtattatggacttgtactcccgacggatcattggttgggacttatctgaaaccttggaggtatcgaatgtcatcccacttattgaaaagactaagcacagtcgccatattagcaagccattaatcatgcacagtgatcgtggtagtcagtttacgtctgaagcttacaatcaagttacagctaacatgacattaagctattcaaagaaagcttatccttgggataatgcctgcattgagtcgtttcatgccttgattaagcgtgaatggataaatcggtttaaaatccattcatactccgaagctaaacgactagtttttcagtacattgaaacgttttacaacacagttagaattcacagtcactgtggattcaaatcaccaaagcaacttgaagatgagtatcaaactcaaattcaaaatttagtcgtggcataggacaaaaaagtctctatttaaattgtctattttattgacaggggaccacagttacgtttttgacgcaagatttagcactttcgtacgaagaaacactcaaaaattgggatagttctgaaatggcaaaaattacagaagttgatggacgtgacaaaattacgattaccaaattacgcaaggttcggattcgaaaagacgaaatcgcatttagacaacgtgtacggacccttatgcctaaaattgatttatcggatttgttattggaagttaaccaacaattacagttagcacaatgcttcacccacacgactgaaaaagaaattagaatgaaaaatattgatattagtattatggctgttttgctggctgaagcgtgcaacatcgggctcgttccagtatctaaagagagtccgaatagtttaaaattcgatagacttatgtatgttgatcatcaatacttgcggattgatacgctatcagcggccaataatcgcattattagcgctcataaaaagttgaagaactcaatgatatggggcgacggccaaatggcgtcagcagacggtatccgctacgtaatgccacagcgttcgctatactctcgtagtaatccaaaatactttggccgagggcgtggtatcacgttttataattttgtttctgatcaatatattgggttccatggcatggtagtaactggtacgctgcgtgattcgttatatttactcgaaggctttttaaatcaaaccagtagcttaaaaccgactcaaattatgaccgatacagcaggatatagtgacttgatttttggtttattcggattattgggctttcagtttagtcctagaattgccaataatcaggcaaccaagctatggcgaattaatccggttgcagattaccaaatcttaaacggtgtttctcaaaatcgtatcaacacacatttaattgagacgaattgggatgatattttacgaattgccggatctttgaaggcgggtacggttaacgcaactgaactcacaaaagcgttacagcgtgaagggcagccgaccactttaggaaaagctattactgaatacggcaaagtatataaaactaaacaccaactgcgatacatttcggacgatatctacgctcgtcaaatcttagaacaactgaataaaggagaagcgcgtcatgcactatgccgtaatattttttatggtcgaaaaggaaaactctaccaaacatatttcgatggtatggaagaacaattaaacgcacttagtctagtcacaaacgcaattatttactggaatacgctttatctggagaaggttatcgaccaaatgcgcacagaaggtttcgactgttcagaggcgatggtcgggaaactatcaccgctgatgtcatttcatattaattttatcggtaagtacacctttcagtacgatgaacgactaaaagatggtcatctacgaccgcttggtgatgtagatgaaatatagtaaatgttcgtgtttttaaatcactaccgctacttttcgtaccgatgttccatgtacccctaagtaagctatcaacaggaaaaagtatagaaccttttaaattagatgttaaataggcgcattctgagaacacgttcaactttaataactggggttttcccatcttctcgctcttttctttgcgtagaatttgaaaataggagaacaacaggataaaagatatgatagtcaagacggtttcatttaatcaaatatatttagtatatttagtatatttgatatattcgttgtggttcgtgatagataaagaacagcaagacaaataaatatagctagtatattaaatatactagctatatttatttgtcttgtcgcatatcataaattattttttcggagtcgctaagagtatcacggtaagcttccatggcgactttgacaacttcgtacatcggcatatcttttgcatagctgatatttcgaaccatatcggccaccggaggatcaacttgtataggctgcctgtctttggctttatattgtttctcaccataagtaatctttgcatcgtcatcaataatagtgggcttgttcctattgtcttctgtgttttgtttgttgttttttttattcagcaacgccatttatttcgatctccttgccaagtggtaatgtaatattttcaagtgcatcaaaatattttgatttataagtaaagttttcaacatctccagttttctcgaaagaggaaattcgagcttctaattcacaaaatagatcggcaaaaagtccaaacatttttcggtcattataatcttcaagcgagacgccatcttcgccaaaattttctaaacgatcatgatttttaataatagtatggaatacgttatcgcgtccataaacttcgacagtctctctgtaattttcaatttggcgcttcttgtgagaagttaaaagtgcgggtaatacacctgcaacttgaaagtgtgcttcttcagggaaattatctagcattggttgtaaatactttccaataaagttacttgttccttccatcgccattttacgaacttcttgtacggcaatgatataatcagaagccataattattgcatcaacaactgtatcggtggaaggagcaacgtcaaaaaaaatatagtcgtaatcgtatttgatttcgtctaccatttttgtcaaatataaatatcggtctcgtttactcttcgagttatcgataatcgtatcagtaagttcgtgttcagcaattgaacctgcaatgaaatcgagattttttgttagtggaaagattgcattttttaaagttccactttgtacagcctttacaaaggactgtgggaaatgacgctgattaaaagttctttttacattacttgtagtattagcttgcaaatcgacatcaatcaagagaactttttgattgaacaatgaaggtttacttgccgttattgcaagaaggtcggtgtcagtggttttaccgacgccacctttcatatttgttaagactacaactcgtccttttctcattgtaattacctctcaaaatatatttagtatatttaatatagtagatatactcgctatatcgaatatactaaatatagcaaatatagtgagttttgtcaaaaatatattttgataagttcacctttacatcatttctttgctcggttatactctaggtatattcaaaaataagagaatacaaaagagaataaaagaaaagcaccacccaactgcaattgggaagcgctcgacaacatctttttcaactaagaagattataccagcaaaatggtaagatgtcgagaatggtgtgatttcaaaacggtaggggacaagctgccgggtaaaaacaaaggggacacgtgtggtgagcgacttctgtgcaaattcactggatctagttaattagatccgtaggcggtaatttaaaaatttaaaagtttattcgggggtagtcggactacgtccaccttaagcaacttggcataacgctaagttgcttttttgtctgcgctttttcggtttctatgtcatttctattaagctaacttaggtgtttattttgaaaggaggtgagctcaccatgtacgatttaaagacggttcagactgcacaaaagctggtattacacgattcattacatacctataaagttaaaaatagtcgttctaatattgccggacaagtgatggaaactcctacaaaaaaaggggccattgcgctcttcagcagtaaagattcaatgcaaaaagcacatggtgtcgtggtcacctcttttgaagcacttgacgccatcgccgatcgtatgactcactggacgcccaatacattcaactggcttggctatacgcaaaatcggtcgagtgttcggggacaccgggaaaataatctggcgcaaattaatagcctggtcgttgatattgattttgccgacgcacaagaacgagacgcgcgtgagcaagaggtcttgggggccgtaaccgttgctgacttattcattcccacgatgattttgcggactacgaagggattccatatctactacgtttttgatcagcctatgtttttgcggaaaacacgcggtatccgtcgttgccgctgaatccgtcgttgccgctgaatccgtcgttgccgctggtgcagcttccgacaacaaaacggcctgtcctgaaggcaagctgactgcatcaacactagttgaatcagcgacatcagtgttcgtcgctgcgccaaacagcaagaaactctgatctgttttgtgcaactgcttaattaaacgacgataccgttgccgagatttagccgttgtctgattccaatgcagttgccgcggcacctgagtaaccacaaatggccgataatctggtacatctgccgtcgtcgtttgtcgctgggccgttgttgccgttgattgctgcggtttggcttgctgtaacgccgcttgtgccgatgcagccgcctgctgctcacgttgtcgttctctttgttcacgtagttgtaagcgttcaccacgttcttttcgtaatctgacttgtcgctccgagcgttcgtcagttgtatcatccatttgttctggggtcggttttactggaaatttacggtaaaaggccgggccatcgtagtgttccatgtgtttcttcctcctagatgagtaactctcatcaaaattcatcgctaccgggaggagacgccgctgtaaacggctcgttgactcattccctatttctcgttttatctaatcgattacctgttccactgacacacgatcgtcagtctattccattgtacacaaaaaagcgggtcgccgacaagggctgacccgctttgtaatattctttcttaagctttaaagatggtttggcctcgttcaaaatcaaacggttcgccaacttcataatcgtctggcaaaatcaaagcaccaggcttttgtggcgcattagccagacccagttctcgtccagaacaaatcatcccgttgctggatacgccccgcaactcgccaggccaaataatcaggccattgggcatcatcgcgccaaccttagcaacaaccaccttaatatccgcttgcatgttcggtgagccactgacaatttgcaaagactcatcattgtccacaactgtttcggtcactaataaatgatccgaatccggatgtggtgtggtcgactttacataccccacgacgaatcgtgacgctgtttcggccactagttcaccagaaaatccggctgcttctaatgcggcattcaatgcagcaacatccgcaacggacaatgcgacttgcccctgacccgtaatctctggtaggatttcactaatggccaagaaattataccccagcgttttttccgtttctggatcataaatccgtgcgacattgtctcggactgtgtgtgcttgggttggtgtatctggtgccacaaccacaattaatgtatcccccaactcttgggggttgtaactagcaattaacatgtttgaatcctttccaacaggtattagttggcgttggttgtcaaagaattgataaattcttctacctctgcttttgtcttacgatctttgtttaccaaccgaccaatctcttgaccatcggcataggcaataaaacttggaatgccaaagacattgagttctgcggccaaatcgatattttcatcgcgatcgacagcaacaaacttaaaatcagggtattccgcttcaatttcaggcatggctggcttgataaatgcgcaatctgggcaccaagttgccgagaagaacagcatcgttttaccagatttaaccacgtcggttaattcagtcgctgacattttgggtaattgttccatgaagatgcactcctttattttaagtttgaaaattatacaagaaccattatagcaatctaccagaaaatttacacgatttttgcctttttacgggaacttcttggcaatccttgctatactaggggcagaagtgatggaaagtgtggcccagtaacacgtaacttaaggaggcggtagtatggctgctaaaaatggacaattgtatcaattaagcctaaccggagtgttgggtggattaatgggcgttttcatcacacggttttttggcggtacgtcacgattaaaccctgatgacatcttggaacaagtcaaacgacaattccgtgaagagtcgccaattgaaggcgcttggattgagaaacacgcagttcctttccaaaagtttgccgttaaatctcgtgtttattacgggggtatcaatcgctacgaagacgatcaacttgtccagtaccaattcatcgccgacgccgctaccggaagtattttggatattcaccgactataatttaactgaccttgacgacaccattttaagtagtgtcgtctttttttgccaaaaaactgacagtggtcgcatcatccgaccactgtcagtttttgattatttcgcttaggtccgtgaccgcttcatttgacgtcctttgataagatacagaccacctaaccacacgattgataagcctaacgcaattgctgtatctagttggaaaatcaaaataattgcgaccagcatcagtaacgccaacacaaaatagtcagcccacgggaaccacggtgctttgaacttaatctgcatgtcatctgtcgttcgccgatatttcaggtgagtcaagatgatactgccccaaatgaacaagaaacaggtcgtggccacactggaaactaacgtaaagaccatgtctgggaacaataagttcaacaccacggccaacgtgataaccagcgctgagaagttcaaggcatttccgggaacttgatgcttcgacaactgattcaatttcattgtcagcggtcgcttggcatctttggtcaacgaagaaagcatgcgcccagtcgtgaagatggaactattgcaggctgaagccgctgccgtgataacaacaaagttaatgatatccgctgccgcctgaatccccacgtttttgaataccatgacaaatggactttggtttggcaaaaccgtgttccacggataaatcgtcatgatgacaaataaagcgccaacgtagaataagataattcgcaaaggaatatcattaatggcccgtggcaatacccgatccggattctgcgtttccgcggctgtcatccccaccatttcaataccgataaaactaaagaccaccatttgtagggataataagaagccagatgcgcctttgggaaagaatccgccaaaggccactaaattttgtaacgaggcatggcccaccggcgtcttaagccgcatgaagagcataccgattccgacaataattaatcccaagatggcgacaatcttaatcagtgcaaaccaaaattcaacttcaccaaacgcccccaccgtgattaagttaatacataatagaactgccaaaacgaccagtcctggtaaccattgcggcacggccggaaaccagaaacggaagtaaatcccaatggccgtgatttccgccattgcgatcgtgatccaacaaatccagtacgtccagccgacaacaaatccaacgcgttcgccaagatattctgtcacgaaatccacaaacgatcgttgatttgtgtttgataataataattctccgagcgctcgcatgagtaaaaaacaagctactccaacaccgagataggccagcaaaatggatggacccgcttgttgaatcgacttccccgatcctaaaaacagtccggtaccaatcgttccaccaatcgcaatcaactgaacgtgccgattcttcaaattacgcgctggagctgtcggttctgttgccatatgacgtccccccttttgcccatctagttaacgtttaaataagtgtgactaagtccgtagcggaaacgccctgacttgcggcaacggctgcctccgttaagtgacccgcataagtgttaaccccagttaagattgtcgcattgtgtttagctgccgcttcaatgccctcatttgcaatcgtcactgcatatggaatggtgacgttggtcaaggccgcagttgccgtcttaggaacagcacctggaatattagccactgcatagtgaacaacgccatcttttacaaacaccggatcatcatgggtcgtcgcgtggtcggtcgttgcaaatatgccaccttggtcaaccgggatatcaaccaccacggagccaggttccatcgattgaatcatcgcttcactaaccaattttggtgctgtatgacccggaataaggactgccccaatcactaggtcagcagttttaatggcttgtgccaaattaaacggattggaaatgagcgtttgaatgttgccgttaaaagcagtctcaatttctgccagtcgtgccgcattaatatctagtaacttgacgtgagcccccaagcctaaagcaatctcggcagcattgaaccccactgtgcccccaccaacaatgaccacgtttcctttggctacaccaggaacgcctgccagcaagacacctttaccaccatgattttcttctaaaaagtgtgcccctacttgaacggccatgcgcccagcaacctcactcattggcactagcagcggcaaccctccacgaggtccaaccatagtttcgtaagccaccccagttaccttagccgcgagtaaggcctgcgttaattgaatatccggtgccaagtgaagatacgtatacaaaattagtccctcatggaaaaagtgatattcttctgggactggttcttttactttaataaccaagtcacatgcccaagcctcggttgctgtccccaagatcgcaccagcctgttcgtagtcactatctggatacccagcaccctcacctgcatgatgttcaacgataacctgatggccagcatgaactagactaaccacgcctgctggcgtaatcccaacccggttttcgttgttcttagtctcttgcggaattccaactttcattttcgttacccccctaatatttgactctaccgccagtataatgatttttgcccacaactactggcctaactactcgttgacggctggttagttcactaacctgaacaaaatcgtggtctaacctttaaggcccagcttgatgctggccattcaaaaataaagacagcaaaaaaagagctcgggcaaccgccacgaactcccttgataacctttatttagttggaactttttttaaccgcgtcacctggttgtgtaggtccgtccgtacgaccagcacgtcacaaaccgcattagccaccacgtaactggctgttgaccctagtagcatgcgttcaaccacattcacacccgttgcgcctaacataatgaggtccgcctgatactctttgggtagcgacttagccaagtcaactttcgcatgtccataaaagacagacgttaccacccgctcaacaccggcttcttgagctttttgccggtattggtcaactaatgcttctagtgcttgacgagactcgtccatcacttgctgatcaacgtaaccaaagccgacctgcgtattatttcccaagccaacataatctccaccactcataatcgtgacaatgatcaattccgcttggttacgtaacgcaacagcaatcgccttatccagcgcccgtttagcctgtcgcgaaccatcgacacccactaaaatgtgcttatattctgcaaccatgttcaccactcctttgatcggtttatcttaaccaaccttatttggtgagttcaaaaatagcttgaccgtaaatcgccattgctttgagtaaatcagcttctggctggaattcatcagcctgatgcatggtatcagccgtgccggggaagagcgcaccaaaggcaacgccacgcttcatcaagcggccataggtcccaccaccaacaacttcaggttgagcttgcatatcgccggtctgttgccgataaacatccattaacgttgccacaatcggatcgctaggatcgacatagtgtggcaccatttcacgtccttgctttaattcaacggtcataccagcagtcgcttgcgtcagccccgccttgatttgatcagcgccggtgccagtcggataacggaagttggtattgactaatccagatttgcctgccgtgaaagtcatcaccccaacgttcatggtcaagtcacccatgaccttatccgtgtaagcaatacctaattggtgggcccgtgaatcgtcatgtaatttgtgcgcaattaagctcagaaaatcagccgcatctttgccaaaatcatacgtcgtcaagaaactggccaaatacgttcctgcattaatcccattcttaggttccataccatgagccgccttaccaacaacctggaaatgcactcccatagcgtcgctcgtgacacttccagcaactggtgcttggtccaagaaagttgaaaagtcagccatcatttgttcggcattatccgtcaccacagtagcctcggcatcacggggaaccatattttctcgtaaacctgaatcaaaggcttgaagaaaatctgctgatccattttgaccaccgaacgccgtcgtaaaggtcacatttcccttttcaccattgattaaaggaaattcggcatcaggtgaaaagcccagagttggtgctggctccaaatcaagataatgattcatccccgtccagtcgctttcctcatccgttccaatgatgaaccgaatcttaatcttcggcaagattccttgatctttcaacatctttaatccgtagtaggcagctaacgatgggcccttgtcatcagacgtcccccgaccgtacaagttgccatccttagctgttaaagtaaacggatcagtgtgccatcctttaccggctggcatgacatctgcgtgaccaagaatcgccaaggtttcttcgccctcaccatattccacatagccaactacattatctaaatttttggttttaaatccatcgcgttttgcaagttctaaaaacgctaataatgcttttgctggtcccggacctaaaggatagtcgtccgtcgccaaagaatcatcacgcgcgctatcaatgccgactaaggtggttaaatccgcaatataggcctcccggtattgtgctgctagtttttgccaatcaattgccatgattggacctccttcacttttattcggacctcttgtccaagattacttatcgttaattttagcataccgccagccaattgtaagccgatttcatcgaacaacatgctatactaaacgtgagattgaggaggtcgatgttccatgcaagttttaactgaaaatattttaacaacgactattcgtcaacgaccagcagatagctataaggggacttacggtcgcgtaaccttgataggtggtaatcgcaactttgggggcgccatcatcatggctagtgccgcagccgtttatgccggtgctggactggttacaaccatcacagacgccagtaatcaaagcagtttgcacgcgcgattaccagaagcgatgtttgctgacatacaagactttacgcaaactcgtacactcattcggcacgctgatgtcgtcgtcttaggtcccggtttgggaaccgatacagcagcgctaaccactttaaagcaagcctttcaggcaatcacacccgaacaacacgtcatcctcgacggttcggcgatcaccctagtggctgaacagcacttacccctcccacaggcgcacattatctttaccccgcaccaaatggaatggcaacggcttagcggcctcaaaattgctgctcaaacgcccgctgccaacaagcaagccgcggctaccatcggtggtattgtcgtggtcaagtcacatcgaacccagatttacacacccaccaacgcttatgaaaatcccctagggactccggcgcaagcaactggtgggatgggcgacacccttgctggaatgattggcggctttgttgcgcaatttgctgattcatcagcggccgtttgtgcggctgtctatagccatagcgctattgctgaattgttagcccagcaacagtacgtcgtcttaccgagtcaaattatcacggagctcccccattttatgaaagtccatgagcataaagacgtttaaaaacaggcaacttaccgcattgaagtggtaagttgcctgcttaattttatttttcaagtgaggaagtggtagccggtgtcagcaaggcatctatctcttgcggaaataatccccgataggtgcccactgccagatctggagataacttgattggcccccaaccaattcggttaatggcaccactcacgcgactaagcgattctaaccacgctgtcacactatccagcgctgttgtttgcaaggtcagcatggtccattgatgcacctgatccggccgctgttcaacgacctcggccgcaatattttgaggaagcgttaacggcgtggtcccagtcaattgcacccgtagtgtacttggccaagtttgaccctgaacctccgttaagaaagtattatcgtcagtcactagcgttagcccagcaatggtcctaggcagatctgccaaaatttgcagtgactgctgttgatccagcgcatttaacatacttcctagactgtgcggaacgaccggtgtcaagtctgtctgcacgccgactggcttgttaaaaaccaaatattgtggtcgccggccagtgacagccaagccatcaacggtcacctgatccgacgtatcgaccgtttctcggggagaatcaatcagtcggtcgttaaccttcacccggccttgacggagtaaacgaaaaatctgccccggggtcccctgatgatgttccgtcaaataacgttcgatattcatatcactgcctcctaatgaatgtgcaaccgacgacgtaatccagcgacccgtgagcctaaaatggtatctgctaaccgtgatcgtagaaccatataaacgtagaaataaccaccaacacaagcagctactgccacaattaagaaattaatcatacggccttcactccctaacaaactaccggcaaaggtaatcaaccgtgccaaaatgaacgtaccaatcgacatgatcagaatcccattagtctttttagcaatatgggcaaagttgatgccaaattggcgatccaaggagtgaataatcagataacaggtcacggtgaacccgataccggtcgcaattaagggaccaaaagcaccaaggaaataaaccagtggccattgcacgataaatttcacaaccgttcctactaagaagtagcgaacggcgcgtttattttgtgagataccttgcatcaacgctgccacgactgtgtagagaccgagcaagatcgacaggtaagacgaaaacgccagaattgacgcagctaacgcttcatgcgtccgaccatagaagaccaagtttaacggccgcgcaacggctgccatccctaacgcactgggaatcatgacaaactcaaacatcaagaaggcattagccaattgatccgaaatttcctgcttattgcccctagtataggactcagataacaacggaacgaccgtaactgccagtgcagaagccagtgagatagtaatcatgattagtttattcgcgtttacgccaaataacgcgaatagatcattcaggtatgctgcagagtagttgcctgccatatgcataattggggcaaaggtatattggtcaatcagttggaaaatagtgattcccgctcccagaacaataaagggcacggcctgggcaataatttctcgatacagctgattggctggaaccaccatttcattattactattcgcaaccaaaccacggaagtagccccgacgacgccaataatatacgcctaagataatcagaccaccggccgccccaatcgctgctgcaaacgttgattgggagactgccgttacccagttgcctttgagcacccgcataatgacatacgccgttagtaacatataaactacccgaaccagttgctcaacaaattgtgagatggctgagggcgccatttgttgaaagccttggaagtacccccgcgtcacactcatcgttggaataattaagatggcccaggccaacgagtgcagcaccggaatcaagtgggcatccccaccagtaaacagcggcgcgccgaagtacatcaacgaggcaatcgcaataccagtcacaacggcaatttccaatccccgtttatataaccgcacgctaatcccatactcattgagtgcattataatgcgccacttgtttagcaattgctgagggaacccccgcgattgcggcaattaggaagaaactatagatgttatagcctttcccatacagtgcatttccttgcagataaaatgcaccaaaccaaatattccacggaataatgtacactgcaccgagtacccgcgaaaaaatacttcccgccgtcatccatgctgatcctgcaaccatctgggcttgtgcttggttgccggattgatctgaccttgccgccatttgacaccctactttcaatttgtaaaattcaacgttcactgtgcttgatcttgccaagctaatcaaagaaacattataccatagcttgtctgaggtaaggctcagatttccgtaaagttttgcatgacttgtgaaaaatgccctaacttaccggatattccaaacagtggtattctagacgtaggcaattgattcaagattattcaaggaggaatgtcaatatgacgcaggcaacagctagctctaccgcaacacccacgatgcaaatgtcgccgaaacgggcgcaacaagtcgtaaaaatggccaaaggaatccgccacaattttcctgagtttacgacgatttcggatgcacagttgatttatgcaacttggcggagcttcaagcagattgatcaaaccaatgatagcgactatcagacaatggccaaagtcttcttccacgaattcgaccaacatctcttacactaccaattttctaaagcggggcaagaaacgatgattcggcaacgtttcttcgcactgctgactaacctgctttaacctgaactcccaatcgccaatcagcggttgggagttatttattctcatcgatgactgcggtatacttaatatcgaagcgattaaaagataggtgaggcgattcttttgcattatttagctttactggggagtcacgaaaaaaacggcatcactgctggctacttacaagccgtcattgacgcattacccactgaagcaactgtggataccgtttttttgcgtgattatgagatctaccccgataccaaggaacgggcttgccccgctctggatgaaattgaagccaaaatggctgctagtgatttttggatcatctgtgcaccaacatactggggtgggctgtccggcgtaatgaagcagttctttgattgcatgcgttttcggctagtccggatgaactccgtagctgataccttacccggcaagtatcagaataaacactacttaagtatgactacctgtttcattagctctgccgacaacttctttactggcatcacggatcaaacctttgtcacgattgatcgtgtgttgagtggcgccggtctcattaaagttggtgaatttgttggaactggtacttggggcacccatgccccgcgccccgaaaagttggctgagtgtcaacgttgggggcaaaaaattgcgcatcggccgcgaaaggatgataatacgttgaaacgctacatactcttatttttcatgattgccatcatggccctcatcacaatgggcttacaagcttggtggttcggcgtcttcgctgctggcaccttttggctgacctactgcacctttgtcattattttttatgtcttactggcaagtattctgcatttcttcacctttgtgcgtcaccggcgtcgttaagattaactgcttaaccccctgtttttgtcagatcgattggtctgataagacaaggggttcttttttacatatcggcttggagataggccgcctgcaacgaggttgtttgggttagtgccattaacgcctgtgggctgccagaaaagacacagcgctgattagccagtagagcaatgtgggtctggtctacgggtaaattttcaaactgatgcgtggttaggatcaccgtcttacccgctgctggtaactgacaaatttggtgcatgacttgcgctgcaactttaacatctaacccactttccggctcgtcaaaaagatagagttgccgttgcaaatggcagaccccttctaacatcactaatcgtcgttgaccaccagataaatgacgaaatttggtgtgtgcaatcggttggagggctgccggtaaatcagcggccgtgacggacaacgacggatcatccagttcaagcatcatttgtaaggtttgtagcactgtcgtcgccccggtaaacgggaccccctgcatctggtaagccacttgttgcatcggtggaaaatcatgaaaggctgctacttgcttgttgggactgacgcccgcaatgaaatctagtaaggttgacttgcccacaccattaacgcctaataggatatttatctgtcctggcatgaatgatattgacaaatcctgaaaaagttgccgcttgtccggaagctggtaagagaaattcgtaatatccataactgaccgcctcctagtaacgacttgtattcgactgcagtgacatgtgctgaacccaataatagcccgtcactaagtaaacacctgcaatcaccaccaaaaacagaccgttgcttcctatttgccccggcacacgcaacaataccacactgtacacagcgaccatataggagccgggattcaacgcaattaagagtcgcgttaaccactcatcttaatagttcaattatggcattttgattagctcatttcaacgaattttaatctttttcttattttatattataagattaatttactcgttagcaactcatgaacccccagaacgctttggctgggcatctatccttggtaacgttggtccaagttctattcaaaaaacagagtacctcatcaggattcaccctgataaggcactctgttcgatgcttgtatctattcgttcaacctaatttgcgacaatgttaaccagcttacctggcaccacaatgaccttccggaccgtcttaccatccgtgtgaacttgaactgtttcatcagccaaagccgcagcttcaatcgcatctttagtggcatccttggccacttttaggtgcgctcgaaccttaccattgacctgaacgactagttccacaacatcctcaaccaattgcttggcatcgtaagttggccatttagcataggcaatcgtttcgtcatggcccaacaatgaccacaattcttcggcaatatgtggcacgattggcgagattaatttgacaaaaccttccatgtaaatcatgggtaggctatcaaccttgtaggcttcattgacgaaaaccatcagttgtgagatggccacgttgaaccgcatggcttccaaatcttccgtaaccgttttgaccgtttgattatagattttatccaatgcgccatcattaatcattgtgacccgatcgcgcaatcgattattgtcgtcgatcagcagacgccaaacacgatctaaccaccgccgtgacccattaatgccttccgtactccatggcttagaggcttctagtggccccatgaacatttcgtacaaccgcagtgtatcggccccgtgtttttccacaatctcatcagggttaatgacattgcccttagacttcgacatcttctcgtggttcgttcccaagatcatgccttggttaaccaatttctggaatggttccttagttggtaccacaccaagatcgtacaggaacttgtgccagaaacgtgcatacaacaggtgcaagacggcgtgttccgccccaccaatgtacagatcaactggcatccagtacttcagtttttctgggtccgcaattgcttgatcgttggttggatcaacgtagcgcaagaagtaccaagaactccccgcccattgtggcatggtgttggtctcacgcttacctttacgaccgttttcatcaaccacgttcacccaatcgtcgaggttggccagtgggctttcccccgtgccagatggttcaagctgcttggcagctggcaatttcaatggcaattcatcttcaggtaccaaggttgtttcgccatcttcccaatgaatcacgggaattggttcgccccagtaacgttgccgtgagaaaatccagtcacgcaaccggaaattgacttgcttatggccagcatcatgttctgtcagccagtcaatcgccgcactgatcgccgtttgcttatccatcccattcatgaaatcagaattgatatgcttgccatcgcctgtgtaggcagcttcagtgatgtcggtatccgcatcgccttcaataacttgcgtgattggcaagttaaatttcgttgcgaattcataatcccgttcatcatgggcgggtacggccataatcgcccccgtaccataagaagacaggacataatcaccaatccaaattggcaatttcttaccactcaatggattaatcccgtaggccccggtgaagacccccgtcttatccttgttcagatccgttcgttccagatcagacttactttcgatggcttcttggtaggccttaactgcgtcggcttgttctggtgttgtaatcttggcaacggccgcatgttctggcgccaaaaccatataagtcgcgccaaatagcgtatctggtcgagtagtgtaaacttcaatcttggtatcggcttggccatcgactgggaagaagacactggctccctcggaacggccaatccaattacgctgcatttccttaatgctatctggccaatcaaggtcatccaaatcatcgattaaccgatcagcatacgcggtaatcttcagaacccactgacgcattggtacgcggtaaacgggataaccgccccgctccgttttaccgtcgatgacttcttcgttagccacaactgtcccacccatgaaatcaggcgcccagttcaccatgatcttatcttcgtaagccagcccttttttgtagagttgttcaaaaatccactgtgtccacttgtagtaagactcatcagtcgtgttaatttcacgactccagtcatatgagaatccgagcgaccgaatttgccgcttgaagtttttgatattgtgcgccgtgaagtccttaggattgtgtcccgtcttcaaagcgtactgttcagcagggagtccaaacgcatcccaccccattgggtgcaacacattgaacccttgcatccgcttcaagcgggccataatatccgttgccgtatagccttctggatgacccacgtgtagtccttgtccagatgggtatgggaacatatccatcacataatacttaggcttagtttgactatcgctagtctcaaacgtgtggttagctcgccaataatgttgccatttacgttcaataatctgatgtttatatgccaaaatgcgtcgctccttttcatttctacgtcgtgccacaaaaaaagcccccagaggtccaaaaatggacttctgtagggcgtctttgcgcggtaccacctacattccccaatcagtgattgaggcactcaccggctgataacgtcgccagacgcccaccttgcagcagaaaaaactcagagacaagttcgttgacgctaatcacggattcacagcacccatccgcttgctgaacactagcatcaactactacttctcgtcaacgtttagatcaatcaaattgttttcatcttagcaaaccccctaaggaaaagcaaggggcgccaccgcttttacccaattatttccgaaccgctgtgctatacttggtttacgcaacctgataaccaactttcatttaaagccccatcgttatcagactttacgacttcaggaggtcacttgtggtaactatttcacggacacgctggcggttcacttgggcagctggcagtttatttttaattgcgttattcggcgtcaccacccatcagacttggttaacggagtttgaccggctcatcattgggtgggtccgccagccgctacctcgaccacttacccgcagtatcatctggataaccacttctggtaatccgcaatctgtcacatggataacccttttactggccgccggactcgtcattattcggcgctaccgggccactttatttctcttatttaacgttttaatttttgcgggtcttggtaacagtctcatcaaacacctcgtccgccggccacgaccgaccgttgaccgcctcgttaatgccagctcatatagctttcctagtggacactcaattacggcgatgctactctgggggtccaccattattctactgagcggattattacgtcagcatcccctgtggaaaaagagtcttattggtatcttaagtgtctggattgttctaattgggttatcacgaatttacgtgggcgttcactatcccagtgacgtggtcgctggttggaccttaggtttcgtcctacttacgttaagtcaatggtttttgacccgtcatggagatgatttaagttgaatttagcaaatgcactcacatacagtcacaccctattaaaagaatgtgtcggccctggcgctaccgttatcgatgcgaccgtgggtaagggcaacgataccgtctttttagctaatctcgttggcaaaagtggtcacgtcattggttttgacattcagcaggcggcgttagatgccacccaacaacaattgactctaaccgggctgagtcagcaagtgactcttcacgcggttggtcatgagcaggtggctgcctacctggacccagaaacgccagtggcggcggcaatttttaatctgggctacctcccgggcggcgataaacagatcattacccggccagaaaccactttacgagcaatcaaagcactgctcccccacctacctcgtggtggtcgtcttattctggtcgtctacgccgggcatcccggtggtcaagccgaacggcaggccgttttagatttttgtcagcaattgccgcagaagacctatcaggtgctccaatacggcttcattaatcaaatccacacgccaccgtttttgctggcaattgagcgccgctaacgatccttattcgacactgagtagataattaatttttgcaaaagaggtgaacgaccttgtggcgagaaatatcaaaggcactatctgcaaacaacctcgtcaccatccatgttgtgggtggtgacagttttaccatcgaaagggccggtcttaacactgatacccaaatgattatggccagagatcaggctggtcgtgtttatatagccgatcctcaccaagtaacttttatcgaagtcacccatcaataaatcgggcaaggcacgggcactgacccgtgccttttttctatcgattaatcagttggtaacgcagttgacctctgtccattacttctttaacgcctgtcgtttagggctcacccaggttccggaaccaaatcctaggatcgtcttcagtgccggaataaacgtcatcaccactgtgacgggattaaccatccaatagaacagcatatacaacggggcaaagaataagtattttaattttgcaccatggtggtctaacagtaatgccgccagtaattgcatgaatccggcaaatagctcaaacgtgacaaaaataaacgacatcgctaatccgtgtaagacccgatcataattaccagtgattaaaaagatccccatggttgttagaaaagccaacgaggttaacatgaagaaaaacgaccacacaatggacagtgttgagtcaataaacatggaaagctgataccggtgggcaattggatgcaatataaatttcttgatattggttaaccaaacctcagtccccccttgtgcccagcgtttacgctgcttgtacaaatcccacaaggtatccggcacattcatatggaaaataacgtttggggcaaatcgcggtacggcaccaatcatctggtgatcccaagcaatactgatatcttcagtcgcccgattctgacgaaaaccacccacatcgatgagaaaatctttcttgtatagcgtgttagccccactgtaagcatacatggaatcattaatcgccgtttggctgcgcttaataacaccaacaatactcgtgaactctactgtttgcgattttcccaatagactcgtacgattttgaacatccatattagcagtcactgcggaggtgttcatatcacggtcacgcatgaagaaattcatatacttcatcaaagcgcctggctctggaatcgtatccgcatcattacttaaattatagtcgccttgggcaaagtgcatgccaatattaaatgcgtgtgctttacccttgttttttaaaatttcgatagttcgcagccgagaatattgagtttgtaagtcactaataatggcagccgtgcgatcagttgacccatcattcattactaaaacctcaaaattttcgtaattgagttcctcaaacaaatacgtaatcgtatctgccaacatgacttcctcattatgtgccggaatcataatcgtaatcattggttgttgctcagccgggatgttctgccaatctgtatcgcgtttgttggtcttcaagaaccgatacgataaggcaccagcgaaccagaagaaggagcccacaatgggatacaagcacaaaattaggagcacaatatttaaaattgtttgccccatcgttgctttcaagacactgtcaataaaaacgtctaacataccggctcctaatctcccaaatcattcaggtgttgtttttgataaagctcatgaatttgttccgtctctaagttctgttccggtttaacttggtatcgccgaacctgatggcgaaaatctgcgtcaccaaatcggtcatccataaatttttccaattctgtttcgcgtttacgctggttaatcgggttatacgttggccactgctcaacgacgcgttctcgcttgcggttttgaataatcgtcatccccaccgcaaagagtgaaaccatcacgaacgcaaataacaataaaatactaatgaatttgatttcaaagatcccttcgcgatacgtccacaaatgaggtatctgcggatgatcaactgccaaaaaagcggttattgtaatcacaatgggaacaatcacacatatccatccgactaatgccaccaacgtctgccgcgctttgagtccccagtgtccacgctcgaaataagcatccgtatacaattgctgcgatggtttatgtttatcagtcatcctgctcctcctagttttgtggattaattgggcggccaaaccggtagccctgtcgaaccggaatcttcaattgttctgccaactgctcatcagcagcatcctccacccccatcagaatcaactgaatatgattatcttgagacaatcgattccaaaactggagattaaggtcaagccaaacagaagcgtcagccttacggaaactgcgcatcgaacattttaacgaatccacctgcggcaataaccactgaatgttttttaaactatccaatgttgatccgacattatcaatatcaaaacgcataccataggctcgagcctcacgaattcgtcgtaaaaacaatgcccgattaagccgccgtaccggtcgattaactgtgaattcgacggctagcgtcatgggcgttattttggaaatagcccaccgaacaaagtagtggaattctggactaacaatttgatcgtactctaagttaattgataatgtaatcttcctaggtggaagtaccttaaaggtatcctctaataaaaagatcacgcgctgtagcggtaacgacgccaactgttgtggcaatgaccaagtcccgtccggattatgttgccgaagaagacattcatagcccgttgtttgtccgtgaaagtcaacttgcttttgaataaagtatcgtagctcaatggcctgattctccaaataattattcgatttttttcgagaataccagaaataaaaggcaataatactaactattcccagcgccgctactagggttaaccataataagacctgttctaattgcactaatgacattccttttcctcacttataattagtcattcagttccaactattataatcgttatagttaacttttcaagcgtttcaatgcatcagaactaaacacccataattattgacactaaaaaacgctaagtttccattagggatcttagcgtttatacatcgccattaatcagttaaaaaatgaaagcgtgtcagttccagtgccgaattgtccataatcaactgaccatgttctgccagcacgtctggggcaacctttgtacgttctgcgtactcataagccaccgctaactcatctttgatagattcacgtgatgattcattaacaaagaagaccagctccagataataggcatcttggtagcggtataagttagaagcggcattctctaagcgaagaactcgagccaaactgatcatatcctcaaaagaatgaagtttaacaactcgagttgtcgttggttgaccactatcgttcaagtaatcctcaatatcattagactcattcgcagctgacttgaagccagagaagaaatccttttgattatctttttctaacaaatgttctttgatttgatccgacacttgatcggggtgctcactgtcaacactggcgtcgccctgactttcatcagctacgtcgtcctcatctgtattcttactgataaacaactccaagccattacggttcggtaacacttgaaaagtaaccgcatcgttgtcctgaaactggtgatcgacatcgacctcttccaagatactataaaagaagccctcaatttgtttgtggttacccaataggtctaacacggtaataccgcgttcggtcagatcatcattgccaataaccacgcgaatcgtattctcattgattcgttccatttccatgaataacacccctttctcgtgggtttggggattgtccttgatactctcattttagtcgtttaaattgacttgtaaagtcatcataccaaaaaaccggactgcaagtaacattttctcacaaatccggtcagatgcaactaattaagcttaatttacgccatttaccagccgttgggcccgttgtaattccaatgctcgaaccttccgcggcaagaagcggcggatttcctcttcgttaaacccaacttgaagtcgcttttcatcgaccataattggtcggcgtagaattccggggtgctcttgaatcagagcataaaggtcacgaagtggtaagtcgtctaaatctactgttaattcttgataggcacgagaccgtttagaaacaatctcttctgtgccatcttccgttaaacgtagaattgatttaatatcattaacggtcaagggctcggagaagatattttgttcacggtacgcgataccatgttcttcgaaccagagacgggctttgcggcatgaggtacaacttggtgatgtatataacgtgactgtcataatcttttcctccctctcagttgtataaatcttttaataaagtctattatacagctttttcgagaaaaataaagaccttttggaaattaatttaatcaacaattttatgccatatgactattactgggcaaaagaataatcactagacaccattttgatattcaattgattttagtcaatttataattatcgaatagtaatcattaggtattataaattgatccagcctgaacgacctcaactcgcgtacccgtcccggccgccgattgggcttctgcctttagttgctgaagatcgcctacttggggaagatgcgttaacaataatcggctaaccccagcttgctgagctaatttaccagcctgagttgacgttaagtgccaggcagttccctgatgatcagcaaagaagttcgtatcagctaataaaacatctgcgcccgttgcccatgtcgttaatccactaaaagccgctgtatcggcagtgaatgctaatgtggcaccagtagccgtttccgtaattcgtggtgcataagctggcacgggatgatgggtcgctaaaaaagttatcgtaaaaggaccgatttgaatcggttgagtgggatcatatgggcggccaatcgtcgcgtggggccaggttaacgccccaaagttcaggggatcagctgtatgaccataaatgggtagctccgcttgcgaccgttgtgtcgaacccagttgccattcatattgcaaaacacccacatcggccgtgtgatcgtggtgatagtgggtcagcaagacggcatttaactgtaacggatctagcaccttttccaaagccaacagtgcaccactgccacagtctaagagtaaatgaaaatcaccactcgtcaacaaatagctactggttcctacaccattatgcgggtaaccgccataacaccctaaaacacgtaattgcatctaatcatcctctctacttaatactactaccagtttagcgcgctgttagaagagtgtaaacgtttcgcttttttattcaggacccttataatagagataagtcattagttaggagggatgattatgcgccacgaattatcattaacattcggcagtcgtgatgttcttcaacggattattcaggaaaatacggatcgtcatttattgttacttgctggttctgcaaccgatgaaggccttcttttactcgatgtttcgggtacccccagcattttcaccggggggctcacttatcaaatacgtgcacaccaaggcagtcaaagttggcaaggattctttagctttgattactttaccctagatccagatactgctaaggtctttgaagctaaagtgaatcgattggctagtcccccactcccagccggtatgactgatctatatttattaaccaaacaacacaacgacagtgagtatttactgcttacggtctggcaggatagtcaagcttacgcgctgtggcgccactcgccagcgttcgcaccaattgacacttatgctactagcgctaatcatttccacgcagcatcctaccatcaagtccctaaaaaagaacctcaaggctaaccctacaggcccaatcatctggattggacctgttttattttgttttcatttcgcggtacaataagcctattcaacttttgaaaggtgttgttcaactattaaaacgatgtctaatgcggcggttgataaaatttcgccactacttccattaaccaccgaacaatctgaattggttgagcgtttactcgcctttgcaacaacccacatccaaacagatggtcctgcggtctttacgatttacggggacgccgggactggcaaaagtgtcgtgctcgctcatctctttaaccaactacaaactttagcccgaactcatccgactaacccgctgaccggaaccgaaaattacttcttggtgaatcatccagaaattctaaaggtttaccgtgaaattgctggccaacaaccccacctgtttaaaaaagattttcagcggccaacgtctttgattaatcaaatcaatcagggaaagcggcacgctgacgtcttagttattgacgaagcccatcttctgttatcacaggctgaccactacaacaatttttatggcacgaaccagctgacttcactcatggcaacggccaaggtcatcattgttgtttttgatgaaacgcaggttctacgaatgaagagttactggacggaatcacggttagagcatctgctagcttcggttccccacaccagctatcgcttaactcatcagtttagaatgcaggctagtgacgaactcgtcagctggattaatgacttcacccatcaacggctgcacccactgcctgccactgacggaacacagtatgacttgcgcgtattcaatgacgcagaactcatgcggcaagctatcgtccaacgaaatcgtgaagttggcctgtcacgaatcgtctcaacttctggatatccgtcaacactagatggcggtaaacattttatcactgagggccggtttcacttaccttgggatcaatataactacaccaatacaccatgggctgaacttccccaaaccattgatgaagttggctctatctatacttgccaaggatttgatttaaactatgtcggtcttatcctagggccgccaattacattagacgaacatcagcatctgcaaattcgattagaccgttatacagatgtcgaagcattcaaacggcgagacgatttgaatgatccacagaaattgacccagattaaacagcaattggtcttaaattcaatcaacgtcctaatgaaacgcggcgttaagggactctatatctttgcccacgatcagcgtctacgtcattacctacaacagcgacactaaaaaaggaactggtttcgatggcctgaaatcagttcctttttggcaacaataatattttatcaaacaaaaaagccttcccaaaggaagacttactaaggattactaaaacggtatggctaccacatggctactttatggacgaaaccaacggggatattgataacttaatcaactttgtggcgccaggcgagttagttttgacgtggacggatgacaaacacgatccgcaatatgagattagtcggcaagcctatgagttattacaacaggcaacggatgcgcaagggcgtcggtttaaaattcataaattgcaaattcctcgtattttgacgcttagtgacgccgaagcacagggagttgatccaattaatggccggttaccgcgggtggctggccaacgcttgacggcgagttatgtgagttatattacgacgaaccgggctattttgatgccagtatttgatgatccgcaagatgccctggcgcatcgccaattagcggcgctctatcccaatcgacaagtcgtggatgtttccgccaatgagatcctaacgggtggcggcaacattcacaccattgcggccggagtcccaggtcgtcacacgggaggacagcaggtatgaacttctttgaaatcgccaacgcacatctaagcgagttatcccccaatgagcagaaactctttgattatgtggtgaccaatatgggtcagatcaagaatcagagtattcgtgaagtggcgtccgcaacatttgtatcgactgcaacttttctacggtttgttaagaaaattggattttcagggtttagcgaatttacgacggtgattaaattcacgctaattaaccggcaagaagcagaacggacgacgccatttgttgtgcagcaaaaggattaccgcgaggaatatttaaaaaatattggtgagtcaatccgggtgattcaaccagaccacttgcgccaagtggttgaccgattggcgcagcacccggatgtgtttttctttgccaagggtgtgagtaagcatgcggttgcttacattgattatctgtatacgatggctgggtttaagacacactttccgcgagatcatgattatcgtaaacaagcattgactcaagtggacaatgacgcgctggtcttcattttgacttataaaggctctgatggagaaatgttagatatgatgagtcaattggttgggcgaccagtacgaccgctgttggtttcgataacggagccggataataatacgattcaaaatctcagcgatataaacttttacatttttaccgatggggtgaccgtcaacgggacagacattagctcgcgaatttcgacgatttcagtgatggaactgattctatatcaatatgtggaggactatgggggtcgagatttccattttcaacgtcaacttgagtcataagatgaaaaaattgttaaagagattgagattaaccaccaaaatctatattacacagacaaacgagtgataatgatagaccgtttcctaatggcctgttattgtcactcgttttagtacgatgggattatcctagccgcaaactctctcgtagaatctgcagtacgcgttcttgaacaggcgttaagacgtgggaggttcgatagacaatactagaaatgaactcgggttgctcatcgtctagtaattccaagcgaacgacatcgttacgatgctgatcgacgatatccgttagaaatgtaatccccacgttttcggcaacaagattcataataatgtgggtatcattcgcccggaaaaccacttctgggcgaaaatgattacgacgagttaacttgttaaacgcagtgttatgcacaaaactattagtgaataaaataaatttctcgtgccgcagttcgctgaagtagattttttgccgattggcgagtgggtgactcttagcaatgaaaatattaaatggtttgcgatcaaattcttcagcaatcagattttggtaggctagtggttcaatcgatcccagcaggccgatatcggcttgtccgttgagcaaggcgtggcgtaaccatacagagccgccctcaacagtttgcagtccttccagcagattctcagcctgcaatcgtgcggcaattcgtggaaaataataattttcgataattggtggcaaccccagcgtggtttggcgagcagctaaatgggctagttcttggtgggctagcgttaattcactgaggacgacttgggcgtgaatggctaattgctcaccgctcggggtaatttgaatatcattgtgtacccgatcccggatgactaatttggtttcaaattcggtctctaatcgtttgatagccgtggtgatcgtgggctgagtcacaccgaagaaggctgctaccttagaaaaatttttttgtagaataagctgctggaaataatccaaatcttttgtattcatattttctcctgtcaaatcaaggctgattactacattataaaataattttataacaatcgctacgtttgactataaaattttcagggcgttatagtgcaatatgtaaataagagctatccaaattggaggaaaatcatgatgacgcaaacagcagatacgattttaaataaccccttcttaaataaaggaaccgcgttcacacaagcagaacggcgggaacttggcttggttgggacattgccagcccaagttcaaacgattgatgaacaagccactcaggcctatgcccaataccaaagcaagccaagtgacctggaaaagcggattttcttaatgaatctctttaacgaaaaccggacattattcttccatttaatggatgaacacgtggttgaatttatgccaatcgtttatgatccaaccgtggctgattccattgagcaatacagtcatttattcacggatccgcaaaacgcagcctttatttccgttgatgcaccagaagatatcgaagcaacactgaagaacgctgcgggtgatcgtgacattcggttggttgttgtgactgatgccgaagggattttgggtatgggcgattggggtgttaacggggtagacatcgccgttggtaaactaatggtctacacggcggcggctggaattgatccagcacaagtcttgccagttagcattgatgccggaacgaacaaccagacgttgctgaacgatccgctatatttagggaatcatcacgaacgggtttatggtgataaataccatgcggttatcgatcaatttgtagccgcagaacaaaaactcttcccagaatcactccttcactgggaagacttcggccggtccaatgcccaagtcattttggacaaatataaggataagattgctacatttaacgatgacattcaaggcaccgggatggtcgttttggccgggattttaggggccttaaacatctctaaggaaaatatcaaagaccaaaagttcttgatctttggtgccggcacagcgggtatgggaattgccaaccaaatcttggatgaattaaagcgcgctggcctatccgaagaagaagcccgtcagcatttctatgctgttgataagcaaggcttattgttcagcgatacgcctgacttaacggccgctcagagtgagtttacccgggaacgtgctgatttcagcaacgcggcagacctgactaatttggccgctgttgtgaagacggttcacccaacagttatgatcgggacatcgacgcaaccgggaacctttacggaagcaatcgttaaggacatggctgcgcacactgatcggcccatcattttcccactatctaacccaacgaagttagcggaagccaaggccgaagatctgatcaaatggactgatggtcaagcgctggttgcgactgggattcccgcagctgacgtagattacaatggcacgacttaccacattggccagggtaacaatgcgttaatgtatcctggtttaggctttgggctggttgcttcaacagctaaggtcttaaacggggaaactttatcggcggcttgccacgctttaggtggcattgtggatacgagtgaagccggtgccgctgtattgccacccgtttctaagctgacagaattctctcaaaagttggctgaagttgttgcacagagcgttgttgatcagggtctaaacaaggaaccaatcagtgacgttaagcaagcagttgctgatatgaaatgggtgccagaatacaagtaaatgtgaatcgttgagaacgattaagaaccacgtgttcggcccgatacggcagttggaccggcataagagagagttaaatcatgagagaaatggggccgaatagctcgtggctgttttgtggaattcgattcaaagtgttttagttgttgtgttaatcatggtactcggctttatcctgcggcgacaaggctggttcgatgataagtttggtgggacaatttcaaagtttattaagaacattgcgttgcctgcctcaattttcgtttccgtgttaagtcgattgacacgggggcaactggtttccttttccggttacttggtatatgcctttctggccgtcatcattggctatctcattgcctttgccttggtacggatcatgcatgttcggccgggacgtaaggggatctttattaacgcggtcgtcaacgccaacacgatttttattgggctaccgttaaacattgccttgtttggcgataacagtatgacctacttcttggtctactatattgtgaatacggtgtcgacttgggcatttggggttttcttgatttctaacgatgatccaaccaagccgaaggaaaagcaacatcatcagattaattggaaacaggttattccaatgccattagtgggtttcctggtggcactagtcttcttattgctgaatattccaattctgaagattagctttgtgaactcaacgttgacgtatgttggtaatctggtaacaccgttatccttgatttatattgggattgttttggcggacgcaggactcaagagtattcacttcgatcgtgatacgattgtggcgctgctaggacgatttgtcctgtcaccgattatcatggtagcggtcttgcttgccgctgggcatttcggtgctagcttcccaacgatggcgtctcaaacgttgattgtgcaatcagcgacaccgatgctggctgttttaccaatcttggcgaatgaagcccatggtgacgtggaatatgcaactaacgtggtgacaaccagtacggtactgttcattatcgtggtaccaatcctgatgtctttaattcaatttatctagttttcaaacgcgtgatacgactaattttagtggtatcacgtttttttatggtcgcaatttgggaaaagatgataattaagtggcttagatggtagtgccttaagcggtacaggttatcatgagttgcgattagaccggttccatcatatagtaaatgaaaaagcaccaatgaagggaccttaaccgatgatgaagcgaagttaccccatgatactgacagctgtactcgtggcattaggcacgattggcggcagtgtattttcttttaatctaggcgtagctaaagtggcgccgatgcaacatttattgaatctagtgaccggtgtcttactagggccgtggtgggcattagcgcaagcatttttgacgtcggttctgcggaatgttttaggaacggggacgatcctggcttttccgggaagcatgattggggccatgttgagtggctatctgtttcaaaaatcgggccatttgtggctaggagcggttggtgaactactgggatctggtattttgggcgcactagcagcttatccgctagcggcgtggctactgggaaccactggagctgtctggttatttctccccagtttctttatgagtgcgttagtgggcgtcattgtgggatatggggtgctgagagccttgtggtcacgtattattgtgccgcagcaacgtaaatgaaaaaacgatagccataattttaggaaatccccatgtctaactataatcgtcattttcatttccagctaaaagctttaaactttagctaggaggttttttcagtgacaagacaagtaacgttatcacgtagaacgcttttattgatggccactgtaactggggtcattgtagcgaatttgaattttattcaaccaattgagaacctagttgccacagactttagagtatctaaggcaatcgttggtttgttggcgatgttgacccagctgggctatgcctttggcctcttattgattgttcctttgggcgatatctttgatcgatatcacctcattcaatttatgatggggctttctatcttgtctctactattggcttactgggcaccgacagtcacggtatttggtattgcgacgacactggttggtgttacgtcggtggcgccacagatcattattccatacgctggttatctagcaccggcgctccaacgggggaaagtattgggcgtggttctcagcgggttactgaccggtattctactatcccgttccttcagtggtctattgggaagtttaattccttggcagaacatttacctcgtggccgcggtaatcgacttattcttcttagtcatcgttcactggcgccttcctcgtgatcaacggggacatcgggccctcaactatggcgccgttattcgaaccttgcccaagttgttagtgacgcaaaagcccttgcaaggagcggcacttaatgggttttgtctttttggcatatcaaatgttctttggtcgacattggccttttacttagctgctcagtatcatttgggtagtaatgttgctggattactaggtttattggggattgctggtgttttggctgctccgatgattggaaccctagttgatcagcgttccccacggttgacagttgggttaggcatggtattttccggaatagccttcgtgattttttggctagctggtcattggctattcggtctgattgttgggattatcctgttggatttagggacgcagtttagccaggtatcgaatcaggccattgtccaatcgctgaatcggcagcaaagtagccggaacaactctgtgtttatgtttagttactttctaggtgggtcattcggcaccttagcagcgacttgggcttggggtcaggctggttggacgggtgtttgtggtgttgcgctggtcttcttggtactggcatttatcggacatttacgcatcggcgagcctgaaaaattgacagttaataacggataatggcgtcgttaaaggtagttaccatccaggtaactatttttttgcctttaagttgacacggtgtcactcaagatgctatactcatttcaatcttaagtgacgccgtgtcacttaaggctgagggaaggaatgattaaacgtgccaacgacgacatttaccaatttaccagccgcgaaacgctcacgggtgacggcggcgttactcacggagttttcagcgcacagtctagcggatgctcaagtggctagaattgttaagacggcaggaattgcccgtggtgctttttataaatactttgcggatttaacggatgcttaccaatttttgtttcatacggccttagccgatattcacgcgggctttggtcccgtcaacgcgggtcaattccaagcgcaacgttattatgatgctgtggctgcatttgtggagcacgtcacgaatagccaacaatactaccaattaattcaacggcactatgctgaaaatgaaagcctggtaccgccattgccagtatcggtggatttatcagcagtggattgggcagcaatgacattgagtcatgctgccattaaagaagtgatgcagcagccaactgcccaagcagttatcttgcaacgcctccagcaggcgttaaacttattagcaagtcaggaggaatgaccaatgtttttagcacttagagaaatccgccatgaaaaattgcgttatgggctaattgtggcgatggtggtactcgtgagttatctggtctttgtgttgagtggtttggcatacggactagcgcaacaaaacacgcaggccatttcgacgtggaacgctgaaaagattgctttgaatagcgatgccaatgagagtctggcgcaatcgttgattagcaagaaaacggctaataaacttaaattaactagccatgaagcttatattggccaagctggtgtggtagccaaagctaagggtcaagcaaagatttcgtcgcaatttgttggtattaaccgtgatgaattcatttataagcaactcaaggccagttctggtcacaagccaacgcgcgcaaaccagattatggtcgatagtagttttaaggataaagggtatcggctgggtgacaaggttaccttgaacacagatggtggcaagtatacaattgtcggcttcaccaaggatgctaagctcagcgtggcgccggtcatctatggcacattagggacatggcgaacgttgagtaacctaacggatcgttttcaagctggtggtgtggtgtcgaatcgagctaattatcaagcgaagactagtggtttgaagaccttaaaaatgagtcaatttatcaataaattaccgggatattcagcacagacaacgacctttaccttcatgattgcctttctattagtgatctcaatggttgttattgcggtcttcttatatatcttgaccatgcaaaagttaccaaactatggggtgctccgcgcacaaggtattccggcccgggtattagtgacgacaacggttagtcaggcgctcgtgctagtgatttcaggcctgctcattggggccgccttaaccgctgcgacggttgtcattttaccgtttggtgttccgttaagctttaacgtaccgctactcagtggcgtgacagccggaattatcctgacgggtgtcgttggtgccttgattccggtcagagtgattctaaaagttgaccccgttcaggtcattggataggaggactgaatatgccagcattaactttaacgcatgtgacgaaaaaatttggtcacgatacgagtgaagtaactgttctaaaagatgtgaattttcaaacaatggccggtgaggtcagcctagtcatcggaccgtctgggtcgggtaagagtacctttctaacgattgccggaggaattcagacgccgactactggggatgtactggttcaagatcaggccatgaatcagctgtcaccgaaaaagcgcgatgctttccgtctgaacaaagtgggctttattctacaagcttataacctggtcccttacctaacggttcaagaccaatttacgctggtcgatcgcgtgaaggcacaaggtaatttaaagcacgatcaactgacagatctacttgaccaactggggatttctaagctagtcaaccggtaccccaacgaactctccggaggccaaacgcagcgagtggcaattgctcgggcactatatcaaaatcctgatatcatcttggccgatgaaccgaccgctgctttggatagtgatcgagtcaaagtggtcggtcaactctttcggaatctagccaagcagcaccacaaggcagtcgtgattgtgacccatgatattcgtctacgcgacttcgctgacaaaacgtatcaattaatggatggaaagttggctttggatcaagcagaggattagatggcgcatcacaaaaaaatttataaaatttgagatagtagtttgtcgagagtttcacgaaattggtttttaatctagtaattggccgctttagtaggcggcctttttgtgttagttcggactataattggtatagactaatttgcgagcatattgcttggcaaaccgggtgcgaccgcttatagtaagcgtttacaaggatttggattagtgctatcttttatttgctgattatttatgaagggtgaggaccggtaagatgaatagacatttaagtacattctttatttttacattcggggcactcggaggactactctttgggtttgatacagggattatctctggagcgtcgcctttgattgaaagcaattttaatttaggtattggtcaaacgggatttattacctcttccgtgttgattgggtcatcggtaggggccttaggtgtcggaccattggcagaccgttatggtcgtaaacgcctattaatcttggctgccatcttattcttattgggatcaacgttgtctatgattgcgattggtttctggtcgatggtcgttgcccgaattattttgggcctggccgtgggttcagcttcagcactgacaccagcttaccttgctgaactggcacctgctgaacgtcggggttcgttgggaacattattccagttgatgattactttgggaatcttgttggcatacgtttctaaccttggtttcttaaatcataacctcttgggcatccgtgattggcggtggatgttggggtcagccttgattccagcagctctattgctcattgggggactcttattacccgaatcaccacggttcttagccgaaaagggtgattcaacgcaagcactgagtgtgttaaagatgttgcggaagaatacagctgacgatccaaagcgagagttggctgagattgaagaagttgctaagcagcctaagggtggtgtgaaggaactcttcacgattgcgcgaccagccgtgattgttgcggtcggaatcatgttgctacagcaattagttgggatcaactctgtgatttatttcttaccgcaagtcttcattaaaggtttcgggtttgcggaaggtagcgccatttggatttctgtgggtattgggattgtgaacttcgttgtgacaattctggccacgtttattatggataagtttaaccggaaagccttcctaatgtttgggtcaatcgtcatggccctttccttgggcgttctggcagtgatgaactttacgatggatatccattcaacggctgtgccgacgatgatcctgattggggtttatatcttcggcttcgctatttcatggggaccaattgcgtgggtattgatcggtgaaatcttcccattgagtgttcggggaatcggatcatcgattggttcagcggccaactggattgggaacttcttggtgtcacaattcttcttggttatgttggcatatttccacaacaatgttggtggtccatttgccgtctttgccgtcttcgcggtactctccatgttcttcgtccactacttggttcccgaaacgcggggcaagtcactggaagaaatcgaaatggatttacggcaccaagctaaataagttaaaaaaacgtctggaatttttccagacgtttttatgtgcttaaaagtggtagagtaaagcgtacggatttttatagaaagaagcgatgacgtcatgcaaattcaagtcccgtttgcgctacctaatttgccagatgagtatggtatcaatcagcccgccgatgagctgattgatggaattaatttacgttcgtttccgttcaccgtaacggatttaccgaaagcggctgtgaccgtagcatttagcttgattgatcatgatacgattccggttgtagggttctcgtggattcattggttaggcgctaatctgccggtaacggccggtcaagtcgtggttccggataatgctagccaaactgctacctttacgcaaggtaccaataccctaccgatgattattgatcaaattcatcagcccacagctttcaaacagcgcggctatgacttaaccaagcactacgcgggacctcggccgcgcggtggtgttcatgcgtaccggttaacagtaacggcagttgacacgacgttgcccgttacgtcagggtacttatacaatgaatttttacgcatggttgagggacacgtggtagcacaaacacatgtgaacctgttgtacgcgaaaaagtaaaaagttgcggcctatttcaagccgcaactttttgattagccaaaatactagatgattatcagaggccaggaatcggttcagccagtagtacgtgatgctcatggtcatagtaactgacagtcttactcataaggtcactggtccaaacgggaacgccagcttcaccagccagttggcagaaacgtgtaaaatcaaattgaccagcctgagcggcgagtacggccgctttgattttagcggcgttactagttgctgcaactggttgaggtaccccattcatctgtaaatcgatatggctgtcggcatcgtagtaccggtaacggccatccgccacaagataatcgtagcgttgaacgcctaattcacggaaagtccgcatgagatcagcgaactcaccggcattggtttcagatttaacagcctgttcaattgcatggtagtctaacgtcattatttgaactcctttgctggaatagggctagcttaccgaaatttataaattaatacaaggattattaggcgccttggtagttcttggtataatagagaagatggaggtggcacgatgaagcatgaatggcgtaaagcagaaaaagcgtggtatttgcctaaagaaccgactattttgaccttgccacggctgaattttatcaccctagaaggaacgggtgaccccaatgggccgttatttagtgaacaggtgggggtcttgtatagtgtggcctacgacctgcgcatggcgttaaaacgtggtgaattgggcgacccctatgaatacgtggtgtatccactcgaaggggtctggacgacaagtgatgggtcgcgtggcgctaccttgaataaggcggctctacggtacaaaattatgttgcgtcagccagatcgcctaacggtcactgactttcaagcaagtgtcacacgcgtgaccactaagaagcctaatccatggttggatcacttggcctgggaaccctatgcggaggggcaggtgctgcaaactattcatcaaggctcctttgacacagagcccacaacctttgcccagctccaaacggtattgaccgatcagcattaccgagttgtgcccacgatgggcgactactggcaccgtgagatttacttaactgatccacgacggactgcaccggagaaggccaagacggggttgcggtataagattgaatcaaccaatgcttaaaaaagctagacagtgtccgtaggggacattgcctagtttttttagcaggtagtgcttgttacagccattggagtatctcatccaagttatggacctcatgtgttggtcgtgcagtggttgtgggagtggcgtggtcacggttcacccaaattgaccgccagccaagcgcatcggttgtgacaatgtcgctaccgtatccttgagcaatgtgccaatggtttgctggggtcaaatcatagtgtgctgccactgttttgaagaaaaccgggtcaggcttatacgtgtgaacgtcctcagcagtccaaatatcaaagggaacttctaaagccgcagcgttggcgggaataatatcccatgatgaattggacatcatgattaagtgataaccgcgttgttgcagcgtctttaaggtgccgatgacctcgggaaaaggctttaagctacggtgagcaatcagaacatttacgtaatagcgttcgaactgatgggttagaccaaattgataatcgagatgaatcaagttattacgcgtcaaaatggcgtaatcgagatagggatgcatgttatcccgactatcttgataggtgataaagcgttgccgggctagttgtgggtcgacgccgattttatcggcaactgtttcaatggctgcgtaggttgcttcttcattgagtagggtaccgtagcagtcaaacgttaagtattttccatgatgagactcctctctgactacctttaagtatacgcacaaacactaaaaaagccgtcgaaattcggcggcttttcatcatattacgttaaattattcagcgtcgtaggcagcttggaaaatcttgatgatatcttccttggtccccttacgagggttagagaaagcattcccatctttcaaggcattttcagccatcaattcaaagtcttctggcttagcaccaatttctttgattgagtgaggaataccaacgtcttcggataattgcttcatggccttgatggctaattcggcagcgtcccgcgttgataggccttcagtgttttcacccatgatttcagccaattgggcgaaacgatctgggcaagcaatgatgttatattcttcaacgtaaggtagaagtaaggcacagcaaacaccatgaggtgcgtcgtattgaccaccgagttggtgagccatggcgtgaacgtaacccaagttggcgttgttgaaggccatcccggctaacatttcagcttcgaccatcttagtccgagcgtccaagttgtggccgttagccacggcttcacgaagggaagtttcaatcaacttgatcgcttccacacattgtgagtcggtgatagggttgtggtcaacggaaacgtaaggttcaacggcttgaacgaaggcatccatcccagtagctgcggttaagcccttaggcacatcgagcatcagagttgggtcgttgaatgaaaccaacggaatgttccgccatgaaacaaccacgaacttcaagtgggtttcttcattcgtgataaccgcgtgacgggttaattcagaaccagtaccggccgtcgtgttaacggcgattaatggtggcaaagccttgtcgagtgtttcaatcccagccaacttggtaatgtcgtcgccattagtcaaaataatgccggcacctttaccagtatcgtgagcagaacccccaccaacagtgatgatggagtccgcaccggattcttcgtaaagtttcttaacttctttgatgttacgaatcttagggttgggttcaacgttgttgtaaacaacgtagtccacaccagcagcctttaaagaatccaaagtctgttccacggcgccgtcctttaaaccttcaaggaacttatccgtgacgataacgggctttttcatccctaacatctttgctcgatcaccaatcttactaatgacaccagggccaaagaaattgacgctgggcatcagaaagtcataactacgttcagccattatacaaatgccttctttcggaagttttgaaaacaattagtaccaatttcacaaagcaattataactaataaatttacagtttgcaatcgtttttgggtaaaagtcccttaattgtgcaataaagtgctaatttgtcggcggtttaaaccgtaatgattaattttactgtcagtatttttaccgctttcaacagaaagtggcattaatgaaaaaatatacaataaggccgttcacacgaacattttgcctgcttgacgattgtgacgacgttaacgggtataatagagataatcagaacataagagggcttagagatgaaagatttaaatgaacatcgacagcaggagcaagctacgtggcacgcccgccaacaagaagaattacaaaaactccgcggcgcccaacaacatttattgttgaatgtcggcgcttatttagccatttcggtgattgagttttatttagccattattggtcattcgcaaaccttgcgggcggatgcctttaacaatttatccgggattatctcctccgtattgttattcgtgggcatccatattgctcgtgatattgatgacgatgacttgatgggtcaaccgctaccagaagatttagagcaggatggtcagcgacttcaattgacgcggtttcactacgaaacggtcttcaccatgattacggggattgtcatgattgcgatcgcggcaagtgttatctatagcggaatccgaagcttgatgcatcaggctagtcaagaagtaccccaacccattacactattgggagctggaatcgccgcagtcatcatgctaggcgtctggtggcttaatcggcggaccggtcgtcgtttaaaaaatgcggctttaacagcggcggcgcaagatagtttgagcgatgcggttaccagtctgggaacgttagttgctatcggtggggcgttgatcttcaagctcgattggttggatggcgttgccagtattttagtggggatttttatcctgacatcgggcattaaaattttccgtgagagtagtttgaatttggcggactattttgacccacaggtggaagaccaatttcggcaagcggcgctggcgtttccggcagtccaacaggtgatggaactaaaggcccactataatgggaatgtcgtcacactggatttggtaatcgcggtggatgcccatatggaagtgcaggacagttaccagcttggcgaagagattgaggccgccatgcgtcaacaattcgggattgttgatacggatgtgatggtcgtaccggctagctagtcggggcacataaaaactgcgaacgcgtttgagttcgcagtttttatgttgattggcggtgacttattagttaacggttggagttagttacgtcacggcttagttcttgtaaggctgttccattggttactagatacccaggcttatctttgacgaggtagccggctttaacaaactgagctaaaacgtacaacaaatggcggtatgacacgcctaaataagcggcaacctgagtatgtttttcagcataatgatgatgatacgtggttaataagataaatgccgctagccgttccgccaaactaaaggattgattctgagaagccgtctcgatattacgggtattcttttgcgctaagtaaatacaaacgtgctttaaaaagacagggtcattgagcaattgtgattggttgtcccgaatggatacggccagacaccagcagtcttcaatcgcttgaacactgtaaagcgtgcttgctggattgatgagttccatttcaccaataaaacaaggcggggtaaagaaatcgatgagcgtcactttaccattagccataacatcataaagcttagcgcgccccttcacgagataataaatatattcaggcgtagccgattctttgacaataaatgactgggctggaaatttaatcagttgggtttgtgcggtgatatccgttgaaaattgggctaagtaatggctattaaggataaattgttttactaaattggcatcattaattttgaccatgattactcctaatatgagatttctcatagttagtctagcaagatactggttataattcaatcagtaagtaagggcttacaaagaatgggaggaagcaatgatggcaaaacgaaagattattttagattgtgatccgggacatgatgatgcggtggcgatgctaatggcatatgcccaccccagtattgatttattagggattacgattgtggcggggaaccaaaccttagcaaaaacggtccgcaatggtttgaatgtcgcgcaattattagaaatgaacgttaaaatttatccggggatgccacagcctttagtgcgagaccaagtagtagccggtaacgttcacggaactactgggttagatggtcccgtctttggcgaattaaaccggcaaccagcaactaaaaatggagttcaattcattatcgatacgttgttagctagtgatggtgacattactttggtaccaaccggaccaatgactaatattgcgagtgccatgcgtgcggagccactgattattcctaagattaaagaaatcgtgatgatgggtggggcctatggaaccggtaattttacgccatcggctgaatttaacatttacgctgaccctgaggccgccaacgttgtctttagatcaggtgtgccaatcgtcatgatggggcttgatttgaccaatcaaaccgtttgtacgccagatatcattgaccgcatggaagcggttggtaataaggcggggaaactctttggtgatatgttgcggtttacactcaaaacgcagtatgaagaatttggattggaagccgggccaattcacgatgccacgaccattgggtatctaatcgatcccgatctctttgaaacgcaggatgaatttgtggtggtcgatattaaccgggggccttgttatggtcgaacggtttgcgatgaaaacaatgttttaaagcaacaacctaacgccaaggtcggccaaaagattaatcatgatggcttctttgacctggttgaagactgtatccgactgtattcataaacagttaatcagtggtcctaaagtaaggctcgtcgatggttagtgtctgtgcgtccaaatccaccgtcgccaatagttcgtaaggtagggcggtgcggggataagcgtggccaaagtttaggttggtcatgattggcaagtcaaggtcctgcgtaaccgtcaaaagggcgcgacaatagtcggtatagtaccgttcgttttggggcttgcccgtaataatggcccgaacttcacttagaattccggcacatttaagattttggagcatcgtttggtaggctgctggtgtggggcattcttcactggtttccaagaacagaattttatcgcgccattcactgagacttggcataatgtgatagttacggttgatgatgggttcctcggggtaacgcgtatcggtcagcaggctattaagactgtcgatacagccgcccagtaagcgcccctgtacgtgtccggtcccccgcagaacttcgtacccccgggtttcgggatgttgaactcggggagtatcaagtgccaccaccgaaaagtcggtgcgttcttcataccacacagggctactggtaatcgcggtggtttggggattagctagatagtgggcccaggtctgacgggtatagggtaataagtcggggcctaactcggctaagtcattaagcagattaggcccataataggtaaccagtcccaaccggcggagcatcaaatgatctaccgtcgtatcagagaacccggtaaacaacttgggatgctgttggacggcggtgatgaagtcggggtcattgaataggtaaggtgctagacggaaggtatcttcgtcaccaattgcacagataataccatgaatatgctcgtcaagaaaggcctgcttcaagtcagcggcccgtgcttcgggatgggcgtttagataagccacgccccgacaggcattgggcatgatgatgggaatcaagcctaattcgcggagtcgttgctggccccgggttaattcatgggccgcgaagtcttcgccaagaacgccactggacaggctgatgatcgccaccgcatcgccgggatgtaattgagttggtttttgcataacagtccctccaaaccattaaattggtgttaattctacacgtctgcggggattcttcaatggttactaaaaagtgcctactccccaaaaggtcttttagtggttaaaatggaagaaaacgctgggaggttattttgtgaagaagtcatacaacaatggtgtcgaggcaacgctcggcgtgattagtggtaaatggaaaccccaactcttatgccacctcggtaagcggccgcaacggacgtgtgatttgcgccagaagcttcccgctatttcgcaaaaggtcttaacccagcaactacgtgagttggaaagtgatggtgtgatcgtccgtcatatttatggggatcgcgcgccgttcaaagtggtctatgcattgacagacttgggccgatctttaggccaaatccttgtgcagatgtcggtgtggggagaacaacgagctagtgaggtgccagatatggaaattagaaacgggcacagtggattcaatcaaattttaaaccaaccaacggaggcactttaaagtgccttcttttttttgaggttatgggcgggtatgctaggtcttgttaaggaggtggccgatggaaccaacaatccatggattacaagagattcaagcgttgatcagtagcccggtgcagtggcaggttttactacagctgagcgagcgtcccgtgacaacgcgtgatttacgacaacgcgtgaccagtggttgtttgccatgggccttactccgactgtggcagcaccaactcatttggcggcgagccgatgagcagtgggcattgacggccactggggcaacgttacgaccaattttacaggccattcaaacgtgtacagaccagaaaggtggaactaactcatgacgtaccaatttatgcaaccttatacttttaagaacggtgtgaccctgaagaaccggatggtgatgtcgccaacgaccaccatgtccagcttctacgatgggcatgtcaccaacgatgagattaagttttatgatgtgcgggcaggtggccctgggatgattattggtgaggttgctaacgttatcgcgagtggtaaggggttcgaaggcgaactgtcgattgccgatgatggggatattgacgggctcagtcggctagctaatgctatgaagcgtggcggcacgaaggcgatcctgcagattttccatgcgggtcgtaagtctaacgatagtatcttgcggggggaacagccggttagtgccagtgcagttaaggccgtctttccacccgattcacaaacaccacgtgagctgacggctgccgaaattgatgagattattgtggcctttggtgaagcgacacggcgagcaattgccgctggatttgatggcgttgagctgcatggagccaatacctatttactacagcagttcttctcccctaattccaaccgccggacggacaaatggggtggcgaccgtgacgcacgaatgggttttgccaaggccgtcattgccagttcacagcaggccattgatacgtacgctgatcggccgtttctactaggttaccgaatttcaccagaagaaatcgaaacaccggggattcgtttagctgatagcttagcctttgtcgatatgttgggcgattccacagtcgattacgtgcatacctcaatgggctctgcacaccggacgtcgctaaatgataagacggatcacgaaccaattttgaagcaattggtccaacagttagccggtcgtaagccgctgattggggtgggctcggttgaaaagcctgccgatgcggaagcggtcttggaaatgggtgctgatttagttgccatggggcgtgaatttattcgggaaccccagtgggttgaaaagattgtggatggtgatgaggccagcattcgctaccaaatttcaccgtcagaacttgatgaattagccattccacgggccatgcaggattacttgaagggggccttctattcagtgatgcactttaccactgatccgagtgtcgccgttgattatcaaaatgaagcggcgccaatggaggggtttgaaaagaagatgtcgtaacagcattatcagacacaacggttggtaatacgtggccgaccaaaaatgagccgcccttctgtgattagagggcggctcatttttgagtgcgagttaagatgctaggacaggtcgctttcagttagcttcaagtgagcttgtaacggttggtcgttaggcatcagccacatcgcgggaccacacagcagcgagccaacgccaccgatgatgaataattttgctacgccaattgcatcagcgagcggcccagcaaagataagaccagcgggccccgccagactagccaaggagtttaacatacctagaacctgtccgagctggttggcggggaaactctgctggatcatagtcatcaaaagggtgctgtaaaacggcgtgacgattctggccaagacgttgagaccaacaaaccaccatgcacacattcctaaacgccagttgattttttcagtcaatttggtgatctacgctttcgctatcagttctttaatcaattatgtgcaacgtctaaattacaaagttattctttgtgcgtaaagccattgcataacttagaagaatagcggcaattagctataacggccagtgggatacatgatagagattcaaaagtattgaaataaatattaacagtaataatatccatagatacctcgtagaatagtttgaaataccaattgtaaatagatagataattaatgcggcaggagtaaagaagttacagagaaataaaaccttgatatgacggatcagcagcgaaacgattgaagtaattattaggacaataaataatgttaccgtgctggcttgccaatgcaactctgcacctatgctggtagaagatgtaaagtgtaatgaagcttaaatcacaaacaaacatagagataccacattagtaatcatagaaaagatgtagtgttttggcattttagtagataccaaccttcgtaggcttgtgttcaggggcaatgattgcggctgaacatgctggtttaagtagcggggtgtccactgccatagtacatagcctgatatactaattttgagcagtaggccctaccaaagtcgcctttgtttggagttattagactatatttcacatgtcgattttttgaataggaatgattagagttccaatatctccaatcggcccaggtgttggcaccccagtggcacctgaaaagcacgttcttccagatcatttcgggaggagcgtgtttttaggtgtgaactcaagatttaggagagtaatcgttagactaagccgtttggtcagccgagtcttcacggagattcgaggggacaaagctatcgggttcatgactctccatgatctgagcgtaatgatcgaccttgaagttaatcgtcgacaaatgtttctgtaaatccgagatttcgctcaaagtgcgctcctgttgggccttcattatgtcgtagcgttcaggaacggttgtttcaccttcctgaaccaaatctaagtagtgttgaatgcgttcaaccggcattccagtggctcgtaggcaaacaatgatgttcaaccattctaagtcatcgtcactaaaaacccgattattattctcatcgcgttggacgaacggcaacataccgtggtcgtggtagtagcgaatactataggtcgaaatgcccattttttgggcaacttcgtgaatcgtataggacatggcgggtcctcctttaaatgagttagcgttccactaactcgaagggttaagctatatagtactcggaatttgcggacgtcgcaagaatttgtctccggtaatcaacaaatgagttgccttcaagttggtcgaagggggtacactcagcataggttaaggaggtgacggtgatgcggcaatttaatagccaaccagccggggcagattttgtcccgttaggcgagtggaccccgcaaccgcagacgttgttgccggcttttagctgggaggcccgcgacctcctcgtagtggacgacgcgaccgacgagatgcaaatcatcgcgcaggctgatccagcacagttacttgatcggctgggaggcaccatttatagccgattgaatgaccaactgacacgagccttggcgccaaggccgttaccgacagcccgatatctcctgttagatctggcgatgttgagtcacgcaaccccacaagcaacggtggctggcctgatggggttggcggtggtcacggctaaggggcaagcgttcaccagtacgccttgccaggagtggtgagtcaggcagtctgctggttgcgagaaacgggcctcactgaacaccagttgttccaacccattggcgaggccactttacgccgcttataccagcaattgttccaacagcccgcagcttgcgatcagcaacgaccgtgccatactcgtgcagagaagctaacgcatgatacggttgccttactacaagggcaaattcaaacgctaaagttgccagtatcatggcagttattacgggcggcctcattggagcaaacaatctaataaataacagaaaaaaacagcgaaccataccatggttaccgctgtttttgggccgcgcttcttccgtaaaaacataggctgatcaaaaacgtagtagatatggaaccccttcgcagtccgcaaaatcatcgtgggaatgaataagtcggcaaccgtgaccgcacccaaaacttcctgttcccgggcatcgcgttcttgcgcgtcagcaaaatcaatatcaacgaccaaggtattaatctgagctaagttagcttctcggtgaccacgaacgctccccctgttctgcgtgtagcccagccagttaaaggtgttaggtgtccagtgagtcatccgatcagcaatggcctccaggccttcaaaagaggtgataaccacaccatgggctttttgcatggaatccttactgctgaagagcgcaatggcccctttctttgtaggggtttccatcacttgtccggcaatattaaaacgactatttttaactttatatgtatgtagtgaatcgtgtaataccagtctttgtgcagcctgaaccgtctttaaatcgtacatggtgagctcacctcctttcaaaataaacacctaagttagcttaatagaaaatacatagaaaatgaaaaagcgcagacaaaaaagcaacttagcgttatgccaagttgcttaaggtggaagtagtccgactacccccgaataaactttaaaattaccgcctacggatctaagtgaatagatccagtgaatttgcacagaagtcgctcaccacacgtgtccccttagtctttacccggcagcttgtcccctaccgttttgaaatcacaccattctcgacatcttaccaatttgctggtataatcttcttagttgaatgaaaaagattttttcgagtgctgaccaattcccgttggttggcgcttttcttatttataagagaagtgtacctcattatctcttcaaaataaagaagtttctttttttatatttataaattcatacatacatgaatttataaataaatgaattcatgtatgtatgattgaactaatttcctttgtaaagtagttattgtcaatagcaataggaaccttgacacaaacaacaattcaagttatacttattttgttataaattcatacatttatgaaagtgtggtgcttagaaattgaaaaaaataaatttaaaaagacccctcacaattactgttgcaaatcaaaaaggtggcgccggtaagagcacaatcactcgttacttagcctacagcctgtctctccacggctatcatgtgctagtcgtagatgaagatccacaatccaatactacaaaatcattcgtagtaacaaaagaacataacgaaccagattcagtttttgtcttagacaaaacaatgatggccggaatccgagaccatgatctaactgatttagtcgtcaacatactcccaaatttagatcttattccggcccattatgatttaaagaatctaacaaattatcttagcaaacagtatggtgtcgccgaagaaggggacgccaattaccacgaagttaaatcgaaaaagctcttctttttaagagaattacttgaacctctcaaaagccgtggaacctatgacttcattttcattgacacaccaccaacctcttctgattatactgactccgctgtaggagcgagtgattacgtccttgtcgcctttcaaactcaatcagattctctggacggggcccacaacttcattttcaatccagacgagctaccagagaaggtaaacgagttcggcgtgccaactgatgtactcggtattctaccgaatcaaatgcagcgatccggaagtattgacgaaactgtaatgcaagatgccgtgaacttctttggaaaggaaaatatgtttaagacaattgttccttacaagcgccgtctacaatccgcaccacgaaacggtctacgaaatgatagttactgggacaaagatatttttacttcattcttagataatctgacgaatgaattcattgaacgcgtgaacttaatggagagtgacaaatgatgactgaatcaagacaaaaaaaacccggttttttcacaaaagataattctgaaaaagatacattaaaaaaaggatcaggattactcgataagtcatacaaacctgatccgcagccaaaaaccctatatcgacctgaaccaactatagaaaccaataatagctctgggtccactcaaggattcggtaataagagtgaacgaaaatctttagttttgccggctgaacaatattatcagtttatggcactacttgatcaatcagaatttagttacacctatgagttacttggagatcaaatgcagccacaaattgataaaatgagtcaggtcgaacgacagatgtttgatatgaaggtagcccaactacgtgagaaagatgaaaagaagaaaagaactcgaaaaaaatcataagttcatacaagtatgaatttatgattgtataactagatttgataccactagttactatcttcactatgcttcttgattacgagcgtcatagactctctatcccgtgttgtaacattcatatttgtatactttcataaattcatatttacatacaagtatgaattttaaaaagtcagtcgttaaaaattacgtctcttcaatcttcacactttaacatcaataacgcttactcgaacaatagcatcattgatagctaccatgctatcaatgatgctattgttcgtcatattcaaattgctgtagatcaacaccaccttaattactcgaagcttgcagcgtcttggaaaagagagaacttcactataaaaagcgaaagtgttctcagaatgcgcctatttaacatctaatttaaaaatgtgctcttctacttgttgaaaagtatgctgaaattacgtgaggcgctgcaattaatgcgtagtagattaaaaaatctacactgctatctttaattatcaatataataagtaacatcgcagtagataagacgacaagtgtggtacgtaaccacggtactgttgtcacatgattgttttctttgaaacacggattcctacgctcaaaaagttttaatagcgtactaaaaattattaaaacgatggccgcataaatcattattattaaccatgaatgaataatctcaatcggaaacaaaataaaagcaatgattaggtattgaaaaagcgtgtagtttccataattaatatcaatcatctcgtttatctccctttcaattttaactacaattagatattggcaaatgtttaatgttcgatattcagttaaaatcaacgaatcccggttaaccttttattcgagaacttcttcattcaaccgattcttgatattaatgacagtctgaaccgagacgccggtttcagccgcaattgctcggtagctaattggggcaccggttgctttatttcttaactgctcaacgattcgatgataaataaaccgtttctgcggattaggcgagtcctcggcgtataccggccgagttccgcggtatttcccattaaccttagcaatctcgattccttgtctttgacgctcgcgaattttctttcgctccgtctgggccatataagctagcagcttagttagcatatcgaacataaatttgtccatatctgaatccccagtttgcattgaaagaaacggggcatctaagacttccattttaacctgtttatctctaatctgtttgattatatcactggcatcgtcatagtttcgactaagccgatccaatgaggccaccactaatgtatctccttgccgcacataagcaatcgccgcctgtaattctggtcggttctgggtcgatttgcccgattgtttttcttcaaagattttctcacatctggccactttcaaggcttcaatttggcgggccaaattttgatcagttgaactaactcgcgcataaccaactttcatcaataactctcctttcagaggatcagtctcccccaccctactgcgttctgtttagacactctaattagacagtttgacaaaaacaaagaactgcttgttatcccaagcagaatctaagcttttcttcataagttgattatactgctttttgtccatttagggtacacttaaattgaacagtttgttttgaattaatttgttgatatcaatcctggaaaagcagaattttgcacttatttcaagatgctcctatgtcaataaatggcacatctttttctaaacactcgttctaattctgtcggaattaaaccaactgatgtaatttgaggttcggattaccaagtcctcaaaattggaaataatttaaaatatcctttttcatgatctttcacctgtcttagattttagaagtatcacttggtttctcaattaacttaaaccgtcgctgctgcgtgcgtttactaatccccgtttttcgttcaatcatcttgtaggtcatgccttgttttcgcagctcataagcaaatctgatttgttcatcagaatacgttttcggtcgcccttcccgaaacaacggatcatgttgcttggcatacaatttaccttcttgtgtgcgcgtgacaatcatatcgcgttcaaactgcgcaaaggcgctaaatattgtaaagactaattggccagtcggcgtattgtcaattaagcccatattcaaaatgttgactttgacattttctttaaacaactcttggataatggctaatgcctcgcgcgtgttccgcgcaaaccgatccagcttagtgacaatcaaagtatcacctgtttttagagtgcgcaacagtttttgaaactccggtcgttcagtagttgtgccggtaaatttttcctgaaagatttttcctgctcctgccaattttagtaactcaatttgatttgctaatttttgatcagtggtactgactcgcgcatagccatatttcatctttttatctccttacttatgtcattaagtaatgacacggttctaaccctttaattatacagtatcaaaaaagaggccacaactgttaagttgtggcctctttttttgatgatctatacattttttgtggaatggcaaattctataattaatccgaacaaaaataaaaaaagacccaaagcaatctcttacaatggtagtagttaattccaaccagctataaggagtgattactttgggtacttctactttatcacgttttcaacgtggtgcgctagctcaactggtcagtgaaggccatcatacttaccaagatatggctgacgccttaggcgttgccaaatcaactattagctatgaattagatcgggtcaaaccctatgatcccgaattagcgcaacaagacgcagatcataaaaggcgggcttgtggtcgccattcaattctaacgccaatcaacgaccattaaaaatccatcatcaacagactgccattgaaagtttccgggcttgttcggattaaatttgcaatctaccattttctcgccaaaaaagccaagagccacacgcttttggcgtgattcttagctttcaagtttcaggttctaataaagtcggtgttttactttaatcacttaatacagggtcaaagtactttaatttggtataatcaacgtttccgccatcagtaattgctaaatccggaattgctgtgattggcaggaaggctaagtagaaaaggggatcaggtaacttgctgccaagttgttgggcagcattttttaattcaatttctttatctgctaactcttgtggagtcaagtcagtggtaatgcctgcaatcggcagttccagtagtgaaaggactttaccgtttaacacaactgcctgaccgccgccatgttcaatcaaggtgttggctgccaaagccatatcagcaaaatcatttccggcaactaccaaattattgtcatcaggggcacaggttgtagcaatcgcgccttgcttgattgaccagccggagataaatcctttggcgtggttcttgttgatgccgtagcgttcaatgacagaaaccatggcaacgtctttagcagcatctgcttttacgataccgtcttggacgtctaactcaacgtctcgctgtttgcgaacgaatgggccgatactgttgatcgttctaaccgttgcttttccatcagcatgatcagtatggtactcaaaatctgcggcgaccattggttcatggtgaacagtgtttaacagttttccactgcgtttaggtgggatgaaagaagcaactgcctgtttagcttcagtcactacttggcctttgctgatgaccgtttccacgttgaaggttcccggttggtcgaccaacaggatgtcagcagctttacctggtgcaaccgaaccaactaaatcatctatatgataagcttcggcaccgttgatagtagccatctgaattgcggtcattggagaaacgccggtattgattgctaaacgcaccatgtgatccaaatgaccatgagctaaaacatcgtgtgcattgacatcatcagtacaaaagctggtgtgacgagccattccaggagcattttcagtgatagctctaatattttcttttaagaatttagtgactgaagattcacgaataacgacgtgcaggcctttgcgggctttttccaaaaattcttcatgactgtaactttcgtgatcaacgtggacaccgctcattaaatactggtttaaagccttgccggtggtcattggtgaacagccaaaaattggtttgtgatacttttgtgccaaactaatagcttcaagagtatcgggatccttggtttcaaccgcttctctgacagtctcccaaacaccaaagcatttttcgtctggctgatatttggcgtggtcttttgcagtcacgtcataagaaatagtagattcaggaattgtataaggtgtcttataaggaagaccccaaaagactttaaggggagtgtgttcaatttcagaaaagatttcttttaagccgtcaacgccgattgctgagatgtattcatccaaaccggaaacaatactggtggtaccaaatggcactaccgcttgagcaaatctggtcatacttaatttgctgcattcaacgtgaatgtggccgtcgatcaaaccaggtgccaggtattttccagaggcatcgatgtgcttggttttaggcccaacgtaagcggaaacgtcctcatcaacagcaacaatgcgctgctgataaactgctacgtccgctttgtaatattcagaagtgtcaacgttgatcaaagtaccattttcgattactaagtcggcgggaatttgagcatttccggcatcgatatattgagataactgctttactgaagtcaaagaaatcttcctttcgctggggctgaattattgaattaagactttggaacaatgtttaaaacatagagcaaaatgataaagacaaacaacatgctccacatgatgccgttaacttctttgcgacgaccggcaacggtcatcaaaattgggtaggttaagaagccaaaggcaatcccgtaagaaatgttatatgttaaaggcattccaacaacggtaagaaaggctggcaaagcttcttcaaacttatcccagttaatttctttaagagctgaagccatcaaaacaccaacaataatcaaagctggagcagtaacttgatcggtaacaacggtcaatagtggtgagaaaatcatgctgaaggcaaacaggataccaacagttaaggaggtcaaaccggttttaccaccaacagcgatgccggcagatgattcaacgtaagcggcagtgggagtagtacccatgatagaaccactgagcattgaaacggagtcagccatcaaagcacggccaattctaggcatcttgttgtctttcataattccggcttgttgggcaaggccaatcaaagtgccggcagtatcaaagaaagcaaccagtaagaagatcaggacaactgcccacatctgtggatcagaaattgcaggcagatttttaatacctgcgccaaaggttggtgccatgcttggggcaagtgagatcaagtgtgatggtaagtgaatcaaaccagtgactaagcctaagataacagtagagaccatcccgataaagattgagccgggaacttttttagccattaaaatcgcaattacaaatactccaaaaattgttaaccaggtagttggaacagtaagtgagccaattgcgaccagtgaagatttgttggcgacgattaaaccgccaccttgtaagccaacaaaggcgataaagattccaatgccggctgccatagccattttaaggtttttggggatggcgttaataacgatctcacgcaccttcataaatgagagaattgtgaataagactgaggcaacaaaaacgccggccattgctttttgccaaggaattcccattcctaaaacaactgagaaagtaaagaaggcattatcacccaagccgggagcaatggcaattgggtagtttgctagaaaggccattaaaacacagccgataattgcagatacagcggtaacagtaaaaatagctcctttatccattccagcggccccaaggatgcttgggtttacgaataagatataagccattgaaacgaatgtagttaaaccagccagcatttctcgcttgacagtagtgtgctgttcagttagatgaaaggttttgtccagccatccgtgttttgcgattgaaacagtgtcaactttttccattgttcagattcctctcttaaaaccattttttgcgacagttcgtattattacatgaatcgggaataaaatcaatagtaatgttcgtgttttgtactattgacatgctatcaaaaagtgataaagttagcatcataacaaatatacgaacattttatttttggaggcttattaatgactacaagtgttacccatgaatttactaaaggattaccaaaagccgaacttcatgtccatattgaaggaactttggagcctgaattgaagttgaagttggctaaacgcaatcacgttgatattggccaagatactatagaagaagttcgtaaaacttataaatataatgaccttgcctcattcttagcagtttactatcccgctatgcaggttctactgaaggaacaggatttttatgatcttgcttttgattatttaaagcgcgccgctgctaacaatgtccgccatgtcgaaatcttctttgaccctcaagcccattccagccgtggagttgcatttgaaactgttattcatggtctttacagggccactgttgatgcgcgtgctttgaacgttgatgctcatttgattatgtgcttcctgcgtgactttactaaagagtcggctcgtaagacgttgttagaagctcttccatataaagataagattgttggcattggcctggactcagatgaacataataatcctccaatgaagttcgctcgtcagtttgaagatgccgctgccgcaggttttcatttaactgcccacgccgacattgatcaaaaagactccattgaacatattcgccaactccttgaagagatggatgttgaacgtatcgatcacggtaccaacgttgtcgaagatcctgatttagttgattttgccgctaaaaagggtgtcggcttcacttcctgcccactgtcaaactcttttgtaagacctgatatgaagggtaaggaagttgttgaactgcttaagaagggtgttaaagtttcaatcaactccgatgacccagcatactttggcggctatattgttgataattattacacgatcgccgacaagtatgatttaaccgaagcccaagttgttcagctggccaagaactcctttgaaacttcatggattagtcgtgaacaaaaggatctttaccttaaagaattagctgattacgtcaaaagcgctgatgctaaggctgtggctgaagattaattgtgagagttttaaaaaagctgttgcgaaaattttttcgcagcagcttttttgtcttcgaattcaatttttctggttaaatatttttctagtttagaatgattattaaaaggcgtggattaatatgttatcattaagctgtaagctttttggtgagatatttatatagtaggtatttactttaaaggggagaaattattatgaacagaaaaattgcttttgacattatctcggtgatttactacgccattacattactcctggtaatcttgaacaaaagtatgctggcgatgtattccatggctatcgggatgtggtagcgtcaagaatcttgtgtaaatgaaatgccttcgtacatataatatgtaactaactcaaataaatgatgcttccaaggtgtcctggagtcctttaaagcctcggtggatccgcttcagagacttctcgttataagcattaaactgagaaaccaggaatcgatccagtgaatcttccgttggaaattgttctttgcggtgggtggtgcgcttgagatgcttgttaaagttctcaatcaagttagtggagtagagtgattgccgaatggctggtggaaagtccatgaaagtgagcagattcggcattttaagcagatctttgattaacttgggataggtacgatgccagttgttggcgaactcattcagtttcagttcggctgcttcacgattggcagcccaatgaacttgtttaaagtcattgatcacggccttacggtctttcacccgaactttgtttatcaaattacgcccaacatgaaccaggcaacgttgtcgtttagctttgggaaaatgccgatttaagccttcatccaaaccaactaacccatcggccacaaacaacagcacatctttgacaccttgcttaatcagggttcccagtaattcagtccagatcccagttgattccgtcggcgccacttggtagttcagcacttctttcgtaccatctggacgaatgccaatcgcaatatgaaccgcttctttttgaacggtatcccgctttaacggcaagtaagtggcatctaagaagatagccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcagtttgaagcagctggttgatggcgatttcaaggtggtgacgaaaaacttcgtccaaatcttgtttttgggctagtgcagcgataatttctgtggtaagttcattcatggggaatgcctcctgtgatgttttctgtggttactaaatatcataagggaaggcattccctatttctatacaatttagaaatcttttatgcgtttacacaaaatattttacgctctcagacacaatttgataggatttttactagagaggatcgtgtctacactttcatcctaagtccaatttcatagtcggtctgtttttagaggtatttacggtataataatcgacaaaccgagttgtcattagagggattaagttctcttgagttagcatcgaacatttttagcccgtctttgacacattattttaatacgcgtggtgctagttgattttgaaccaggtatcgataaaaagacactgttctaggcgtgcttgaaaccctaagtatgatcgcgcagggttgtgttcgatattaaataaacaacataattgcgaaaatactgtctctatcctacgccgttggcgttttaataaggtttcatcacttgaacgttgtttcatatttttacgacatggtgtccgaaaccagatgccctttctttttaaatcggtatgcagtgcatgactgatataccctgaatcagccagaattttggcactaaaatattggtttactaaggtttttaccaacttaacatcatggattgaagccttagtaatggcgtatgccactacaattcctgcatttgtgacctgaaaatggcctttgaaaccataaaaccatgttttcttggtcgcattatagccaattgaggcggttggactaaaaactttggcgctatgattgcggattggctgacacagaggcatcggcatactatcgattatggtataggttgccgttggcaacgcttcttgcagtaagccatttctaatcatgttaaacaaagctccggcttgctgacaaatacggttgaatcgtgatctttctggcagtaacagccccaaactagctaacaagcgataaaaggctcgctgattttcaattccaatggtaacttgccaacacattaaagctagtactgtcacatcttgtaggatagcttgcgtcacattctttcgatggcgtacaaccgctggcacgtatttgtggtacagcggacttaggattgtttgccattcgaaccatggggcttgtattcgattattactttgattagacttaaattggtctgacatacttaacacttctttgctctagattgctttaagtgtaagccgtcaggcttttttactgtctaaatttaactagcaccacgcgtttttaatatctttttcaattcctcaaatagaatctcatttttaaatatcaacaaagtggtaaaatatactattactgataaaacaacagaaactacaaaagatactatatatggaaaatttaacaaattgattagaaaacaaattaaatatataaataggcacccaacaaaaacagaaaataaattattcttaatatttctaactttaacaacccttctaccataagaaatcgtaaatacacacatcaaaagttccgcaattactgttgcaaaagcagatgcattttcattaaagaaaggaatcaatgcaatatttaaaataatatttaaaactgcactgtaaattgtggcctccaaaacttttttttctaatttcgcaggtatcaacacgcaagaagtatataaccagcttattaccgagaaaactaaagctatacttaataattttaaagaactgtcagagcgaaaataatttttcccagcaattatataaataacatccttacttacagaaaaaattcctaacattgcaggaaatactaaaagaactatcaaattgaaaaccttattaaatattttttcaaattgttctattctacctgaaccataatacattgataatctaggtaccgtcaccaacaatacagctccaagtaaagatttgataatagaatataccttaaccgaaactgaataaatgccaactacataatcatttttcataaaccccaatattgtaacatcagaatttatatatattagagtagctacacttgaagcaaaaattaccaaaatcggttttaaatgttttcttaaattaactttttttactaaactagttttacaaattttttttgcatgaaaataattaaagatattagatccaactgttgcaagaacagttataaaagcataattgtaacaatcattacggttctttacaaaaataaacaacatcagaatcgaaataactttaaaagcaacacttctaatcgtaatgtaagcataatcttcatatattgtatacaaccactctttgcccaaagtagtaaaaattaattcaatactgaatatcaaaatcataagattatattctttcaactttggaataataagcaatgttaagaaaagaacaatataagaaaaaaaagtagaatagaaattgatggtgtagacttcagatgaaaaggaacttataatttccttttggtctctatattttgcaccttccctaactgcatatgtagaaatacccaatcctgctaaaagtaaaaagtaacttatatacgttaaggaaaaattatattgcccaataccagtcacaccgagcactcttgaaatataaggaaatgttattaaaggaaacaatagattcaaaaatgtcctaaatccatttaataaagcgttcatgcccattgatctctttttcataatcttccctcaatctttaaaagatttttacaacaaataaatagttttttgattgcacttgaatttagcacactaaaatagtaaattatatgtctttagtagatatcactttctctatgcaccttttttcgtatttattttaacacgattatgtaggatttctaactaactaattgttccctttcatctggagttaaatagccatcggcactaatgatccgccaagaattataaaatccctcaatgtaactaaactgagccaaagtggcttcatgatagtctttgtaagtccgttggtaaacctccttcttcttaaagctggcatgatagccctctcctcgtgaactttaggagcgccataaacccgccgatgatcaaagtagatgcgtcggatttgctggtataaaacttggcgccgcttaaactgttcgggcttagtctggtgctggtactgatagtaggttgatcgacataagtgcaacgtctgacagacttctttaacgctatgcgctgatgccgttactttaatagctgactgccaatctttgatacttacttttttgcgaatatggttaatgctttttttaggatatcgttttcactttccagcttggtaattcttgcctgcatttctaacaagtcggccttggagaccccggtatcattatctttcttgtacaaatcactccttatagctggttggaattaactactaccattgtaagagattgctttgggcctttttttatttttgttcggattaattatagaatttgccagatgttattaatatcagtcttgggtttggttaatccgtcattacgttttaatcccctaacaatactcaaacaatattttgtcaatttaactcctccgtaaaccgtttttgattttaaccaaaaaatcccgcaagttcggtaaaagcactaccaaaaccacttgaatcttagacttaattgtcacctcgttactagatagataacgcattaaggagcgtaacatgaagtatctaagtatcttggataatttatgataattgtttcctgttttttcatgtacattaaaaaacatattcaaataagtttttgcatagtgaacttttaatgcattttgttcaatctgtgtagtgcccaccattaccttttgaacttcattaacggcatgcaattccgcaaaaatctctttcgtacttttttcttgcttatgagttaacgaattagatcttactatgtagtgataggttgcaggagcaaaaattacttttccttgttttatatgagccaaatatttcacaacaaataataaatcttcactactatttaggttctcatctaatcgtagattgaatttatttataatactcattgtaaacattttattccacaggtaccccaagacatctttcattcccaaaactttaaccatgtactcgcttttacttaaagtttttgcttgtacttgactgttttccactttggtatcacttttaatcacattaacagaacatatttcagtagatccaatagtatcaagtagattttgcaagtgatccggttccacccaatcatcactatctataaacgttacaaatttggttttcaccaaatctaatcccatatttctcgccttagaggggccatgtatctccgaattattttttttaacaaaaaagcggttatcttttgcttcccaagatttgcaaaattcataacttccgtcggtcgacccatcgtctacaataattacgttgaaatcaatccacgattgattaactaacgattgaaaacatgtttccagcgtccccactgtattaaaaacaggtataataatcgacacagtgttcaaaaacatttctcctctcacgtcgtttcatgtctatctctacaataaaaccaattaaaaacaaaccaaaatataactatcttaacgcgtggtgctagttgattttgaaccaggtatcgataaaaagacactgttctaggcgtgcttgaaaccctaagtatgatcgcgcagggttgtgttcgatattaaataaacaacataattgcgaaaatactgtctctatcctacgccgttggcgttttaataaggtttcatcacttgaacgttgtttcatatttttacgacatggtgtccgaaaccagatgccctttctttttaaatcggtatgcagtgcatgactgatataccctgaatcagccagaattttggcactaaaatattggtttactaaggtttttaccaacttaacatcatggattgaagccttagtaatggcgtatgccactacaattcctgcatttgtgacctgaaaatggcctttgaaaccataaaaccatgttttcttggtcgcattatagccaattgaggcggttggactaaaaactttggcgctatgattgcggattggctgacacagaggcatcggcatactatcgattatggtataggttgccgttggcaacgcttcttgcagtaagccatttctaatcatgttaaacaaatctccggcttgctgacaaatacggttgaatcgtgatctttctggcagtaacagccccaaactagctaacaagcgataaaaggctcgctgattttcaattccaatggtaacttgccaacacattaaagctagtactgtcacatcttgtaggatagctggcgtcacattcttttgatggcgtacaaccgctggcacgtatttgtggtacagcggacttaggattgtttgccattcgaaccatggggcttgtattcgattattactttgattagacttatattggtctgacatacttaacacttctttgctctagcttgctttaagtgtaagccgtcaggcttttttactgtctaaatttaactagcaccacgcgtaagaaatgtatttaaatgtaacgttaaactccattgcctctgatacagtaacgcaaaaagacaagacaccaaaaatgatgccgtgaaaacaacagatggcgttaacaatatccgattactaataaaatagttaatcacgagtacaattagtaacagacacaccaataaaaaaagtatcacttaccctctctcacataatcaattcttagctttctcatactttgaacggtcaggaaatcgctcattcaagtaactagctacttcggttactgccttttctgaaaactcagattcctgatcgacatcatttatacaaataaacttatgatgtttatttcccaccagttcacgttttaacctttcaacttcatccacagtaaaaaaggctgacttatttgaaaatcctgcataaaatttaccggaacacatttgatagtatctaataacccaatcactaacatcatctgttgacctaatcctatgactacaagtttcttctaacttttcagtttctaaattccacatgttttcaaaactatttttagtgtaagctattccttggtgttgattatagaatcctgtaatacctgtccacggtaaagataaaaaactacgtaacactaatttaccattttttaaattgaagatttttttccaattttttctcaatacgttcttttttgaaaaatgcttgtttataatcagcatatcattcaataaaatatgtgaaaagtcattctgagatggaataacactaaaactcatactatctactggtaaatctcctttaaaaaaatcatcaatagtagttttatcattaaacaacatatcatcatttagtaatacaaaattttgattaagtccggaaatatgatgaacgttcaactcaatagtattggtattaaatgtaggtaaatatcgggaattaataaaatctttatgatcaacaaccgtaactttactataattatcatccagccattctggcttttgattatcagttaccaagaacacatgatttacccattgtgcattctgttcaattgaacgaaataaatacttcaatgtcccatagtctctgtagcgcatcgttccattataagtttcttcactagaatcgtaatcgttacccttggtaaaccttgcctttttcttttgccactctggatcgttcccatcaacccagggaataacaatatccgccttgttcaaataattacacaccctttttactcactcacttaaaaataattactgcatacccagcatgtcgaacatgaccactcaaccatgctttcacatcaactagttagttaaatctacttttactcaatgcgaaacctctaggtaaacctgtttgagtttttttaacatgtcattataattgaaatatgtttcaaatctttttctacctgcctcacccatttggtggatagaatctgtagacattgctgttagttgcatcaacgcgctagaaagcgcctctacagattctgatttaaatgttattccagtttctttatcaatcacaatttctggcaacgctcccgcatcactagccagtaccattttcttcaaatgcattgcttccaaacagactaaccccaggccttcccacctagaaggaattacgagcacatcgttttgagataaactttgtgtaatatactcttcatttctccagccaagaataggtacttctttcctaccaaaccaacagtaatgtaataattttggtattgtcatatagctctccctctgaaatatcaataaaaagtaaacaactctcagttagtaaaaaatgttacgtatggaataacatcagataaattcttgttaagctgtacatacaaaggaataaatgttactgcaatcactccagatacaatcaaaaatcgtatacataatttatgcgtatgcgttgtatcaatatttataataagcagttcaataacttctggaatatacataatagaaaatattgataaatatagaaatacacgtgtcattaagatgtctttataaaaaaggattccaaatatgactgcaacaagcattacaagtgttaagaacgtaaagcgatttcttctttcttcatctttaaatcgaaccttacacaaagctgcaatacagataaatcctatataaaatattgtcaataataacgttccgccattgctatgagaagagagcgtttcaacatctgtaacgttcgacgatgaaccatacattaagtacgacggaaaaagcaccataaaagcattctgaattttttggtaaaatgttaacaaaatgaccataaaggctccaaataacgtcaaacgcttcttattccagttaatcgaatggataataaaaaagacaatccctataaaagcagtactgtgtatcaaacatgcaaaaatgaatagaatccaaaaaaagcatgtttttttttggttcaagcaaactgtagcaatcattaacacaccaattgccaaaaattggcgactaatattcatactattaaagaagaagtataaagtaacatatagtatattcgacaagaggacattatcagaataataataaatcgaaattgcaactgtgactatgataatcaatgaagtcactgctacaatagtctgagatttatcactgacgaaatgcaatagatatgtgtataggctatataatggatatttactacccaaaattctataccaatttcctgcctcataatcccaattatataggttattatatagctgtgtatctgttcctacacttacagctcttacagcagaaatagatccgaaaattataatcattagcaatgattgaatttttttactgacttgtttattaaatgaaacacttattataactccaaaaaagatgtataaccctaacagcataaaataaaataacatattaactattcaccatccattataatttaaaatggattctgtgatatattcctattacccgttgtggcactaaacatttcagtaactcatatatcataaaaacatcataatacattggaatattcaatggttttctccatttatacatgcattttactaatcgcactttacgaatcgcattacgcctttttaatgaaaattgatcttctcgataatctaataaagcattaggcaaatttacacctattaatccataggagtaaaatttacaccaaaagtcataatcttctattcttattacgtcatcacttgttgaatattggcccactagatctaaatctttttttctaaacatgacggcaggatgtgtaaaaatttttcctctccaaatatccttattagttggaaaattaattttatttgtctttccatagatgccacttgaatcaaaaaagtttgcattactacttataattgaaatcgttgaatattgatccaaatactcaacctctttcttaagtctgtcaggatgtgaaatatcatcatcatccattcgtgcaatataatcaccttggcattgttccaatccgtaatttagagcattagtaaggccatctgaaaattcattttcaaataccttaatacgatcatcactttcttgaaaattttcaattatattctcagtatcatcagtagaatgatcattacaaataataaattcaaaatctgaaaaggattgacacagtattgatgcgatggcctgtttcaaatgtttatgaccattttttgtagccataagtaccgacacttttggcaaaatacaaacctccttcgtacttagaataaaaaaatcttcattcattaatctcttagttcagtaataaaaatcaagtaatgcagaattataaattttctcaatatttctggtcatgttttttgacgataatatgtcatttttcgccactaaattactaatagactcacgatctggcatattctccaagctatccagaattgttttacaccaataattactattatcccctgatattactttaaaaagttctcgagaaattttagcttctaccggtatgccggtagaaacaaatgttaacaaaccatttgtttgtgcttcaatagccgtcattccaaaagcctccattgaagagggaaaaatatagcagtccaatgcagagtaatatttttcaatatcagatctactatcaagaacaatcaccgcaacacttaaaattgggcttttacttacctgattttgtattttcgttctcatagggccatcaccaactaataaaaatctaaaattgggattatataaagccaatttttcaaacacacttaatgcgaaaggaatacgcttataactcacaaatcgacaaaaactgcccattaatatttggttatcactaattttcaactcgttccgtatttgtttgcgatttttatttgagaacgcaaaacgctttgaatcaataccattctttactactttaaaatctttgtgtttaaatacccaactgccagatttttgcgtaggcgctatatacacatttggaaaaactgtattaaaaaaagacaaaaactttttaataacattctttttaattccatcgtctggtgatatcaagttgtgattatgtgcaatacgtactggtacatgacaaatataagctgaaaacatggggaatacatttaatgcactaatgtttgcatgaacaatttgatagttttcttgtctgaataacttatttaacgctttctgatacttgatcacattttgatacggaggaatgtatttaacacgtccacctaaggtactgattaactctgctgggacatttgtagagtctgaatcaatgataatatctatcgcatatgtttctgagtcattgaacttaagcaaattcaaaataaccgattcaaccccaccaccaaccatctttccaacgactatgccaacttttatttttttatattctttagtcattcttctaccacacctactaaatcaatataaatattttttgcatttgttccgccattagcggttgttgcatttgtttctgtgctagaactggagctagaactggagctagaacgactcttactcttcgaattcgtactactaaaaaccgcaattgatccggtcttcttgtaagataagctcaagccattacgaataaagtttgtcacgaaaaattctggactcgttgtgcttagaaaagctagtgccgttttaatcttcagttggggcgtcttttttggcgattagcaaatccaaatccaacaattgcttatcagcaaccgtggttggtgcttccgtcattggttcagtggccttcgaattcttagggaaggcaatcacatcacgaatattgtcacgcttagctagcaagcgggcaaatcgatctaagccaatggccagaccaccatgaggcgggaaaccatagtctaaagctttcagcaggaagccaaattgactttcggcccgttctggtgtgaagcctaaggcctttagcatcttcatctgtagctcacgcgtatgaatccggatagacccaccgcctaattctagcccatttaaaatgatgtcataactctgagcgtaggctttatgtggatcttcaccgtcgttcaagtagtgcgcatcgccttcagccggcatcgtaaatggatggtgcgctggtacccaccgctccagatcaacgtcgtagtcaaataatggccagttaacgatccagaggaaggcccacttgttttcgtcaatcatatcttgttccttggcaatcgcaacccgcaagtaacctaatgtttgcgcaacgactcgcttggagtccgccgcaaataataagaggtcgccagatttggcatcggtggctgccgtaatctgatcgaaccagtcaccttccttaaagaacttcgcaattggaccgctaaagccatcatcggtaactttcaaccaagctagacccttggcgccaaatcgttcgatgtacttgccatacttatcaaggtctttacgactgtataggtcagcaccaccaggtacggcaatggccttcacttgaccaccattagccacagcaccggagaagaccttaaagtcagtatcggccatcatttcagacagatcctttaattccattccaaaacgaacatctggttggtcagttccgtaacgggccattgaatcatcccagtccatccgttggaatggcaacttaacatccacatttaaggtatccttcatgactttcgcaattaagccttctgtcaaatcttggatttcttcagccgtcaagaaggaggtttctaagtcaatctgggtaaattcaggttgccggtcgcctcgtaaatcttcatcccggaaacagcgggcaatttggtagtaacgatcaaacccagaccccattaatagttgcttgaaaagttgtggtgactgcggtaaggcgtagaagtgtcccgggtaaatccgtgaaggaactaaataatctcgggccccttctggtgtcgacttggttaagttaggcgtctcaatatcgataaatccattgttatcaaagtaactgtggacggattggataattcgattccgcaaccgaatagcacgctgcatctcgggccgccgaagatccaaataccggtactgtagacgtaactcatcagaggcattcaaatcatctttaatatcaaatggcaaagctttggatttatttagtagattaatccccgtgacccggacttctactttacccgtacgcatgtctgcgttaacttctttgtcagcccgcgcaaccacttgtccctgcacttcaatcacatattcgttccgtaactgatcagccacagcaagggccgcttgactgtattcttcactaaagaccaattgcacgattccttcacggtctcgaagatcaatgaagatcaaacttcccaggtcccggcgcttttgcacccaaccttttagaacaacgatctggtcgagataagcttcatcgaccaagcccgcataggtggttcgttttagattcttttccattactctgcccctcttattttgccgtaaatttagttgcgacgacattttggaaatcttgataaatatcagccaatggcacgctgatttcttcaccggtagccatcgacttcaagttagccgtatggtccgccaactcttgttcaccaatcgtcaacgtataagcggcattaagccgattagccgtcttaaattgggccttaggcttccgatccagataatcccgatcagccgttaagcctgactgacgaatggcctgaacgatcttgagcgttgctaacgacgtctgatcaccaatacccacgacataaacgtccagtgggtgattatctgggattgccacttgctcggcctgcattaagagcactaagcgctcaacaccaagaccaaagcccacgccaggcatttctggaccgccaagttcttctacgagaccattgtaccgaccacccgccagcactgtcgtataaccttcgcccagtgccggtgaatcagccataatttcaaaaattgtgtggttgtagtaatctaacccgcggaccatcgtggcatcgacatcgtaatcaatccctagcgcatccaagctggccttcacgcgatcgaagtgcgccgttgccgttggcgttaagaagtccaaaatcgatggcgcatccgccactaattcctggtcgtgcttgtctttactatccaaaacccgcaatggatttttgtgcaaccgtaccttggaatcttcactcaattcatcgaagtgaggttctaagaagtcaatcaacgcttgacgataagccgtccgcgtctcctgatcgcccaacgtgttaactgctaaccgtaaatgcgtcagccctagcttgcctaacaagttcatccctaaagcaatgacttcaacgtctaattctggtgcatcgctaccaaaggcttccaccccaatttggtggaactgccgttgccgaccagactgtggtcgttcataacgaaacatcggtcccatataatagaccttgtaaggcttttgcgtttccggtccatacaatttattctcaacgaaggcccgaacaacccccgcggttccttctggtcgtaaggacaggtgtcgatcccccttatccttaaaatcatacatttctttagttacaatgtccgacgtgtccccagaagtccgtgagaaaacttcgaagttttcaaacatgggcgtccgaatttcttcgaaccgatagttggcaaataattgccgcgcagtggcttcaacaaattgccaggtctgtgaatcacccggtaagatgtcggccgttccttttggtcgttgataacgcatgttcaattctcccttctcattgccgcggaaaataaaaaacgcccctgtcaattgacaagggcgcaggtatgcacggtaccaccttttatattttctgcaggataacgttgcaaacgaatggtcgctactgccaccattagcctcaaaagtgtcttcaagttgcgcccgttcgtcattttcagcaagttgacgtctctgtcagcggggtaggccttactagtctttctctttggcaatctattttattcttcttaagaatactgaatacactgaaaaaagtcaagctgttctgccaagtaactcctagctaacggtgatccttgaccgtcaaatgggtgactaaatgccggacctggtggcgacgatttgacgtcgcattcgcccaatttagtaacgtttgaattgacacggttttaaccatctcccgccgaaaggaatgcacgataaaactgtgatagctaacgtgaccggaatgccaagtaaaccaattgggagctaagttcttttcggccgcagttattcgctgatctggccagactaaataccggtcttgaccagcatgcggataaatatcaatctgccgcccggcatcgacatcactaacctcttgccaacgctgcaaatggcgttgccgatcatgatcaatcgcgtacaagatcacgctaacataccgtaactcaggctggcggcgttcttctcgtaacgttaatttgggtacggctggcttagttttggacgtcgtgtttacgggaaccgatcggggcgtttgccgagaccaccaggcaactcctatcactaatcctattattaatacccccaaagctccccactttttcatctcaacagccaccttaaattttaagcttgattctgccagtttatggtttatctgtcaactcactgatggcttaatcaaaattttatgagcggcaatcagactcccaattgaatcgtgctataattaagcttaatttctaaaaaatgtgctcatcatgaaaaagtgttaaggagattgaacatgcatttcaaacttaaaaactggtcaggcctcgtcaccagcctagttattctcttagtcgctggtggcttattgtgggcattcacccaacataatgccgtcacagcaaccgtcagcaacttgaacctacgtaacggtcctggattaacgtatcaggcgacccacaaagtcaaaaaaaatagccgattaacgatcttaggcgaaaaaaacaattggtatcatgttcgtgatagccaaaatcatttcggatgggttgcgagttggttggtcgaccatcccggcagtttaaaacgcgtcaccaatttatccgaagcgacgattgttctcgatcctggtcatggtggtagtgattccggtgctttatcaatcgatcaaaaacacgacgaaaaggtctacacactggctttagctaaaaaagtggcccagcgcttacgtgcccgcggcgcacatgtcatcatgacgcgtgataccgataagacggttagtttggccgaccgcccggcactagcaaacaccaatcaagccagtgcctttatcagttttcactttgactccgccccagcagataatctgggatcaggaacaacgacttactactatcatcgtcaaacttcttacgctttggccaaagcaatcaatcagggcatgagtgatctaccattaaccaatcggggcgtcaaatttggtaactttgaagtcatccgggataacagccgaccgtcacttctaattgaaatgggctacatcaataccaaaaaagactttagctacattcgccgcgccgcctaccaagaccaggtcgcaaaacgtgttgttgctggcctaagcacttatttccaatctgcatcctaataattaagaaagaagatctgatgatgatgctcacatctgactggctccaacagctaccacttcctaaaatcacggcgataaccccggtagctggcggtgatattaatcaggcatatcagctgataacggttgaaggaccagtattcttattggttcaaccacacacttcagcgcaattctatcaccacgaagttgccggcctacaggcactaggtcaagccgtcaacgtcccggatgttctcgcaaccggtgaaattgaaggggatgcttacctcgttctcgaatttttagaaactggtcacggcagtcaatatgatttgggccaagctgtcgcccgcgttcaccgggtaaccgccccacgctttgggttcgatacggataacctcgtaggtaagctcccgaaacataatcaatggcaatcggactggacaaccttctacctccaacagcgactggaccccctagttcgtcgggcccaagaacagcacctatggacaccgcagcgacaggcagcctatgatcaagttcgccaacggatcatcacagaaaatcatggtcgttttattcagcccgccttactacatggcgatttatggtccggcaactatctcttcactcaagatggtacgccgaccctcattgatcccgatgtcttgtacggagatcgggaatttgacctagcaatgacgaccatctttggcggttttacgagcgacttctaccggggatatcaagacagttatcccttaactcctggctatgccgatcgcttaccccactaccagctgtactatctactcgcgcacttgaatctatttggtgaaacgtacggtgacgctgttgataacgtcctcgcccgtggataatcaaaattgaaaaacccactgagttagcgcaatgccaactcagtggggctttttttaggcttgtaaccacgccaataactcggccagacgaatcactcgaatttccgggtggctttcatccacaatcaagtgttcgggatcaaacagcgcaccggccatgccagctcgatgccctgcttgaacgtctaaattccgatcgccaatcatcaaggccgactggcgcttgaccgcatattgttggcataacgccaacaggcttgtgggatctggtttgcgcggataatcatcgtcggccgtgacctgccccgaaaaatactgtgccaaatcagccgttgccaaacgatccatcgcacgatgattccgatgcgttaacaaaaagttacgcccacctgccgcaacagttgccgccaaaatttcagcagcaccgtcaacgacgggcgcgtcagctaagcggggttccgcgcgcaactgatacaaccgttttaagcgggaaacatccaactggtactctgccgaaaaccgttgtaacgctgtacctaggctgtgttgtcgcatcgcttgatagattgcatcctgatcaatttcaaagtcattcaccccgctggcaacaagcgcctctccaaaggccgccaccatgcccggatacgtgtcaactagggtcccatcaaaatcccaaaaaagctgtgaatagcgcataaatcctcctaaaaagcgagttcaggacagacgtcctggactcgctgtcttttcatctagtacggaacaggcattaagtaacctgtctgtccgatttttctctactggtttttaagcatccgtatcaaaccagatggttacaggtccatcgtttaccaatgccacctgcatatcagcaccgaacacaccagtcgccaccgttaatccagttgccgccaatttctgattaaattcatcatagatctggctagcatgctgcggatcaccggcccccacaaaactgggacgattgccctttttggtattggcatagagggtaaactgcgatactgacaagatctgaccaccaacgtcattgatgctcagattcattttaccggcatcatcttcaaaaacccgcaagtgactaatcttatggacgagataatcaatctgttcgctggtatcttgatcctgtgcaccgaccaataataaaaatccgggtccgatttgaccatgcacagcattatcaatgctgacacttgcctggcttacccgctgtaataatacccgcaattcatgccaccacctttcgttaatggaatgcccgcttaacgacataaacgtccgcgacatttttaatattatctaaaattcgttgcagctcaacgcggttccgcgttcctaagctaatagaaatggtcgccatcttattgtgatcaaccttgccattaattgacgttaagtacttcgtattattattaatcgtccgtaaaacgtcatttaacaggccgttgcgattgtagccttgaacttcgatgtccgcattgtaatttgtcttgtcaccagcaatattaccccaacgaactgcaacaatccgctcgccattttgttcggcattcaacacattgggacagtccttacggtggaccgatacgccacggcccttggtgatgtacccaacaatatcatctccgggaaccggcgaacaacaatgactcagccgaattaagaggttatcgaccccttcgatgaccaccgcatcaacatcttttttatttttgcggtctttcttatcattatccggttcattcttaatcgtttgatgttcttctagtagttctcgttcttcttgacgccgccgctcattttcggcagcctgacgaacgtcatcggtcaatcgattgacgacccctcgcggctgcacatcaccaaacccaattgcggctaataaatcatccgcatgttgatagtgcattttagccgtgactttatccagattctctttactcatcaaagccttgggatcataccccaattcatgaatgagccgagccaccatctcttgcccttgaacaatgttttcttcccgatcactttgccggaagaactgtttgatcttgttccgggcccggcgagtcgagaccaatttcatccaatctcgactcggcccggaagaactagcagacgtccgaatgtcgacaatatcaccgttcttaatttcgtaattcaacggcacaattttaccattaatggttgcaccagtcgtatggtgccccacttcagtatgaatggcatacgccatatctagtggccccgcgcccttaggtaactctaaaacgtcgcctttaggagtgaacgcatagacatgatcgccaaacaattcgcccttaacgctatccataaagtcagaagcgtcatccgtatcttcttgaagctcgataatgtgcttgaataagttcagcttgtcacccgtgttggttgtctgaaccttatccttaacgccttccttgtaagcccagtgagcagctaccccatattcagccacggcatgcatttctttcgtccggatctgaacctctaagggtttgccctctggcccgataacagtcgtatgcaatgattgatacatgttggccttaggcatcgcaatgtagtccttgaatcgaccgggcattggcttccattgtgagtggatcgctcccaaaacggcataacagtccttaatcgtgtcgacaatgacgcggatcgcgagtaagtcatagatctggctaaactgtttgtgctggtctttcattttacggtaaacggaataaatatgcttcggtcgcccataaatttctggatcaatctttagatcactgatagatgcttgaatgtctttaattgcacccgcgatatattgttcccgctgatcacggcgtgaattcatcaggtgcacaattcggtaatactgttgtgggttcaagtaacgtaacgagacgtcctccagttcccacttaattgtactaatccctaaacgatcagctagtggagcatagatttctaacgtttcattagcaatccgccgttgcttatccggccgcaagtgttctagcgttcgcatattatgcagccgatccgccaatttaacgatcatcacccggatgtccttggacatggccaatagaagcttacggtgattttccgctagttgttctcgattggatttgtacttaatcttcccaagtttggtcacgccatccacaatcaaggcgacgtcatcgccaaaaagttcgcggacatcccccaaagtggcccccgtgtcttctacaatgtcatgcaaaaaaccggcagataccgtttcggggtccatattcagatctgctaaaatcccggctacttgaatgggatgcatgatatagggttcgcccgattgacgatgttggtcttgatgggccacagttgcaaaatgacaggctttaaccaccatttccacatgctgcgcattcatgtatttaccgactcttgcaatgacttcatcagccgtccagacacgttctttggtcatatggacgccaccacccttagtttttaaattatgatcttatttgtttgtgcgtctgggctagcccataactcacgtatgatagacacaggtagacaattgcgaggtaccacgtatactgtggtaaccacccaattgcaccaacgaaatacgtcagtggccagatcaatagccaccagcctggctgggcatgttggtaaattcgccgaccaagaccaatcgctaatcccccattgattagtaacaataagccaccaaatcgccaaaccggacttagcccaattaaggtactccctatcggtaacccaatccccacgattaccgctagcacccaataacgccaaccaatcttttcccaaaaggccatccaacttcacctagctctcttaataattgcaactattttagcatgttttcaaagagatttcatctgcttatctcggttgctgtagctcacaaaccactgaaaccgcagataacagatataatggtgccgtttcagttcgtaagatccgaggaccaagccccgctaaaatagctcctgccgcctgagctcgtgtcacttccgctgggctgatcccaccctcaggaccaaatacagccattaagtgttgctgaggatacagtcgctgtaattgttgatttaaggcggcctgctcaccttgcttagctgactcttcataggccagaatggtaacgtcagccgacgttgccagtacggcggccaagttaggggcataactcaccgttggtcgccgtaagcgatgcgcctgttcggccgcaccatgggcaatcttggtgagccgcgctaatttcttgggcaccttattggctgaccacttggcaacggaccattccgccccaaagaagatgatgtgggtcacacctaattccgtggccttttgggtaatccactctgccttttcctgttttggtaacccgcaagcaatgattacctcaactgggagttcaacggctggtgtcggtactgccgttaacgtcaccgtcgcctgatcgggcgtcacagtgaccaattgtccatgaaaaagctgggcttgatcgtccacaaattctgccactgatccgacttcagctctgagaaccgttacccaatgatgatagatggccgctggcaacgtcaagttcgtgccatcaacacccgtttcatctaaaaaataccgttgcatgcctattcatcctccgttggcctatgagcaattacgccacgccaatccttcatctgtaagatgttgtcaatgacgaaaccttgtttttcttgggccgcaaccacttcagctaacttgtcggcgataattcctgacgttaagaaataaccacctggcgtcaagttctcccacgcctgcggaactagtggtaagatgatttccgctagaatattggccactactaaatcaaccgggtgatggatgctctttaacaaatcattgggcttagccacaacatcagtcgcaatgggatttaaatcaaggttggttttggctgaacgtaccgctacttcgtctaaatcaaatgctgtaatctgattaacaccgagatacttcgcggcaatgctcaaaacaccggacccagttccaacgtcatacatcgtctcaccaccgcgaaccaccatttccaaggcagtcatggaaaggcgcgttgtgggatgggttcccgttccaaaggccattccaggatctaaacgaatgacgtgttcgttaggctggacgggggtatatttctcccagcttggtgtcacggttaagtaacgggtcacccgaaccggatggtaatacttttgccaagcagtggcccaactctcatcatcaactgccttcgtggtcaccgttcctggcgttgggtctaaaccaaattgggttaactcctgcacgcgttggcgaatcgttggtaagatctctggcacgaagattgtttcgggataataggcactaatctcggcaccactcgttcgatgagggatactgtcaagatcaacgatttcaccatattttcctggctttaaattagcatagtctgcggcatcatcaatcttaacgccactagcaccggcttcttgtaaaatgttactaacggcttctaccgcttcattagttgtcattacactgacttccgtccattgcatgtaaacgcgctcctttgaaaaataaatttaaatgagaaaaagccggcgacaaccaacattgtcaccggcttccactgaacattaaagaattaatcgacccgcttaaaccttctcagcatcggtcgtgtggccagcgttgcgctgctcccgttgggcaagatgtgtttccaaataatctagcatatctgcctcattttgaaacacacgtggatgcttttgcttgtgcaatcgcaaatcaatctcgttaattcgctgacgcccagtccacgtatgaccataacgaatgattacccggttattgagcgaatcgcgaccgaacttaaagacgtagacgctctctggcgccatcaatggccgaatatacgacttctcatagcgataattatgttgtcgtaaaaattccttggttcgactcagcatggtaatcacctcctatttaatgacaatccactcggttctcaaaacattttaaggccgtttcggttgcccaaacactttaaaatgtatcgatgactaataatagtggatttttcactggattgcaaccaaaacgcccagaatccttgggccatccatgaaaaaatttcagaccacctttaccgcatttgaaaccacttacattataacataaaccctggcccactgctgataaaacccacataacaatcaaaaaccgtttttagcgtttcgattgcattttataagaaaatcgttgagaatagaggatagttaatattttacttaaggaggataatacttgtgttaaaagaatttaaagagttcattgcccggggcaatgtcatggatctggctgtcggggtaattgttggggctgcgtttactgccattgttaattctttagtcacaaacatcattaacccattactggggatctttgtcggcagcattgatttttctaatttggtctttaccgtaggcagtgcgcatttccgctatggcgctttcatcaactcagtgattaatttcttaattattgcgtttgttgttttcctactcatcaaactgattaataagctgattgccaaaccggcggaagaacctgaagaagccgtcccatcccaagaagaaaaatacttgcaggaaattgtggaattattgaaacaagataaaattgagcattaatgttagaggcgttcccggtggtggagcgtctttttttgtacgatgaggcaataaattatcaccatataagatagcatcggtgagtgatcgccgtcactcaccacaaagtttctccttaccattccctttgaaaatgctatactgtgacaagatactttaacaaattaggaatatcttaaataacaaatcatgttattggagatgggaattagaggtcatcagaatgaaagaagaggaacgtgattttacagaaactgactggcaacgtgctcagacagctgtattcaacgaatatgaccgttttgttaaacagctccacgttgaaggcgttgattacaccattcttcaggcgcgtcgcatcgtcatttatcaagatttaattgaagaatggcgtcacaatgctgcgacactcaaagttgacttagaagataatacccaggccctgacgatctttgaggatttggcacttaaaggtaagagccaccttttggaacgttgtgccaagaaaatggaaaattggccggactatatcccctcacccctgacgatttggctagaattggccgaagacgctgaacgtgagtaacccaagcacaacattcgcaattgctcatcgatttcggtacacttttagtataaatacaggaggtcttaacaatgaataaactcacccgtcttttaaacttctccagcctattgatgaatgtgttatcaattgttttgattctacaacgtatccacaattctcgacgagaacagcgttaattaaacatttctgtttaagccatttaagccatcgcttgaatggctctttttatgcttctctaactgatttcacgaaatcatctttacatcatacggcattttttaagaattggttaaaaacaccagttgcattcaacgatgagtttaatatagaatagttttattgcctaatttgaagatcacaaaatattttttccgtttactttttatatacatattttatctttttagtctacccaaagtgaatcgtgtcaaaaattagttaatcgatcgtgactatttcagatacacacaacaactaaatacaggaggattttatgaaaaatattaaaaagaacatcacaatcattgctttgagcttcaccctattcatgggtggtacagtccccgttgttccgaatgccaccgttgctcatgcaaaaaccacctatgtgtggattgcgcctaaacatggtatgaagtatcactattccaagcattgtcgcgggttgaaacgtgcctcctacaagaaacatgttacattgcgctgggcaaaaaagcatgggtacactaagtgccactttgaataaagcttctatctggtactttctggtactttttctcggttcgactccggggagaagcatacgttcagacctgatgacattaaaagctgactacctagtcatgaggaacttatgaaaagagcaagtgacgggaatctatctacaagtaaggtgaatgaaatgaatgacaaactcgggtgcttcggctgggcagttataattattatcttggctttgattctagataatagagctaatataaaagaggttcaggtgcgtgtcctagacgcacctgaacctcttttatattggtccctaattctgttaaaagcactattccattctgtaccattacttggcttcgtcttcgtcggttcataaaacggccatgagtgcttcctgtttcttaataaattccctgctactccatactggtctgaactggtctaaggaggtgttagcgatactgcgtttatattcctacggtttcagatcgccaccattggtttatcaataacaatctcactatacttcgttctgataaacatattgacgtgtcattggtaggccagttccacttggagcatttgtaagtaagtattgcataacatcaatatttcccgattcaaatgcccctgcacaagcttggaggtatagcgaccacattctagagaatgggactccatactcttctcttacttgatcaataacaccattgtaattgttataccaaatttccaatgttctttgatagtgccgacgtaaagtttctaggtctgtcaattgtaaccctgaatccataacgtgccgtaaattttcagcaacattgggaatatacccaccatggaagatgtatttattcaaaaatgggtcaacgccggctccttcatgctggcctgtaattccatgaattaaagcttgcccattaggcttcaacaagtctttaactttattaaagtatagtcctaaattttctttccccacatgctcaaacattccaacggaagtaacgtaatcatacttatcatccacttcacgataatcttcaagtaacacagaaaccttgctttcaaggtgacgaaccttaatttgctcctgcgtataatcatactgctcttgacttaaggttactcccgtcgcattgagtccaaattcctcagcagccataaatagtaaagtgccccatccactgccaatatccaacagccgtttcccagattcggggttcaacttatgaataatgtgtcggtccttatttaattgtgcttcttcgagagtatcgttatcatgttcaaaataagcgcatgagtaagtcatggttttatccaaccataaccgataaaactcattcccaatatcataatgcttctgaatatctcgttcgctatttttttctgagtgagaaatacttggcaaatgtttcaagaagggattgttggttaaaaaactatggtcggttcgaaaagcagatgtaattaattcttgtatactgccatcaatttcaatttcgccattcatataagcctctgctaacacaagagttggctcagatgtcattgatttaagcgaaatttctttcttaaacgttattgcaatatttggagttccctcaccatatgtggcaattgaaccatcccaataagtaactgaaataggaatgtcaaacgcatgactcaatagttctttgtatgccattttttctaacatcatatagccccctaaatcatattaggtttaattttaacgcttactatatttagtacaaaataatttcttaagacaaattcatttagtttcatcagcagaagatatttcaaggcaagaagattctattaaaagcttgttggtttctagacattgttaaaacagtgttcacagataatacattcagagattaaatctttacggcaaaacaggtctagataaagaggcagtgccgataaatgtattagttgatgctaactttaaacagttgtccaatatgtacatatactatcaaattaacaaatttttcaactgttactctaacacgttcaattcgcttaatatatgtagtagctcccaccctacatactatggaaacaggcactcttgtctatctggaatcactaatcaagcggattcaggtgcacactcaactgaccatcatttatactggttttgtcggtgagaagtggccacccgatttgcgactaatcaaaaaaatagtgagtactcgtgaagacaaacaatacctaaaataaggacaatttcaatgtggtgttgttcctttttagtcttcagaattatcttcgaatgctatacttagtttagggggggattataatgaaatttgattacaagtatgcgctaacaaactcttcagaattgataccacttgcattattttttggcacagcttcttatatttcttctattaacatattggtgtgttatgctattatcttagctattttatattacatttactatatcaaattagaagttcctttgagaaataagcacccctcactttctgaatcgaatagaacaactccgacggtggtcacatatgtactaatgcctttaaccatctttggtataatttgtattacacattttaatctctctggtgcttggtttgttttagtgcttttaatacttcgctggcttaaggatggcttttcaaaaacatcagtaaattagtgttcctagatgatgcattcgaaatgcactttttatggcaaactatctttgtttcttaatgatgatcccccaaacaacttgcacaattaccaaaaggacaaacggaacatccaaaacataccatgttatcattttaacttctggtgtttgaactagcccagatccatctacttttctcgtaaaaataaaaattaatagcaatacttaatattttttataaaaagacagcacggacgatattgtccgtgctgtctttttactatttaagtgtcaataacatgagtcccactgcaactaggttattaaacccgtgaagtaggatgctactctgtaatttacccgttcgccgatacacataggccagggttcctcccattaccgcatataaaagccaactgattggattagaactggcatggggaatcgaaaaagcaatcccgctcacaacaattgataaccagaaagatctgggggcaaaacagccatcaattaacagcccccgaaaggttaactcctcgataattggtgaccccaatactgccgtcaaactcagtagaatcatcgttaaactactccgccccatcaaagtcccaatggcttgattgttcgccgtactagtttgatggtacagcacactagtcaaaccacttaaaataaactctgacaagatgataaacccatagcctttgaccatttgtacccaatcttgcccagtcaaccgttgccaattaactggatgaatctggcgatagcgccaaaaaccaatcagggccgtgatcacaaacccagccagataaataccactccataaaacacgatgcaacaatgagccatgatttaattgtagcaatggcaattgaaccaccgatattagaatcaccatcccgataacccatagccaactgccaaagccacctattttaatccgttgttgtgtcaccttgtccaccctctcagcattgtttccccgcttaactaaccggttcaaagttctctaatcgcctcatggctgaacgatcaaccgtctcattaaataccttcaccaaaatatttactttttaatagcaatttcttaataaatacgttactataaagttgcggatgagtttgaactaaccttcaacttatgcgtgaggcttctgtcctcattcaacagacagatttcattttactcccccaaagtagatgaaattttttacaacataatcccccaattatgttgtaaccttactctttggccattgcgacttatcgtaatggctttttttgtgcttcctcatcaccaacggccgtctcatcctctaaaagtattggcgatcggggccataaaaaccagtacagaccaagattaacgagcgtactaacgatcaatcccgttaaaccaatcatgatatcccagccaaaagccacgttccacgtgagcatcccccacaaggtaccgccaatcagaccaccagttagtaaaaccatcaacaatgacgttaaaattttcacagccagaatgccccttcgttaagtaatcatgtacaaatgttaccacgtttcttcaaattatcgaagtaaattcggctaatagctgtattcctaactggaaacgattacaatgaaggtgtcttttaaatttaactgaaggagtgactcatatgaccagtgttctcgtaactgcccccattcctcaggcggcgctaaacatcttgcgccaagccaacttagacgtagattgctataatggccacggcctgatcaccaaggctgaattgttaaaacgtgttgtgggtaaggattatctgattaccccactatccactcaggtcgatcgtgacatcattgatgccgatccacaactaaagttgattgcaaattatggcgccggtttcaataatattgatgccgactatgcccggtcacgacaaattcccgtgacgaacaccccgaaagtctcgactgtctcaaccgctgaggtgactgccggtctcatcatcgctttaactcaccgccttgttgagggtgaccgattgatgcgcgatcaagggtttgatggctggtcacccctattcttcttgggtcatgaactagcgggcaagactttgggcattctcggtatgggccaaattgggcaggcagtcgccaaacgcttagctgcttttgatatgaaaattatctacacgcaacgccatcctctcgatgcgaccaccgcgcaggccttacatgcccaacaggtgccattaactgacttagttgcgcaaagtgacattttaaccattcattgtcctttcacgccagagacgcatcatttattaggagctgccgaatttaaggccatgaaagattccgcttatttaattaatgcggcccgaggttccattatcgatgaagccgccctgttgacagctctccaacagggacagttagctggcgctgctttggatgtttatgaagccgaaccgcacgttgacgccggcttcaaagcattggacaatgtcattttaacgccccacgttggtaacgcaaccgtggaagcacgtgacgctatggctacgattgttgccaagaatgcggttcgcgtggatcagggacaggcccccttatacattgttaacccttaaacgtcagtaacactcaagttcacagcttgagtgtttttttatggatcaaaggcgtgatgactacaaatactgcaatcggttgcaatattgtcaaatcaacctttatcaacaaaattattttaaccaaaatcggaagaattaattgcttattcaatctgggtagcctaagattagtcttgaaagaatacgctatcatttagcagaaaggatgatctcaaattgaacttaatttcattgcatgtcttggatgacgctttagccgtcagctaccaacccactaatcccgatgaacggcgacgttttacgatcgcctacaattctgatcaaactattggcgaaaaccttgagaatttgcggttgaaattagctggtttagacgtcgatgccgccgtaattgataatgcactcagttacccattttcagataccgtggtgggcattaatcaccaacggattgatttaggcctcgcgattaccaacatgttaaatgttcccgctgtcagttcccaagccgtgcagcaacaaggactcaccgctgcactgaccgctaaacgcgactatttaacctggcaccttgactattatggtcagtaccaaggtaaacgtaactatggtcaagaggctatgctcaccgtcggcaacggttttatcgggcttcgtggtgcttatacagaagctcacgccgatgccgacaattatccgggcatgtatacggctggcctgtatgaccagttaaccaccaatctcaatggtcgcaacgtaacaaatgaagacttggttaacttacctaacgctcaggccttatcctttggtgttgatcatcaaaatccttttcagattaaggctgctgatatccaagatatttatcgtagtcttgatctgcatactgggacgctaaccaccaccatgcttgtccaactccctaccggtcatgccctccgaattgaaactaaaaaactggctaacttcaaagattggcaccgtttagccatccaataccggatcactcctttaaattttgcgggaagtctgcaaatttactctgcgattgatggtcgggtaatcaatgcgaatgtcgaccgctataatgcctttaatcaacgacatttacgcatcacaggaaccagtcagcaaaccgactcaatgttcttagaggggcaaacaactacctcagctgtcaagttcgttctagggtcccgattaactggtccaggaacggcgctcaccccgcaaaaccatgatcgcccagacgccgatcaacaagtgcgccagatgcagtcgcttgacgttcaaccccaacacacctatacgtttgaaaaaaatattgtgctctataccgctcgcgaaacaactggtgaccttttagctgcaacgcaagccgatttggcccaggccagttttgagaatacgcataagagtagcaccacttattggcaacatcgctgggatattgcggatattcaactctcgggtgatatgacagcccaaaaattaatccgagtcaatctgtaccatctattctcagcaacgcaggccatcgcttctggtaaaattgatgcctcaattaacgcccgtgggctagacggtgaagcctatcggggacatgtcttttgggacgaaatgtttgacctgccgctactgacactatatgatccgcaacttgtgcggcaactgctgatgtatcgttatcgtcggctacccgctgccaaaaagaacgcccatgaggccggatttgctggtgccatgttcccatggcagtccggtgcaactggagatgaacagtcccaggtagttcacttgaatcccctgaccaatacgtgggaccccgactattcatctttgcaacgccacgtgtcattagccgttgcttacaatgttattatgtatgaccgaatttctggtgaccataccttcttggtacaatatggtttagaaatgctgcaagaaattgcacaattttggctcagtaaggcccaccggaatgcgcccgatcaacgatacacaattgatcaagtcatgggaccggatgaatttcacgaaaactatccaaacgcgcacagccgaggattagccaataacgcatacaccaatctaatggttgcctggttatttcgcgaactgaaggtccttcggcagcagtgccaacccgaccaattggcagccattgaccagaaaacgggcgtgactccgcaaattctcgaccaatttgcagacgttgcccagcacttgaaactcgacattaacgaggacggcattatcgggcaatttgctggttacttcaagcttccccagttagatttccagaagtatcggcaaaaatacggagatatttcccgaatggatcgcatcttgaaggccgaaggaaagacgcctgatgcctaccaagtggctaagcaagccgatgcccttatgattttctacaacttagatgttccacaggtcatgacgctgcttcagcaattgggttaccagcttcccacaggtgcgttaactaagaatctacaattctatttggatcgaacaacccatgggtctaccctatcgcgggttgtctacgccgcattaacggcgatggcagggcacttggatcgttcttggcaattctattctcaagcactgttgtccgattactacgacattcaaggcgggacaacagccgaaggtattcacctaggcgtcatgggggcggtaacgttaatgactatgcggtattatgccggggtcgatgcgctagccgatcacctgacggttgcccctcgcctgccccatgcttggacagccattgcgtttaagcaatgcattcgtggcatcacctatgcctttagcattgaccatcaccacattaccgtgacggccgaccaggcaaccacccttcaaattcagcaacaatctgtttcactaaaaccacacgtttcaaccaccataacttattaaggagtgcttagcatgacaaagttttctgatattaaaggatttgtttttgatctcgacggtgtgattacggatacttccattcttcatggtacggcctggcatcagctcgccgattccctaggtgttacttggagtgatgaactgggcaatggtcttaaagggattagtcgcatggattccttggaaatgattctgaaggctggtggtaaggaaaacgactatacccaggctgaaaaagagcagttagccactcagaaaaacaccaactatgtcgctgaagtcgacaagatgacgcccgctaatattttaccagggatgaaagcttttcttgatgatctacgcgccaaaggctaccagctctcattggcctctgcttctaagaacgccccccgcgtattagctaagttggaattggccgactacttcccaaagattgtcgacccagctagtttaactcatggtaagccagatcctgagatctataccaaaggggctgagctattaaacttgccacccgaacaatgtatcggcgttgaagatgccgctgctggtgtggccgcgattaatgccgccggtgaaatttccttaggcattggtgatgccaccgaattaggtgccgcggatatggtctttgtggacacggccgatgtgaccttagccaacattgcggctaagttagactaaattcatcaatacaaaaagggattgagcaaatcgctcagtccctttttgtgtgttctattgaattaaaccaaagtggcgaagtccgcgaacaattccatccgtggtatttgtagtagtcacatatgctgctttttctttagcagcagccaccccattccccatcgaaataggaacatcaacttcgtcaaacatttgcaggtcattatacccatccccaaaggcataagtcttaatcccctgtagtccggcctgttgaattaaggttcgaatccctgactgcttcgtcacgccattgaccatcgtatccaaacaccgtggattatttcgcacaaaagttaactggcctgaaaacttctcttgataaagctggtcatggtcgcgattaaatacatttaaaaagttaatttgctgagttgcataccacgctggatcaacgatcggatgcagccgtaacaactgaaagttttctgtcgtatcagcattggcctgactcaaacggaagccctgactcgtatagtacgcaatcggatcatgctggcgttgcgcaaatgctgttactactgtcaataacttgggcgcaattaccgctgcggctaatcgctgaccttgatactgtacataactgccattagcaccgactacggaatcaattccagtaccgtccaaaacatattgtatctcaaagatgtttcttcctgtggcaataactggtagaatatgatgttgttgcatttcatgaatggctgcgacacttgccggtaagacgtgcttgttatcgtcaaatagcgtgctatccagatcaaaaaagacgatggcttgatacataattagcctcctagttcactggttttgacagattcattatacaacaatgaccaaagtttacgaaatggtgaaatttttttgctcagcaaatgtagtagttggcaattttatggtacactatatcttgtatttctatttaaaagaggggctatcatggtgataattacagcaggaatgattggtgttggtaaaacaacacttactggaaagattgcatcgcatttaggtacgcaagcattttttgaaccggttggcgataacccggttttaccactttactaccgggatcccaaacaatacggcttcttactgcaaatttactttttaaataagcgttttagcatgatcaaacgtgcactggccgatgacaacaacgtcttagaccgttcaatttatgaagacgccctcttcacgcgggagaataacgccgaaggtaacatcacagatacagaactagaagtttatttgaatctgttagacaacatgatgaatgaactcaatgagttacctaaaaaggcacctgatttgttagtctacgcagacgctgactttgatacaatcttacatcggatcaagaaacgtggtcgggattacgaacaatttgacaataatcctgaactagaatcttactataaaaagatgtggactgcttatcaaggctggttcgcagattacgacgttagtcctaagatcaaaattgaccttcaaaaatacgaccttgatgttcccggtaatacagaacttgttttggggcaaatcgatgatgctttaaaaggtcttcgtactagcacggccgtttaaacataaaaaaagagctgtaaaatcatcatagatttcacagttcttttttagtgttcagccgtttcagatggtaataaaataatctgactatcaccatcatcatacgccaaaactgtagccggcaattcaggagtgtacccgaactgtgtgtcaaatccggctcgcaatgtcacctcttggtcatcatcagtttggacgtattcaaaagtcgtttgtccttggttattatgcaacttaaatgttagcaaatttgccaacgggaaaagtccctggaggtcgtcatcaataatctgccaaacagcatcaatcatctcacctggtaaggccgccaccgtgccgtaactcgcatagcgggcatgattactttcaaacatcttatcgcctccatctaccgttatttatagctattataccgtaacttagtttaaaacgggaataatttagctcttaatgctcagtaacccgctgagtattcttacgatcaagccaatttaccatgaacgatatcacaatcaatccagcacccgcaataaagatgacatgcagtccttggtataaaataccgtgaagcgtcggcaagagcgcctgaggcaagtccttagccgtctgcggattaatcagttgattcatcatcgccatcgttgttttggggtgttgcgccaccccgcgggccatctcgacattcatgatgatgccgaacagtgagaccatcaccgtttgccctaatgtccgcgataaagtattaaatgacgttgccacaccaacctcatcgacaggcacctgactctgtaccgtcaccgtagtggtcgtaatggtaatcccaaaaccagtaccacagattgcagcaatcacaaagaaacaccaaaacggcgtatttgctggcaataaagccattgttacagcaccaattagaaccagcgtcagggcaatattaacaatttgattaggcgagcgccgcataagaagcttaccagcgataaaggacccgacaatccacatcagtgaactgggtgtaatagcaaaccccgcctgtgacgccaacagacctaataggccttgcgtccacgtcggtaaatagacttcaaatcccatgataaaaccacttaataaggccgcaattaagttttgaatgacaaacgttcgattccgaaaaagggctaatggaatcaacgggtcatcggtgcgttgctcccgtcgtaaaaatagccaaaacgccacaatcgtgaccagaaagccagctataatccagacgatccctaagttactctcactcaacaactggaaggttaacatcaacgctaatagcccaaccgatagccataagcaccctgcccagtccatcataaagggtttccgctgcgttgattcattcaggaaaaaccaaatcaatagcatcgtgataatcccaattggaatattaatgaaaaagatccagtgccagctaagttgatcaacgatgaagccccctaatagtggggccacaacggcagcaatgccccaagcagacccgttcaggcccatcacacgggcccgttgttcaacgggataaatatccgctaagatcgtaaaagagactggcataatggcacccgcaccaatcccttgaagagctcgccaagcaattaatgtctccattgattgcgacattccggacaaggttgagcctaaaatgaacacaaatagaccgactagaaagacaagctttcgaccgaccgtatccgctaacttgccatagattggcgttgccaatgcactagtcagcagaaaaatagaaaatacccagttcatcaaggcaaccccatgcaggtcaccaacaatggtgggcatggccgttgaaacgattgttccttcaattgctgacataaatgtcgctacaaaaacagcacccgttacaacaccaacgttagtttgtttcttaaccataatttcctcctaacgttggccccaccactcaacgaatctaagtagccaattgctgctacttcccaatttctgatttacagtaatgtcctaattatcacggctagcttcataaatatcaagagggaagctcatcttttttagccagcacgacgaaaaacggctagaccgctcaaccgagcgtctaaccgtctaatttttaacttatttacttgcaagcagccttcaaagcatctaccttatcagtatgttcccaaggcaaatcaatgtcggttcggccaaagtgaccataagccgccgtttgcttgtagattggccgctttaagtccaacatttggataattccagctggccgtaaatcaaacagatcacgaacagccgttgctaatttcgcttcagcaactgtgccagtcccaaacgtattaacgtatacggaaacgggttcagccaccccaatggcgtaagcaatttgaacttcacacttctgggctaattcagctgccacgatgtttttggcaatgtagcgagcagcatagctggcggaccggtcaaccttcgtcgcgtccttaccagaaaaggccccaccaccatgacgagcggcaccaccatacgtgtcaacaataatcttacggccagtcaagccagcatccccttgcggaccaccgatgacgaatcgaccagttggattaatgaagtacttcgtttgatcatccaacaagtcagccggaatagttggcttaataacttgttcaatgacatcttggcgaatacgatccaacgtaacgtctggatcatgctgagtactaagaacaaccgtgtccacgcgtaagggttgatcattatcatcatattcaaccgttacttcagctttggcgtctggacgtaggtaatctaaaacggcttgcttacgaagcatcgcaatccgtcgcatcaaagcatggctcaattcgattggtaacggcatcaattcaggtgtttcattaaccgcgtacccaaacattaatccttgatcaccagcgccaatctgatctaacggatcagcatcaccttcccgggtttctaaggaatcatcgaccccttgggcaatatcgggtgattgttcgtcgatcgccacgagaacggcacagttgtcgccgtcaaacccgtattgaccatccgtataaccaatctctttaatcgtctgccgaaccactttttgaatatcaacgtaagccttcgttgaaatttcaccgaaaactaaaaccaagcctgtcgtgactgacgtctcacaagccactcgagaatctggatcttgcgccaataatgcgtctaaaatggcatcactaatttgatcagcgatcttatcaggatggccttcagaaacggattctgacgtaaataaatgtctttcttgcaatggatattccccctagatatagtagacggcaagttgaccgataatctcgtcgccattcggttacaaggcagcttcactagcatgtgaatcctatcgggaattgactcataactcaagaattttaccacaaaatcagttgacttaaaaggaagtgccagaaaaatctgaaagaaccgttgaccgcaccacaaataatcactaatataaaaagcaacactataaccaattgaatggagcgattccatgaccacgctcatggccttcttaaaaaatcgaacagtccagcaacttgttatcttcacagtgtgtcaaaatagtctttggtggcttgccagttccaccgtcaatacaggaagtccattaacgacgctcgttaaaatctacctagtagtatatggcggcctgctggcagcgggaatctttttaattttaaatcaccaatttcgatcacgaattggaccagttctcgtcgttgcagctgtgactatggggttcctagcagctcccaatgtccatttagtgcaactttttgccctactcctctgtcttttcttagttctcgtctgtatcccacaattaggcttgcagtccatctacgggctcattgtttttagctgcttagccggttatggtgtcccagtcattcttttctttctccgaaaccactacttggcacttcagtttttagtcttgttattgcccctagttgccagctacctagttttcttcgaaccttactatctacccgccgaacgtgattggcgcttaacgttaatttctccgataattctgcttattattatgggaggaaccgcgttctcttggcgagtacttgtggttatgctgattgtgggcggtcattggtggttacaacctcgattaaatgcacgctaccgcctaatagcatcgggatgcttacaattaatcgctggcctatttattttgctctagaacattgcttgttttttaaagtttagcaaaaccctggtttgtgactaccgttctcaaaataaaccatgctagaatgagacatcaattcataaatggaggaacttttatgaccaccatcaaggtgattggtgacattcttagcggtaactaccaacccacactcacaggtaatcgcattgttgacgccagcttaattgaccatttttgccagaatttagcagccacgcttcacttaccaccaatcgcagtgacagcagaacatcattggaatttcaaggtagatccgactgttctttatctagttgatcaacgaatcatacaagtcaccgatcgtctactggaacaccataacgttatagccgtgacccattctgatctgcttcgtggtcaagtgacacttgcacaaaaccaattacaatctaagcatctgatcaacaccaataaaaaagatgtccaatcatttagttaagattgaacgtcttttttatttcctgaattaagtaaaatctttaattcgtaatagattgcctcgaatccacagtgtatggtcattcagttcttgttggagcaacatgaggccatctactaacgggatctgctcattggcatcaaagaactctgttttactgacatataagcgctggttgtagatgtcaaaagttcggcgaatgcgataccctaacttaccataagttaccgtctctaccgctgtcccctgctccacttgccagtgggatacccgctgaagctcatctaacgaatagcatcgtttttgatgggtctgccgatcccaaatctcaagatgataggttgttgccaatgactcgcgtaaaaagtaaccgactgtatcgaaaaaattaagccgaaagtgagttaagtcactcacgtccagataaaataaccgtttttgctgatagtgatctaacggcgtttgcaggtcgtgttcaatctgtcgcgtaattgcttgataggattggcgtagttcaagaaattgatcaattaattttctttctttcgtgccaatcgtttcaggtgtcatatcgcccttaagatcatctttactcattcactaaatcttcctttcaacggtgattcttggtttcaatcaaccgtaaagccactttaacatacaagaaataaaattaatacccattataatcaatattatataaaatctataattatcagttaaatgacgctcaaatggcaaacttgcattttatcaataaaatcagtatattgaagttaatttatagcgaggaggaagcttgaatgaatactgatctgttagtcacaacgactgaacatattccgggaaaagaatatgaggttatcggtgagatctttggcctaactacccaatcaaaaaatgtcttacgtaatatgggtgccgctttaaaaaatgtggtgggtggtgaaatcaaagattatacgaaaatgttagacgaagctcgtaatatttctgtggatcgattacgaaaaaatgcccgtgatatgggagcagatgccgtggtgatgatgcgtttcgattccggttcaattggcacagatatgcaatcagtggctgcatatgggactgctgttaaatatgtgtaatttcctttaaaaatgtgattgttacgcctcaatagttcgttacactcaactaaatagttttcaaaaaactgacgctgtgattggcaataatcacagcgtcagtttttttaaaattaattttcgatattagacgcatctattcataatggggcttgaccacaagcatcaacatgtaacgctttaataccacacaataagcaatctgggatatattatatccacttaaaaaaaactgtcccctagcttttatccacaatcctctgaatggctgtcaaccatctctgctaaccgtcctatactaaccatagtcaataagatagcaagcaattaaaaaagtgattattcggattttaagaaagtgggtattcgcaatgttaacaaaaattggcaaatggactattttaatgatcgccaccatcgtattaaccatttcaacttgtggcacaaccatttttgccgctgcaacagctgctaagacgcctagttggggtagttgggacgacacaacaattacatacaaaacggagaatacatcgtcttactaccaaagcatttggaaaaatgctgttaagcgttggaataaagttggcgtggttaaattaaaggctgccactaccggtgaaaaagcggatatcaccttgacctcttctgcttccttaagtacacaaggcggaaaactggctggttacacaaactattcttactacaaaaagagtggcaacgatcaaatcgtttctgcaaagtctactttaaaccggagcttattaagcaagtacgattatactaaaaatcagcgcactaatgtggcaacgcatgaaattggtcatgccttaggtttaagccactctgcaagcaagaagagtgtgatgtacgcctcagatcgttatgcttccattgattatcaagataaagtagctttgaacaatgcgtacaacaactagtaaatcttattgctaacattgacgaatacctataaatcccctagctaaatagctgggggattttttcatcaagcggatgatttcacctactaatcttatgctataatcaaattgacaaaaacttattgaggtattagtgggtccgtttacgccaaacctgataagcatgtgttgatgctttaagtttttaaatgatacggtccctagtgatctcgataaagaaaggcggttacccccatgacgacaactggtaatgttattttagtaccgatcgaccattcagccattacttccacattagtcacctatgcagcaaaaatggcaacagccagccataaaactctatactttatctacgtaattgatccatcacgttatacgtcacgctttcaatcatttgacttacagacacaaattgaccgggaaaaagctttggcggcttataacttggaaaacgtggttaatgatgcccatcacctaacccaggccccggttattaactcaatcatttgtggtgacccgagaaggattatcgtccgtctatccaacctcaataacgttattgagacggtcattggtgctcaaggaaaagacgccgatcgttatacccgaattggccatgtaactcgctatgttagtagttggtcacagcataacgtgacaatcgtcaaggcccaccaaccacagccgcatcgtgcgccttaacgccttaagtaaggggcgtatacattaccaatcagccacatatatgctctggtgccttgattccctatcactactacacttgaatctaactttttacatgctgatctgcgtatggctacatatcagaagcccaattaggcctcagctgaataaattctcatgctatttttgatgttgacgaatagtgtccgtcaacatcatttttgtgcagcggcctcctaatccagtgaacatttattatcaaccactaacaggtaattgcttagtcaacagctttcttcgtaaataaactagactctcgcaacaaaccctacaatctccgaacccgttaacaaaggattacaaaaaagtcatcgccgattgcgatgacttctgagatgaagcttcttataccggaggtggggttcgaacccacacgtcctcaacggacactggattttgagtccagcgcgtctgccagttccgccactccggcaaaaaataactcatgattggatacacccagtcaaaggtggtaatcggattcgaaccgacgataaaggttttgcagacctctgccttaccacttggctataccaccataatcgcctatccaatctgattggaccagctaaataaaacaagatgcccaatctagggcggtatgtgggaatcgaacccacgcgtgccggaaccacaatccggtgtgttaaccccttcaccaataccgccataacattacaacagggatagtaggagttgaacccacatcgacggttttggagaccgttgttctaccattgaactatatccctatgatggtggggagtggattcgaaccaccgaacccgaaggagcggatttacagtccgccgcgtttagccagacttcgctaccccaccataatggcgcgggacggaatcgaaccgccgacacatggagcttcaatccattgctctaccgactgagctaccgagccatttaccatcatgtaatgcttgttgtattaaattaataacataacaacggtccgtacgagactcgaactcgtgatctcctgcgtgacaggcaggcgtcctaaaccaactagaccaacggaccataatattattatgtcatatggaggatacagggctcgaacctgtgaccctctgcttgtaaggcagacgctctcccaactgagctaatcctccaaaatgacccgtacgggattcgaacccatgttaccgccgtgaaagggcggtgtcttaaaccacttgaccaacgggtcatactattccaaacggagagtgagggattcgaaccctcgaaacaggttagtacccgtttacagcatttccaatgctgctccttcagccactcggacaactctccattacaaagatgttcattagaactgtccaaaaggaagtgctgacaatggctaaaattggttatgctcgtgtgagttccaaagagcaacatttagatcgacagctagcggccttaaaaggcgttgataaattatttacggataaattaagtggagctaacactaatcggccagaactgcaaaaaatgctggcctatattcgtgagggagatattgtcctggtcactgaattagatcgcttaggcagaaacaaccaggatttgactaagattatgaactccattcaaaataagggggccaccctagatgtgttgaatttaccgtccatgacagggattgcggatcccaacttacggcaactgatgaccaatttgattattgaactctataagtatcaggccgaaagtgaacgtaagcgaatcattgagcgccagcagcaagggattgccttagctaagcagcagggtaaatatcatgggcgcaaaccccaatacacccaagacgatccccggttgcaacatgcttttaaactttatcagacgggcatgagtgatgtagatgtggctcgtaataccgggattaagcggacgacctttatcagatatcgcaaaaagtttaatataaaaagatgagacttatatgtcaggtaaattaaaaaccgttttttatgagcagcaaaattattttgaaaaaatgatgggaattaagttagagtgatatcatttattaatcagaatgcaaacaactgtgcttcttaccatggttttttaggaatagcggttttactaattgttgatatagagggcggaattaaaatgtaggaaatcggcagtttaaaattgtcggttttcctacattttttgtatactcaccttatctatttgatgaggaagtgaagagtatgcgcaacgacgtttacgaaaggatgaaacatttcgtgatagatgaatcccaaagcttggttcaaatcccttcatcaccaacagccgcctaatttcttcaccctttacccctcccgaagtaaggacctgccgataaatcaacatcctactatttcatttggtgttaatttctttctctcgaatataacctatgcgtcaattataaattatatgtctggtctactgcaacgagctttcttggcccctaaatctaaagagagcgtgtattgaaatccaaggatttcgatacacgctctcgctttttactacgtctccttctagcagagattagaaatgaaaacaaaaatccacccggcgcgacgaagacggcgggtgaaagtggaaggccggattgggcctatcccagggaaagcaaggccttgtaaaggccgttgaccttcgtgggcatgtagtcgttcatcatcatgatctggtgggagtccacgacttcatcggtgtacaggcttcgcaggcccaccattccctggagggtggtggccaggatttgatggtcgcgggccatcagcgcctgggcctgggcgggactggtccggccaggggaagatgtcgcagacggccgcctgatgccaatcgacgacggggtcgtcatagcggaaaggcggccaaagacccataagggcgctggatgcgcacgtaattgagcagatagcggttcttgccggaggcgaaaggaccgtaggaaagggggacccagacctctttccgctggcagtgctcctcgaaatgatcttccagggccaggaaatgggttgccggggcgtgggcgtccctgacctgttcgtagctgccgctcaaagccgcgccgacgttggtgtagaacacgccgccgaaggcctgggccgctttctgggcctgcccggcccccaggcttctgcgcacatcgtttccctggatatgggccttgatgccgaagatggcggcgacgatggtcagactgatcatgacccccatgacgggagccatccaatccggggcgggcgtcccctgggagtaggtagagccagtggcgaaaatcatggaagccctcctttcattcttgcgtatcttcggaaagctggaaggtatcgacgaactgcttgtattccgagctggaagttccaaaggattcgaggccatagatgccagcggacgagtaaacgacctctcgacgcatgatcaccgaggagtcctcgctatcgtgaccggtgtaggaaatggccatatgcccgtccacggtggtgaaggaatacttgtcaatctgcagaagacgagcgacattggtcaagaccttacgtttctgcgcgtcattgaaccccttggagtcctcgacttgcttccgggtgaatttggtgacggacacagcgtagttgatgtgatccttgtcattgaccgtcgaatagcgggcataagcgccggtgggatccttataggtgtccttctccggaacgcccgggaaatagacggaatagcccagatccttggacgtgaactgcttccagccctggggggcagtgacggaggaagtggctttgttcgccgatggggccagtcgactgggaggaaccgcaggcggccagacctgtcgtgaaagccatcgttgctatgacagcggaaatccgcctgaaagaccttttcatatcaaacctatttttctttcttgtcgtttcttgcttttacattgtaacaccttctaaagtatgcggataaaaataatctggaatggttttatcttcaattaaacactgaataatatatttccaaggactccgctcttgatcatcaagctcttgaggtagtgaacttttaaatattgaacgccacttggggtcttggcgccgctttttgaactgttttttaaaagctttggtaattttgaaactttgtatagtctttctttaaattacgctcatttaccctatgttataagcttttcattctgatagaatcttcaaacaacgtcatacaatatcaaatattttcccattttgtcccttttttgtcccttgggaaacggccgaattcggcatcaaattaacacaatgaatcaaactgtcgggcacggccgttacctcttaggtagcggtttttattttactatttttcgcgagctttaatgtttctattcagtggaacagttatccgcggatccggattgactcgtgcccaccgtgactggttgatcacgctcatggccatactcaaccgctgcttcgttgtcattggctgcttcatcagcagctgcttttgccgagcagcttgcgcgttgtgctgattatccaggaccgtcaccgccatgtgcatgacatcagatgccgatgcggggcgtagctcattagccttgtcacgcagatagcggacttggaaatctggaatcaaatgctgatccaacgcttgccgattaaacttttgaagctggttgtcgtcaaatttaaccaagttttccgtcccagtcttaacaattgtaccaccacgaccatttggtatctgtacccggcggccaagcagcggatcgcgcgcatgatcatatgcagaggcaatctcttttaagacacttgcgcggtccttattatcaaagacccatagggagcaacccttttcatcactggtaatgctggctaattatcctacttgattatccatccgctgtagcatctcatgatagtcaggcgatccattggcatcaatatcaaaccgatactgaaaatcgtccgcataatctgaatccttggtcagatccacacctttcagtttcatacggctggtctgtagcttcttaacgacgtcattaaattctggttccatcttaattactcccttacgcggtttctgcaaccgccgacttgcttttggggctgatacgttgccgtactgcccattaacaaattcatgcacgagctgcttatagacgtcctggcccagtcccagcttcggcctcgttaaagccaagtcgttcgatgcgcaggatggctggcaggtcttggggatcaacggcagtaattttaatcatggcaaactccttagttaaatagatcgtgttagatatagataaatataggcatccaaaacggttttaaaatataaacgcattaaaacaagaattttaatgacaggtcgatataagcgatttaataccctactttgcaaatatatagcaaccatatagcatctgtttatcaaccgctactcattcatgctataacagatgtacacaaaatgcagggccgcttcaaagacggtggacctagttgcattgaatcaataaagtagaagataattgtttaaacaataaagcgtcccaaaataggacgcttttatatttgttgccatcttactcagccactactatttttcagatttaacttctttagttacaattggtactgtattaaccaaattatctctgacaggacaagtatcttccatgaatttaacgaatttggttatctctgtcttttcctttggtgtcctgaagtgaatatcaacaccaatattatcaaatcctggacgcttcccagaaatctctcctctaacaggaatgtacaatgaactatattcaaatttttcttttttgtagaaggaagctgcaacaatatcctcacatgccccaagtgcacataagatcccttcattaggagtaattccttcatcgtatccattatttaattcattcgtttgaaatttaactgtgaaatcacgtgaataagagatgtacttgttaggatcatctgtacttacgacctttgccttaaacgttgtgatagccataataatacctcctaatccttaataatgttatcaataatgacattagtcccgttaactagcgtgtcaaagataggagaacttttttcaactaattcaacaaacttctgacattcttccttactttgacttgtttcaaaattaaaggatatccgaatttcttggaacccattccgaacatttggatcacccataaatcccctaaaatctaggtccccttcaagacttatttcgagtttttggtaattaaaattatttgatgcagaaagtttccgtgctgtttcttggagcgaagcaccgagggagccaagctctaattcaaccggattaagtccagtattcgttcccccgtttgctttcggctcgtctaatgtattgtgaattccacgtgtatgagcatcaacttgtaaacttgaattagtctttctagcggttacactgtactttgtcatagtcagcattcctttcaaatatatactcaaagcgctttcagtaattattatagtattttcaatctttaaatcaatagttaactaactatctaatcagaaaactatgataaaatcatattgtaaggagtgaaatgccgtgactaaatttaccctggaagattgcttaatgtttactaccaacactagctccaaacttttcaaagcggtgcttactgaccgcttgaaagatgttggcgttacctacaatacatggatttctctatactttattaattctcacgatataatttcccaaaacaatttagctaaattagtaggaattactggacctagtatggtcaaaatagtccaaagacttgatgatgaaggattaatatatcagcaacaagacagtaaagatcaccgcaaaaagctaatatacctaacagaagatggaattaaaaagtataacgagatcttgagtattgttattgaataccaaaagacaatgactaaaggattaagccaaaaggaactggatattgtagccaacgtctttgataagatgatcagaaatgctaaaaaagcactaagctagtttcgtgtgttataggtgatttaatcatgaaaaatcaaactcgtaatgttagattagcaattaagaaaggcaatgagattattgctgatttcaagcagcacactcacggtaaacttaacctttgggtctccattaccgatcttagcgagaaatacaatatcacagcggaggcacatagcaaatttaaccctggagtctatactacaatccctgcacagctccccttctctgactttacatatgatgagtttgttgaggtgctaatggcatttcaaaaggaatgggacattcccgtgctgacccacgcctttcctaagaagaagctatttaatctacgccaaaagtatggtgccaggataatcagggatgatattgtccacaaagaatagacgtgttacaatgacgccaactcttctattggtagtcctacgtgttttgcgtggggctttttctatataaaaagcttcccagtaacaatattactgagaagccagaagaaattatatgtatatacatattatgacataataaagcccctttttgctattggctctagcagaaggggctttgtgttgtcgtaactctttccatatgggaaagaggcggtccaattggactatgcatcacaatatcctacagctgtattataccacgagcactaagctgttttcttttcgctttcttttcattgagctagatttctgcccatgcatgattaactacaagataatctagacagtcttggtcacgattagtcgatgtacgcttattttagtaagcgtacataactttcggttgctatcgttcccattccacctaagattgtaaaaaattgttgcattttaatttacccttcttaggactaactatgttataaaaagtaatattgataagttatactaaatttctaatcttgtaggctaatcctgggaatgccattaacattttcttcttccagtcatctggttgcacatccaaactcatcactggaatcagattattaatgtcatctacagcagtctggctaatttcggaagccccctttaatcgtccagttttcttgtcataaacaatggttagacgagcattatcggctgttccttgatagaaaaagtcacccgctgtaatatcaatatcttttataacatatttctcattattacgtgcttcatcaatatttataccagcttgtgctacttgagggaaggtaaaggcaactgtcccgattactgggtattgaattggtttcgtttctttttcagtaaagagagcactcagataatcaccttcaaattgagcagttggtgtcaagcctggcaccttcttactgagcacatcaccaagggcataaatattttccgaacttgattgcaaaaaaccgtttgttttgatcccatctttggtcgcttcaactcctgcggcagagagattaagcgaacctaaattaggaactcgaccacttgcattagccactgtatcaaagttacttttatcaccagtcgtggtttcaagttgatatccactttccttcttagtgatcgcctttatgctagtattgaatttaaattcaattcctaacgagttcttcatttcgttcacaagttgttgaacatgttgtgagtagaacgaccggaggggacgatcggaatgttgaataattgtcacatctgaaccagcagcggcaagtaaagtagcaatctccatgccaacatagccgctaccgattatggcaatacgctttggtaagtcctccaagtcaaaaatatctgtactagttagcgtatattcttgtccagggaaagataattgacgtggtgtgcgtcctgtagcaataacaaaattatcagcctcaatcacacctgactccacactgatgtggtgtgaatcaataaaagaagctgttcccgtcaatgtttgggcacctaaaccctcatacatttgctgtgtgctcttaggaaatggtgcgaatacttctttcttgtattgaattaatctttgccagtttaacttaccaggagtttcaattccctttccttctagctttcgtgaggtaagaactgctcttacagccccttctaagaagatctttggctcgcacccctcattcgggcagattccaccaaaacgctttttctccaccactaggattttctttttactatccttcattcccagcaagaaacgataaacagaaggtccacttccaactacgacgtaattaaacttttccattaactattcccctcgttctaattaatcggtatattgagaaagaacttgcttaagctggtccttgctgtgaaggccaaccagcttctccatgatcttcccatctttcttaataatcagggttggaatagacatgataccaaactcagcaggagtattttggttagcatcgacatccatcttactgatcttgaccttgtctcccatatccttatcaagttcttcgataattggtccctgcattcggcaaggagggcaccaagtagcccaaaaatcagttagagttactccagtattggtctctttcttgaagtcttgatccgtcacatttttaatcatgttatcttacctccctagtccttcttttcatcattctttttcttgttccagtgatcggcaatactgcagccgttaggcccacatgtgccactatcaccttgattatcgccgacaacttggaatggtgtagttacttccttttcttccatgataattatgcctcctcttcagcttgaacctgcttaagtgctttaacgaatacttcatatggttgagcaccactaattgcgtacttattattaatcacgaaaaacggtgcagcatgaatacctgattgttgggcttctacctcgtcactaatgacatcatcatgatatttatccgaatctagcacggcctctatttcatctttagctagtccagcatccgttgccgcattaactaaaacatcatgatcagcaatcgaggttccatcactaaagtaaacttggtagaaacgtttaataactctttctgtaagtgcaggatcacccttactgccagctaatttaattaaacgatgagcatccatagtattagtagggacaaccttattaatttccatcgataatccatctgcgtgcgccattgactcgatataagccatttgctttttggcctgaggctctagtgacttatttccctgagtaaagtgattaatatacccttcagtagttacttttggcgttgcagggttaagctcaaaagatttaaactttagttctgtctcatcgtaaataccaatttctttcatagccttcttcatacgattagagccgatataacaaaatggacaagcaatatctgaccaatatttaatttccatctttaattctccttcttaattaaaattttcaacatattcatatgcattctgtccagcaattcccccatcaccaacagcagtagtaatttgacgaagtctcttcttacgaacatcaccaattgcaaagacacccggaatatttgtttccatatcatcatttgtcagaatccagcctgctgagtctgtaatatttagcctcttaaaaagctgactgttaggtaagttaccgatataaataaagattccgtctgtattaataactttcttttcatttgttttagtatcgacgacctcaattccggtaacatgattttcatcaccaataatcttttcaactgtcgtattccaggtgaaattcatctttggattctcgaatgctctatcctgaagaacctgttgggcgcgcaatgtatcacgatggtgaactacatttactttgttcgtcacattggctaaatataagccctcagaaatagctgagtctccaccaccaattacggttacctgcttacccttaaagaaagcaccatcacatacggcacaataggagacgcccttgcctgaaaattcctcttctcctggaacacctaattttttattagtcgatccggtagcaataataactgacttagcggccaactcttcgctatcggttttgatatgcttccattgatttgaatcaacagttacttcttgaacatcaccacaaataaaattaactccagccttgaccgtactttgatacattttctcgctcaaatctggacctttaattgatgtgaacccgggataattttcaatatcatccgtattattcatctgaccgccgtatatgccacgatcaatcatgccaactttaaggtttgcacgagcagcatataaggcagctgtcattccacctggacctgcaccgattacgagtacatcatatgtttccattatttagtcactcctcacactctataaataataacgaattactgtctccaattgattttgatctataaaacgtgatatccattctaccatctcatcatttttaattaatatgatgcttggcgcagttaacacattgtatttttttaccataagcgggttattatcagcattgagcacctcaacttctaattgatcatgatatttaatggcaagtctgcgaataattggtctttccgtatagcattgagcgcaccaatcgttctcaaagaccaacattttaagtttaggtatgtctagcttaaccatataaccaatatcacctcttatctattcaactaattcattgaatgattaaataatagcacctactttttgtaagtgcaagggtaaatttctgtatttaaattacctaaacaaaaaagtgaccggtaaatcttccgatcactttttcttgttaatacatttcaatgctcttttccaatcatagtaactataatttaagctaagcgtattgtagccattattatttaataactgcgttgcaatattcgaattaccacataatctaccacgacaataaacaataatttgccgattcttcggtagttccgttagatggtctgataaagtatcaagtgggatatttatagcagaattaatatgtccttcttgatactcatcttgtggacgaacatctaaaagtagtccattcttataacttttcagtgcttgttctaaggaaatgctttttacattttctgaggttgtggctttatgttgaataactttcatttcagaaagctcgttttcgccaatatcagtaagcagttgaattagtttcgtaattaagggtgaactcaggctgtaaatgattcgattcccatctcgctcagtttttactaggtgactatcccttaatacttgtaaatgccgtgaagtattagcaacactaatctttaattcttttgaaatttcttctacactcttgggagcctggattaataaatcaaggatttccaaacgacgatcactgccgaggctctttcctattctggatagttctttgtaaagactatctttgtactcaattgcttcttcgtacataatctcaccactattcaaataatttattgaatagtttatcattattttaaaactttgtatagtttttctttaaattacgctcatttaccctattctataggcttttcattctgctagaatcttcaaataacgtcatacaacatggcactgtaccctgtcaagttgacacattaaataataaaaactagttggccttgccgaagcggtattctgctgcggtaaggtcatttcttttgcctgaaataaaggaatgcgtaaagtaatcgataccttctgtcaccagctgttctaagtcttcaaacgtttgtggttgtggtgagtgtgctaaccagatagatttaaaatcagcccaccagtgctccatcaccgcattatcagctggtattcctggggctgagtaactatgttggctgttattactagccaagtagtggttgaatgctttggaagtatatgctgctccgcgatcagtgtggattagcggtgccagacctccggctttctgcttggccatttgaaatactttaatagccccagtactcgtttctgtaggcgtaataatccagctaagtgggtattgaccgtatagatccaggacaacgtgtagacggactttgtacttacgaatgttgtaggcaatttccgtcgtgtccgtcacccacacctgatttgcggcagcttgttcaaactggcggttcagggtattctgtgcttcataagtttcctgctcctgcacacgttttctcttaggctgacgatagtccgctttaatactgtgttccttcataatgcgcatgacgcgcttcttgttaactgtgtatgataatctttcctgctttatcaaacgggtcatcttgtcataaccaacgcagtgtttatgttgtgcttctaactgtttaacgagctttagaatttcttgatcttgaatatcatgaaccgtcggttcatgggtaagccacttgtagtaagcctgccgacttaccccggctgctttaactagatcagataccttatacccactttggctcatttcctgaatcgcttgatatcgtccggccgttccacctccagattgtgtatttcgaccaatttttttgcgaaggcaatctgtacctcccgttccttcgctttagctttcagctgccttacttcttgtcgtaatctttccacttcattggttggtgttttgcctttatggcgaccccggttatcctgaagggattcccaatcgtgagttctttggtactttcgtacccatgaatagacccgttgatagctgacattaaatttttctgccgcggcttgatagttatactcgtgatcaattgtccattgagtaatttgccgtttctggcaaattctataattaatccgaacagaaattaaaaagcccaaagcaatcacttacaatggtagtagctaattccaaccaatataggggcagataatttttttgtataggaatctagttggtaatgccatccttgatcggaatgagtgatgggttgaacattacttggtaacttattgattaattcatcaacggtcttggttattagaatgcaattgggactattactgatttgaaatgctaaaatttccttgctggcctcgtcggtaatagctgagatataagcccatcgtggttcgctaagcgaatttgcgtaatatctgtatggagtactatataaggcttagcctgtttaaagtcttgttccaagagattttcggcgatcttaccgacggtacccttataagaggaatatttactactgttcttgttccggttataaagactcacttgtacgcccaattcatccattagtcggcgtacaaccgcatctgcgatatgaacatcaagcttaattagttcatcttgaacccaccggtaaccgtaggttaaccgaccacgatacttaccattttcagcatatttatcattatgatttttgatccttttacgttcatcatgatgcgtggccttcttaagcccaatggcactaagtatatcgccaattctataacgttgtttcttgggtaacttgacttgatccgccctgatctgatcaactatttctttttttgatgccctttgaaggtccgaacagggtcattgattttttaggatgtcattctccaactttgtgtcatagaattcctgattcttttgagcgatctcgcttcgtaaacgctcgatttcactctgtttttctaattgacgaatctgttttttagaacgtttcgttttggttgacctacctttgggatgaggctctaagctagaatagccgtctcgaataagcgtttttcgccaaacactaatctgacaggctaaaacgttgtattttccggcaacctcggctaaagactcatcatgagtttggtagtagtttatcacataccatttaaattctgccgagaacttacgccgagttttgtaccgcttaagtgtttcaatgccgttcagatgatattgttgaagccatcgattaacttgtcgcttgggtaattgatgatttcttgctagttccgctccggaagtaccgtcgctgagatgttcatttataatttgagcttttaaaacagaactatatttaaccatgaaaaaagtacctcacaatcgttagacttctttgtctaacaattatgaagcacttcactaaagggcatttttaactctgcacaaattgatgaaggtagtatctgaggtgattggtacaagcaatataataacacggattaaggcataagaaaagcccctacaagaccaagagtaagggccaacgaatcatacatgaaagggcattttcatgcacttaaatattaacacttttttacgtaataaaaaagcactctagaaaggaactagcgagcttttttaaggcaaagattttctggaataaaatctaagcaagaggtagattaactctgggacactcagagtataacacttcttcagaacaagaaaagccccctaccagactgacagcaagtactcacaaaacgtaaatgaaagagcatcctcatgcaaacaatatgatatcacagatgaaagtaataaaaaagcccttacccatgggggatagggactccttcaatcaatcaacacacatgcacgtacacagagatacctctccatgcacttatatactaccaccaactagtacaggattgcaacaatccataacccaatccagtcaatggcacatacagcaccaatgaatccccagttgagaaaagtggataccagaaatatccaaaagcaggattttcgtagcgttttcaagtcggcataactaagttgtgacttacattcctcttttctacgtttggatctctgtacccgattttcatgatgataccatctggacattgacgcaatcttaaaaatatctcgaaatatttctattactttcttcttatggttctggtgcaaaattataaatgggctcacatgaattgatcgttctgggctataggcagtttacgctgccagcatttgttttaattcattgatcactgaaaaaccaaggagacttccgtttcttcggttttctttcctcattgcgtgaataacttcaactccagccagggtacttgctgccgtgcgtatgttttgaaatcctgctgactgacgatgtcttttgataaatcgatgatcttgttcaattaaattgttgcgctatttggaacattgatgggcctttaggtccatcaaaccgtctttagccacaggtttaattgctctgagcgttgcgccatagtggtgaactcagcgcatgatcgttgtatggtttaccgaaacaccccgatcagccataatttcaacgatatcacgatagcttaaattaaatctaaaataatagctaatggctaatgtgatgatatctcgattaaaatgacgacctttaaacccaattcatgtcatcaactctcaagaaatttctttcattctaccaaattatgggtgctactaaagctttgcaccagaaccgtttcttgttggtggacgatctagattgttaaaatagtaaatttctttctcaacaaatttcattagttcctaaaaggagtatttttagttgaatttgattgacttatttttagaatgattctaaactatatttggaccttttttgtaagtagattcatcttattatttgtcacccatctattaggaggctatattttttatgtcgaagacaaaagttattgttgttggtgcctcgcacggcggccatcagtcggttttggaacttactcacaaatactcaaacctagatattaaactattcgaagcgggagattttatttcttttatgtcctgtggtatggaattatatttagaaaacagtgtaacgagtattaatgatgtccgtaattttaaacctgcagatctcgaaaaatttgggacagaagtatatgccaatcatgaagtgaccaaaataaatccagaaaataagcaagttaccgtgaaagatttaagatccggtaagatacagagctatgattacgataaattaatcttaagctcaggcgtaactccaaacgatttacccgttcctggtcatgagctaaaaaacgtttattcaatgcgcggcaaggattgggcagaaaagatcaaagcaaaattatctgacccagatgttaaaaatattactgttattggtgctggttacattggtgttgaagctgctgaagccagcatcaaagctggaaagaatgttacattaatcgacatgattaatcggcctctgggcaactacctagataccgaattaacagatattttatcaaaagaattgactagcaaaggcgttcaagttgtcacaggcgctaagattgaatgctatgaagggactgaatcggtttctgctgttaagaccaacgatgcagaatatcctagtgacttgatcattcaagctgttggagttaaacctaatactgattggttaaagggaacggttgaactagataagcgcgggtggattaaaactgacaaatatttgagaactaatctgcctgatgtctatgccataggtgatgcggtgttggcctattcaattcctgctcagaggaacatgccgatagctttagccacagttgcccgacgtgaagcccgttatgtagtggaacacatctttgagaacacaccgtctatgccattttcaggagtagtcggctcatcagcattaagtgttttcgactatcactttgccacatcaggtctgaatatgaccacagcccaaaaggccgatattaagattaacacatctttttacaaagacactttacgtccagcttatgtccctatggagaagggaaatacagaggtctacgtagagctggattacaatccaaacactcatcaactattaggtggtgctgtattgtcaacttatgatatcactgcccaaggtaatgttatttcattagccatccaacaaggattaaaactggaagatttagccgaagctgactttttcttccagccaggctttgaccgacagtggagcctattgaacttagcagcccaacgtgctcttggtgaacttgagtttacaaaatagaaattgtaacgaccacttataacttgctgtttaggatcacgaataaatcaaaaagaggctgtgacataagtctccacaaataagacggtctagtgagaatcttcggattctcactagaccgccttttgatataatggaaaataaaaaaggcatcggccacacccgatacccacagattatccccgaaaggacatctaaatatgcaagactattatggtggattgtaaaattaatccgaacgctgttcggattaattttacaatctaccataactgctatactaaaagtgaaaagaagaggagtgatcgttttgaaattgtatcaaagccttacccaagtccaaatcaacgaacaattcgctggtcaagcaaccggctacaagctttccacgacccttgataagccgctgaactacgatccaacgattctctatcagtatttggataccgtcctgaaaccgggcagtcgccacgacgaaaacaacttgcgctacgtgactgatccgggctatatcggcgaaaactttaattaccaaagcgtcccgtttacttcgcacatgaccgaattcgacgagaagatggccttcgcacgcaaactggtggccgaccttaatcgtcatttatctgtcaacatcaaaccggaagatgaaactatcgaactggtctttgttgactaaagcaaccgtgttgccctcctttcctagtcgcgatgcttctctcctgatcatttgcggctaagtacccagtcaagcatgcttagttgcaacaaaaatgaccgcctaccaaaaagtagacggtcatttttgttgcaactaagcacgaattcgcagctataccgctttcttcgcgacttcctttggtaacgtcaacgccaacagcaagccaatcaggcccacgccagcaaacacagcgaaggtaacagcaaaaccgccagcatgacttcgcagcgtggtttgcatgccatccaacaacactgtggcgaacatgacaccggcagaaccaaataactgacgagccgtcgtcgtaaccgcagtgccgtctgccacgagctcattcggcaaagcattcgcgccagccgtcactgaaggcatcatcacaaaggcattgccggcttcagtcgccatcgccaacataattgccccaatcagcggtaaatgatgggcaaagactgctaacagaccaaagccgccagtaatcaacaacatgccaatcatggccacgacacgcggtccaaagcgatccagtaggcgcccgctaattggattcaaaatactcagcaacaccgcagctggcactaaggacaagccagaaatcaacggtgacaaaccaagtagcgtttgaaagtaaagcggcatcaggatagtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaaccaaccacgccaacagttaagccttttttcgacaaagcacccaaggcataaagtagaattggaaaacttgcggataaaaggaaggacacccagtccagttgcgtcggttgcaatggcatgacagacgcaatggtcaccgttgaaacggccagcacaagcagcgaaacgaccaagaagaacaagaataaagcctgccaagggaaccatgtcagcaaaacaccggaaataatcggaccgactgccaaggctgagcccatgaccaatcccgccgtgcccatcacccgaccacgctcactatgcggcgtaatcgtcagcaacacggtctggaaactcgggaaaataatcccgaccgcaatcgcttcaagcaaccggccaatcatgagcacggtaaaactcggtgcccagatacataagcctgtcccaatggcaaaaatgagttcaatcgcttggaaaagccgttggaaagtaacattatgcaacagccatgggctaaccggaatcatcaaggtcatcaccaacataaagccggttgtcagccaagcaactgtatccgctcctaaaccaaaagctttcataaaagcaggataagcggtgcttaaagaagactgagaaattgacatcgaaaaggtacctgtcagtaacgtggcgacaaaagccccgcgatgtttgatcgttggagagtgcatattaaaatcatctttttctatattagtattgtgggacgtttacattttcattcccattttttcataagactgcataccgcccatccaaatctcagatggtttgacgccacgttctttagccaaggccatcattaacgtatccatatccatcaatttatattcttgctttggcttggctggatcgaatgtttcaatctgtgccatcatgccgccatcttcgtgctcaatgatatggcagtgatacatataaacccctggcaaatcaaagcgaaccagcagccgaaccgtttcaccaggattcacgccaattgtatctttgaaaccatgttcatttggatacggcgcatgcccattccgcgacaagactaagaattgggttccatgcacatggaatggatgaaccattccaggcgcatcattgctattggtaacatcccagtactgggctttgccaattggttgcgtggcatcaatccgctgcatggcaaactttttaccatcaatcgcaacaccttcgtccatcccctgcatcacaacgtggcgaactggcaaagccgggtcaaccactggtgccttcacatcgaacaacttatcaggcaaggtagtctgatccggtttgaacgcatgaatgcggaactttagcaatggcacatcatccgtatataaggtgacctcgtcgccttcatggtattggccaaaatcaacaatcacttcggcacgctcagcacaagtcagcatcaaatgggtaaatttgaccggctccggtaacagtgagccatccccgccaatttgcgtaaatggcaggtcatcggaaaaatgcaaccgccattcacggcgattagcaccatccagaaaacgcaaccggaccttttgcgtggtgacatcaaaatagggattgatgtcaccgttaatcattgcagttggcccagcaacaccgtcaggatcataatcagcccggtagtcccactggttgttctcatgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgccggttgttccaatgtgaagtcgatatgcttactttcacccggataaaccggcgcatggcatccgccatcaacataagggccactgacattagccccatgccaatgaaaagtggtcaactcaggcagggtgtttttcagtgtcacatgcgtatgctgaccacggcgatacacaatcgtctgacctaacagactggtattatagccccacgtcttggtcttcgccccaggtaacagttgcgtttccccagcctctgctgtcaccgtgtaataaacgtcggtcgccgtctctttatccggtttcaacaacggcggcacatttaagggcttctcaggcgcatcactgacctcaagcggcacgtacccgccatcgtggagatcaaacgctggctcatcaaagaaatagtccgtatagattttcatcgtgatttccccctctgacaagaattttaacactttttagggttgccataaacataatttagaattaacctaaagtagtattgaaaaatggtataggtcttatccatacacttgaggaggattttcatgcaacaaatgtcgaaaacaatgggctggctcatgctggcgttaaatgtggtgctgctgattctaattggtaccatgcacaatatggcagcgatgtggttaatgggtctgattatgactttggacgctgtgacagggttagttgccgcttatcggccccagtcaagtcaacaacacgcccaccagcactagtttgttaagaagttgctgcaagacctttcatggagtcattgatcggcgttatatgttgacatatacatatgttgaatatatcatgtgtctgtacttagatgaacagtcacatgaaagagggtcgtttaatgcagcaactgtcaatgacgcagaaacaaaccatgacgtcagccttacgggttgaatatttttcaacggcatggatggcatttgagtggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcatttctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccacacaaccaaaaagccattcatctcatcacgaggtgggtggcttttttgagtaagttaagtgacagcattgattgattgttatatgattgtgtatgtcctaaatggacacaagcaacgctcctaagcaaagcctgtatgtactgatttcagaaaagccctctattccgcataatagaggacttttttgtgtgcattctgcttaatttaaacggacaagtatacatctaaaaggtgaacgtgtcgtctgagagcacgtgattatttactttttactttgttagcatcgccggtttccaaagtctgtatttgagtcgtaagcgtattttgttcagactcagttaacgattcaaaaaaagttttttgtaattgggctaatccgttttgttgagttgagctataccctaaaattaccatagctttcataaagttttttagatgattgtcaattctgagcgtagtatcaaaagtaacaccatctatttgtttagacttcgttttgtttgattcgtttagagaagatatggaaatttctttttggggctggggcgccgattttctaggaattattttgcttttatttgagttaggattgtgtaaaagttccaccatgctagtccgccctttcaataatttcttgtgccacagaatcgtataatctaattatttttttatcgaactgatcttttagaaatacacctctgattgaatatcttttgattctttccatattacgaattagggtttttaacatgttttctttcccaaattcttcttctgctacttctaatgtgctgtgatcaacaggcgccccattctttaatagcacaggaagtataccgagtaaattcaaactaggtgcttcgtattcatcgattacctgttcctgtatatattttagaaacgattcggcaccctgaagactgtgctcttgagtttgaaggataatcagaacccaatctgaagcgtataaggcgctatcagaaattaaggaaatagtcggtggcaaatcaaataccacaaaatcatatttttcttttagtgaagcaagtagcttgctaaaatatgtaactctatctttataattatttttaaactttttttccataatccgtgggtacaatgaaaaatctgcgcttgatggaataaagtcaatgtttttatccaaagtaaccaacgatcttgataagtcctcttcttggattgatgcaagcaaggtttgattaaatttaatatcatcgtggcctaaattagccgcggttttaaagtaaatatctgtagcgtttgcttgaggatcgaaatcaattaatagcgtttttttaccagcacgagctagtgccaggcatgcaagcgtggcatttgttgttttaccggtgccacctttaaaatttccaaaagtaattacttcacccattatactgacctccaattaagtatcctaatatacaaggatacttggatacaaggatgataacatacaaagatacaaagatacaaggatacaaggatacatttcttctcaaaagccgttaaattaagattgactgcaagtatcctaatatacttagatacaaggatacaaggatacttagatacaaggatatgaatatacaaggatacaaggatacaaggatacataaaaagaaatgttgatttatcaccaaacaacgagtaatattggttacataaaatagaacataaaaaaacacccaccaacgggaatcgaacgaattaaaatcgaaaccttttgtgaactagggctgtccaatatccaaatgggcgttcggattaattttaaaatctaccataagcctaccgattttttaatattattttattcatcaatttccggcgccgacccaagctctgcctgaatcatccagattttcttctcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaataccgctttggttttcgtatatttcattagattgatctcctttcgatatggttattataacttagtggtagcttaatctgaaacgttatacactggcaaattaagttatttatagcccgtagaattaagtcgttttgaaaagatggagacgttatatggtagattgtaaaattaatccgaacgctgttcggattaattttacaatctaccaattaaataaatctacaattgaattttatttaccttatgaagatgttcaaaacgcgttaaaggaaagtgcgcaaaacccctttatacgtacaaaggatgaatgggtagtgggtaacaatgagtgtaaattaaataaggcacaaaaaaggatgcttaaggataaagaaatatataatcatttcaatttagaaaatattcccagttccatcaaaacggagctaaacaagatagtgcatgacatcgatgactaatactttaacaccaaacagaaaggggctatgaatatatagggtctataattataggatgactcctaaatctaaaaagacaaggcccattaatttattaactaataatattgaatttcaatttcataggaaaactggtaaactattcaacaaaatagttgaaaaggtggaaagaaaatgtttgaacaagcagttaactacaaaaatggactatatgaagaactatctaaaattggtaaggggctaagcagtgatcgacgattagaaattcttgatcttttaactcaagcacccaaatcagttgaaactattgccaacggggtcggaataagtgtagctaacgcctcacgccatctacaaatattgaaggacagtcatctggttaaaacaaaacgaaaaggcaatcatattatttatagccttagttctcccaaaattagtgatcttgtgcacctattaaccgatattggcaacagtgaactttcagatatgaaaacaattcaggataaatcagacgctcaagataacgttaaaaccatttccttaaagcaagctcaagaagaatacaaaaattgctttgtccttgatgtacgaccttctgatgaatatgcagcaggccacatacaatcggcaattaatgtcccattggaaacattaaaagaatcaatgcccaaattacctaaagatcaaaaaattattgtttattgccgtggaagactatgtgctaattccaacattgccacacagatcttaaatagaaatggttttgacgcagttagtttaaattcaagttactattattggaataaaataacagaataaacagtttaagcacgatttagtcatttattgattaaatcgtgcttttatattgacttacaaaaagtatgtgatattattaaactattcaagcaaacaattgaatagttgaaaggcagtgacataacttgtctactattgataaaacgctaaccttaattaattttgagaataattggtgcgcccagtgttatacgcagcgaccaataataaataagattagccatgactttaattcatatttaaacgttcgggtagtgaattcagatgctcacccagaactagcaaaaaaatacaatgtttattccgcacccagtactattttgctgcgtgatggaagaatcgttgaaaaaattacccgttttattgatcaatcacaattaacaactttaattaaatattacctataaaggagcgactcttatggttaagaacttaactgacaaagactttgtgaaagaaactagtaccggtgttacattaactgatttttgggctacttggtgtcctccatgtcgaatgcaaggaccgattattgaacaacttgataaagaaattggcgataaagtcaaaatcactaaaatggacgtagatgcaaatcaaaaaacaccaatggcatttggaattatgtctattccaaccttaattatcaaaaaagatggccaagtagttgataagctggttggcctccacagtaaggaccaacttaaaaccgttcttgctcaatatactaattaggttaagaggggagaagctaaatggaacaactatcagtaatgaataaaaaagaatttgataaaaaactgaagaatggaaaatatattttagtttttatagcttcttggtgccctgattgtagctttatcaagcctcatctaccagaaattgaacaagaattcaaagattacactttcatcagtgtcgatcgtgatgagaataccgaattggctcaagaactaaatatctttggtattccaagcttcgttatttttagagatgggcaagaaatcggaagacttgtcaataaagatcggaagactaaagaagaagtcgaaaacttcattaccaacactattaactaatgaagaattttttaactattcttggcggtatggggacgttagcaactgaaagttatgtccgactccttaataagaaaactgaaacccataaagaccaagaccatttagattatatagtggttaaccattattgatgcacaagaagtcattgttaatcgttcattggataagggattagcgttacgtgacgactaataagtagattggagtgaaatttaatgaggaaatatgatgtagtagtgattggggccggtcctggtggaatgaccgctgccttatatgcagcacgagctaatttaaatgtagcaatgcttgatcgcggtatttatggtggacaaatgaacaacaccgatgacattgaaaactaccctggttttacaacaattaagggtcctgaacttggtgagaaaatgtatcaaggaaccgttaaggccggagtaaattttgtatatggtgatgtccaaaacgttaccgttgatgatcaacaaatgaagcatattcaaaccgatagtgacgagttagtagcaagcgcagtaattattgcaacaggatctaataatcgaaaattaggtgtaccaggtgaagaaaagttctccggaaaaggggtttcttactgtgcagtatgtgatggttctttctttaaaggaaagaatgttactgtagttggcggtggtgattcagcaatttctgaaggattgtacttagctaatgtcactgatggagttaatgtcattcatcgtcgcgatcagttacgggcacaaaaggtattacaaaatcgtgcttttgataacgataagatagatttcacttggaatactagtgtgacagagattttaggtgatgaaaatcatgttactggagtaaaaattcataacaatcaggtcggtgatgatacaactctagacactgatggagttttcgtttatgtcggtaactttccaaatagccaaattttcaataatttaaatattaccgatcaagctggttggattataactaacgatcaaatggaaacaacaattcctggaatctatgcaattggtgatgtccggcaaaagcaactgcggcaaattacaactgcggttggcgatggtggtattgctgggcaaaacgcctttgaatatttcgaagccataaagcatcggcaaacggttaaagattaaagagaggaaaattacttcatggaaatcaaatattggtcagacattgcttgccccttttgttatatcggttctaaccgaatgaaacgagcaatgaaggaaattggtatttatgacacaactgaattagagttcaaatcattcgagcttaaccctgcaacaccaaaggaaaccgatgaaggatacattaatcacttcactcagggaaataaggcaatggagccacaggccaaaaagcaaatggcttacatcgaacaaatggcgcataacgatggtctaccaatggatcttgacagtgtagtacctacaaatactatggatgcgcaccggattattaaattcgcagaagctaaaaatgatcctgatttgactgaacgagtaattagacgcttctaccaagtttactttagtgatggtcaatcgatttctgaccatgatgtgctattaaatgcggcaatggaagctgggcttgctaaagacgaagtagaaaaagtgcttaattctaaccaatatcatcaagctgtggtcaatgacgaggcagaggctcaacaatccggtattcatgctgcacctttttttataatcaataataagtatgcaattagtggtgcccaaccatatgaagtctttgttaaagccttaaagcgagttcaagaagaagaaaattaggaggaatttacgatgaccgaagataagccacaatttaatacaatatttggcgataataatgatgctgctgtatgtgggccagacggttgtaatatcgctgaacatcaaaagcaaactgaggataagaagaagaaaacaaaataaatggagggaagctataaatgaagtttgactacgttgttattggcagtgggccatcagtttatcgtttcctattgggaatgcagaatagcggaaagaaaatcgcggttgttgaaaagaatcggtttggcggaatttgccctaacgaaggctgcgaacccaagattttcttagaaggagcagcacgagcaaccttaacttcaatgcgtttgcaaggtaagggaattactcaaccagctaagcttgactggaaagaacttattcagcaaaagaataaggctatggcgtcattcctaaataatatgcaaagtatgtatgaaggcctgggtgcgactaccatcaagggtgaagcatcatttgttgatcaacataccattgaagttaataataaaaaaatcactgctgataattttgtaatcgcaaccggaaaaaagccgcatcctcttaacattcctggccacgagtacctacttactagtactaacctttttgaactcgaagatactccaaagaacgtcgcaattatcggaagtggttacgttggtatggaatttgctacattgttgtctgctgccggggttaaagtaaccgttattgtccgatccggccaaccgctagagggattttacagccaacacgttcatcagttagttgatgaaatgaaaaactcacttggtattaattttatatttaacacaaatgttacagctgttaccgaagcacaaactggctatgaggttcaatcagctaacggcaaccttggcacttttgataaagttattaatgccagtggtagagttcctgaaattaatgcattgaaacttgataatgctggtgtagagtacagcaaccgcggaattaaagttgataaatatttgaccacatcagcaaataacatttacgcaatgggcgatattgttgataaaaccgcaccagcattaacctctacggcacagtttgaagcagactacttaagtgccttacttactaataaaacaactgaacctcttaggtacccagtaattggaaccgttacgttcacattcccccaactcgctcaagctggaattagtattgataaagcaaaggaagacagtaattattcaattaaagatattgatattactcaaggtgactttctttatgctggaacagatgatcacgcacgattatcattagtctttgacaagcaaaatcatctcgtgggcgctgctgaaattagccaaacagcagtagatgatatcaatgcactaattcctgttatggcaattgatgttgatccagaggtttggaaagaaaagatgctaatggctttccctggtttagcatataaaattagaacattaatttaacaacaagagggtctatttgtgataaatcgcccctctatacaggtttttaatgggtctagcacaacatagaataaattctatgtgtaagtgcgcattgacctcgtttcactcggtcttctgatgaccataaaatcagtttttgctgttgttaaactgaatgtatttttaattcaatttatacttgcacttaactaagtttgttatgctttagatatttaaaaagtgttgcggattacgctgttttaagccaaaatattttaattgctttgtgcagagaatttttataagcttggtaacaaattttgaataacggtgttgtaagatctgtaaatctaaactgaaagcattattttgatgttaggagtcattaagatggacgaaaagaaagtattaaaaccaattgatgaaatgcttgctgatccatggcaagttgatattcaagaattgtttgaagcttctttcaatgaacctgacgagatcaaaaagaatttgtatgattccctgtatacttatgttttgcaaaaaagacaagaagatattattaatcgtcctggcttcgttatttagccctctaagagcctgctgagggctttttatttttgctttggtataaatatatataaacagtctcaaaatcgctagaaacgagaaataaggcccttaaaaacgaatatagcagttagattcttgttgagattcaaaaaactaactgtttgctgtcaatggtaacggacgagcaaaacgtgggagcataaggaattgacagctttaaacaagtcttaacactgaaatggcgaaagccaaagtttctacaaaactttgctttcctgcctaacggcgagtgaaaaagcggttaagctggctcagcttggacagggttcggggcgttagcgcccgattaaatgtggcttgccactccttttgtaggcaacgaacgaagtgcggcgcaaagagcgtagcgaatgaagtttaatgtgagcctgtttttgggctcactcctttgtatttttgttttagattttgatcttgtacagtggtgcctcttttaaacctcttttataaacctcttttaaacctcttttagacccccttttagccttactctcccaggggatacaggagtttatggatagagttttgtctgtttatagatagagttttgtctgtttatagatagagttttgtctgtttatagatagagttttgtctgtttatagatagagttttgtagtattatatattcataaaaccatattcattaaaagaggtgcttcatttgagtaatgaaattgttaaatatgatcctgaattaaatacaatcccacttcgaaaattcactcctgttgaaatgaatttattcttctcaatagtttctagaatgcgtgacaagggtgacgaaactgtaaggttttcatttgatcaattaaaagaattaagtgcatataaacctacagcaaataaccgatttattgacgatattgaaagtacttatcaaaaaattttaggcttacgctttggaaggcgtagtaaagatgggctgcatcgtgaattttttgttatgtttaccgaatttgagataaacggccatgctgatgatccttatgttgatattaaaatttaccccaaagctataaaattattaaatgagctggaaagttgggttcgttatgctttatcagaattcagagatttaaaaagtagctacgcaaaaaccatgtttcggttactaaaacaatttagaactactgggtacgcttacttttcagttgcagactttaacgagctattagatgtccctaaaagctataaaagtagcaatataaatcaatccgttttaaaacccatcaaagaggaacttacgcctctttttagaggcctaacggttagaaaaaaatatggtaaaggccgcggaaaaccagtgattgggtattcttttacttggaagtctgaaaagaaaaacgctaatgacttctcacaaggtcaatttcaagatgaacgtcaaaaactctttaacattcagcataatggtgaattaacagaacaggaaaaatggcgtgccattgataaagttaaggggttaactctaggttctactgaaaagcaagcattggctgtcaaacaagccgaacatgataaaaaaataagagatcaagcacgaaaagaagcacttgctgaactccgaaaggggtttgggaatcatgcctaaaactattagagaacttgctgatgagtttggtgtatcaaaacaagccattagggaaaaaactagatgcaaactttagttgttgttaattcgggatatttgccgttaaagcaacattcattggtggcaacaaccagaaccaaatcaattatagtttagcttgaagattgatatctattttaaaaaacgacaagaacgacaaccgagtttaagctttgcttgtcgattggtgttcttgtcgtttttaacttataatttaaggcagattaattaggtggtgaaactattgggcaagactattcgacaactttcagaaaaattgaaattatcaaaacaagctattaatcaacgtattaatagtattaatggctttcgaagcaaacacacttataaagtcaaaaaccatctagaaatagacaaccaaggcgttaaaatgcttgctaatttcgacaagcaaaaacgacaagaacgacaaacaaatcggcaagctgaaaacgacaaggacaaaaatattgatcatatcttgctgagacaacttgatgttaaggatcaacaaattgcaaatttacaacaagctttagaccagcagcaaaaattacagatagcaactgttgcagaaaatcatcaattaaaagaacacgtgcagaaattgagtgccttgctcaaaccttctagttcagttcaaaaaaaacaagcaaacgacaatgacgatatcttgtcaaataatatcaatactagtcatatcaaggataaaaacgacaagcaagatgaaaataaagttgttgaatatgataatagacaaaaaaaatcatttaagacaaaattcaataatagttggtggcatttttggtagaattctatgattttcaacaagtaatcaacgataaagcgtaaaaggttgcttaaaaaattggctaaacaaaacctgcaaataaaacaggccacaccagaacacagccaaaatctaaagcatcaactttttttagagattcgatagctatttttatgaacatagaccaatgatataatgcatattgttattggaggtagattgatgaaaacatatagctcacatagtgatgcgaataaggtgcttgtacaccaggttaatattgcacattacaggttaattcaattaacatcgctcgctgaacaggaacgcccattttacgagtgggttgaacgatatgctaaggctcaaactcattcagatgttacattaaatgagtttcttatgcattccaacttagatgccataaagaaactgatcacaatggtatacttcgacgaatctaatgatcgtcctcatcttttcgatggttctgggagattttatgagcaccacaaagcaagtttcttcttttttgcttggttgattcgcgatgctcctcaacagagactcgcaccgttaattacaaaaatgagaaagattaagggaaatgagttgaaaagggagcaggcagagatagattcgctttcacgcctttttgtggaataccgaagcaatgttcacttgtttcaatgggaagctgtaagagaagtatttgctgatcggcttgaagggtctaggcggtcaatctcaggacatatagttgaggctaatgtacgaactgccttcgtaactgctatacagacttattatgctacatatttaaattatggaatctttgatactgttaaagttagtaagaaacaggttaagataggcaacgatactgctgatatacgagttgactttataaaaaaggggacaattagtaagagcatatttgtaccaatcaaatcacgtgaaactgagggtggaggacatgcacatctttttacaagggacattgaaaccgcaattagtaatataaaaagtgcagatagtggttcatatgtcgtagctgttataattgctgaaaattgggatgcaaaggaattgaacaacttgaatgataaagtgaatttggtttttcattttgatatgaatcctaaccagtttcaactgtttgattctgaggcccaaatagttctgaataaatttatcggaggaattttaaatggttcaacacaataaaatattgcaaggaaatgttaaacagagattgaaagatatagaagacaacagtattcagttaattgttacatctcccccttattataaactacgaaaatactctaaaacagaacaaacagcagctgaagaaatcggacgagaagtgagcgtagatcagtatgtaaaagatcttactgaaatttttgaatgcttaaaaccaaagttaaaagaaaatggtcttttttggttaaacttgggagacacctttataaataaagaacaacagggggtcccgtggagagttgcactatccctgatgaactctggatggattcttagatcggacgtcatttggcataaaccaaatgcgatgccatcttcggttactagtcgaccaacagtcgatcatgaatatttttttatgttttccaagtcaaaatcttattattatgacgcagattctatccgtgagcctaatattacattcactgataaatcaaagatgaagggtggacgtaatcattttggaaaagtcaatgggacaccagagaacggcaaaaacggcggaaatagtaatttacacaatgggcgatgggaccaggcttttaatccaaaaggtagaaataagcgtactgtttggagtattcctttaagtaaatttcgtggtgcacattttgctgttttcccagagaaacttgttgagccacctattttagcatccactaagccaggtgatacagtccttgatccatttgcgggatcaggtactgccggtgttgttgcgaagagattggggagaaattttgtgggtattgaattagtcccagagtttgctgagatggctcaacgtagaattgatgagatacaggaagagatcacactgttctaattactagtttttttattttataatagtagatatatagaatgatagttagggtctatagcttacaaataggcctttgatcatttctaaagccattcttcagaacgttattacgatctgaagaatggctttattggcttgtgcaagtaacatttgcgtgactaatgctagtaattcttgctaggattgccttagatccttgattatgatttaggaggagtgagatttgagctttaaagacgatatcaagaccttgcgcaggcaatctaacttaacccaagaagcattagctcaaaaattacatgtgacccgtcaaacggtctcaacttgggaaactggcaagaatatgccaagtttagagaccctgcatgctttgagtcaattgtttaacatcatttgaaaataaaatgttaccttttaccctagaaaggtaacgccaaaagaaaaattcccaatgcatttagcaaagggaattttttgtaattaattcgtggtttttttgataatcatttgaaagtgaattatcgaattgtggcccctaatacgtttttaaaatgattcatcgcccattcagcaccagctggtgagaacgtggccacggctgcttgtggaatcacaatgtggtaatccaggttgtaggcactgattgcggtgtggaggacacaaatatcagtgcagacaccagcaatccagacttcatcaatccgccgttcccgcaggtagttatccaaattggtgttttggaaggaggagtaacggttcttattgaatttgtagacatgggaatcgtcatgatatcgatcaaaccagctgccgacttggccgtatagtttctgaccggtcgtcccaataatattatgggccggatatagtttggtttctggattgaatgggtcattaagccggtgaccatcagtgggaaagatcacataatcatgctggcttaagaattgatcggctaaccgcataatttctggggccaacgtctgcgctggcttgccaaccgttagtgatcccttatcagccacaaagtcgtttgtatagtcaataattaagagcgctttagccatcttaatgttcctccgtaaattgagctttagtaattaactgttcttgcaattcagccaatgtagctgttaagtaaactgggtaccgatcggggttaactaaccgttttgtggcttctggtaattctgctacttgatccattgagaattgctgaatcttaaagagatcattttcgattggggaagcattggaacccagatattcttgcatcaatggcttagcattaaagttagtcagaacttgactggcgtgcgtggctgccgaattagcattaaccactttcaatggagccgtgatgtgctcatcagccagggcaatcacatcggcgatcgcttggtgaaggttatcttgccggtaaatccggtaaacttgcttattaccaggcagggtgatcttttctctgctatcactaaccttaatttttgggatccattgatcattaatcttttcttcggcgagcttataaacgccacttaataccggactggaggaactggtaattaaacgttccccaatcccaaagttatcaattggagctccttcatccaacaacgacttaactacatgcgcatcaagggcatttgaagctgtaatctttgccttggggaagccagcatcatcgagcatcttccgggctttgatggctaattgcgaaatgtcaccggaatctatccggatcccgactggttggtgcccttgagcgctaacttgcttgaagacccgaatcgcgttcggcactcctgacttcaagacatcataagtatcaacgagcaaggaaactttgtcaggataaaccttggtccaagcttgaaaggcacttaattcatcagagaagctttcgacccaggcatgtgccattgtgccggccgcgggaatattaaatttactggctgcttgtaagttcgacgtgctggtacaaccgccgatcaccgcggctcgcgccccatacgtggcggcatcagggccttgcgcccgccgcgcgccaaattccataattggtcggccttgagcggcatggttgatttgccaagacttcgtcgcaattaatgattgatggttaatgatgtttagaataaaggtttctaacagctgggcttcaatcaacggtccactaattgaaataattggttcccgtgggaaaacaggggttccttctggtaaagccttaatcgagcagtgatttttaatcttgctcaggtaatccaaaaactcgggagtaaattcattcagggaggtcaggtattcaatattctccttagtgaaatgccaattttgaacttgttctaccacttgctggagaccagcgacaatgacaaaactaccgttgtcgggaacccggcggtaaaagacgtcgaagcgagcttgtcgatcatggggtagggtagcgtagtacccattggccatggaaaattcatataagtcggttaatagttgtagattcatcttaaatgcttccttttaagtaaaaattactttaattggctaaaaataaaagtatggttaacttttatttacgtctagtataaatactttgcagcaaaatgcaaatgatgccctttagttaagttggtagagctttggtggccgcccagaatggttcaaagtggcggccccgacttctttgaagaggtggttgtgagttttcttaaagttggaattatcaatcttgtcaattgtcgtacctaagaaagccgcaaagacttcgcgcgcttggcgcagggtaaaggtattacctaagatccgaagaatttggggttgatagtccagcttgtttttaatccgattaatggcggtggtaatgatttgaatatgatcaaagaccaggtgaccggcgggacttaggataatctcctgttggtcatgggtgatcacatagttgccctgatctttatcaagcacgaaccattgggcatctgtggccccataccctggatgcaattttggggttgatggtaaataggtcatataggcgagtgccagtgcccgagttcccgtaacccgcttgggatctgtaaaggtggccagttgttcggttgaattcatcggaacttgcaggccaattttatcgtcaattagacgaatgcaggccgcgtcggcactctctttactccgcaagagggtttcggggagggcccaatgtccctttagaggttcatctgcccgcttaatcaatagtaattgtggtcggtgtaattcagtattaaaactccaaatgacgttggtgatggtcaccaatggccgggcaataatttcactatccaattgacgctcctcccttcataattgttaactcaactctattttagcatttctcggccactagtaattgcccagttgctttaaatcatgtttgacgaggattgctaaattttgaatggtgatcgacgtcggctgggctaaccataagcaaaaagtattccagaaaataccgacggcaatgcgggtcatatattcaactttggtatcgttagtgacatcgacgtgtcaagcaacactggggtggcggagatggaaacgccgaaagaaaaccggcatcgtttggttagtattatccaagatcttatagcttaaaccagctttaactaacaaagccaatttagctgagtgagctggccagtaagtaaagaagtcatcgatgacttctttataggtttgggggttaacttgcaagatccaatcagtgtatttctttagtaaggaaataacatactgattaatcacatcgtctttgcttttgaaattccggtaaaaagtccgccgggaaatatgggcttggttactaatatcgatcacgaaaatttcttggtacggtttgacggttaataattttttacaggctcaaaccaaagaacaatcagcttttattgagctacttaaacagcagttagaggttaaggacgaacagattgcaacgactaataggattgccgatcaagcacaacaattagatttaactacacacaaacaatcacaaccatcattacctcaacaaaccgaatctgagagagcgtaaaatatcttgtgtaaatgcataaaagatttctgaattgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgccgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactgggatctggactgaactgctgggaaccttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatttgcttaaaatgccgaatttactcactttcatggactttccaccagctatccggcaatcactatactccactaacctgattgagaactttaataagcatctcaagcgcaccacccaccacaaagaaccatttccaacggaagattcactggatcgcttcctggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctacctagaaaccggcatgaagatgggggcatgcacttgtaatcacaaaattagcgactggttaattggtatgaatggtagcccataaagtattttatattgataaaaattagagcgtgctcgattagttacgtatagctgccagccttgtgtatggtctattaaagaaaccaggtaaacaaaacctttaagccgaaaccctattttgaactaaatgctgaaattcttgctaattagcaaaaaattcagcaaaattagacccctatcagcgatttaaaggcgaaacagggctaatgacattcatgcaagctaaacacgttcagaagggcttacaggacggtttaatcaaggacgtccaaaagcaaggcaaaaaacgagctagtccccaactattctcgctatctagtctccaaagtgccatgaataaacgttatcacgccagcgccagccaaaccttagcggctattcaaagcttatacgaagacaaactgctcagttatccccgcaccgattgtgcttatatcactgatgaagaatttgattatttagtggctaatctgacgaagtatctgggtttggtatctaagcaagtcgctttaaccaataccaccccaaataaacgttacgtcaatgggaaaaaggttgaagaacattacgccattattatgactaaagttgtgccgactaaagagaaactagccagcttacctaaattacagcaacaagtctatgacttggttttaagaacgacgttagcgatgtttgctgatccgtacgagtacgaggaaaccaccattatcacccaagttggtgacgccaattttaaagcaaccggtaaggtcccaactaagcaaggctggcaagctttatttgatgatcacacagccgaccagcaagaagcagcaactttaccgctcgttaaccaaggcgatcaggttaaagcaaatctgcaaacaccgcaaaaagaaatgaccccaccagtaccgtttaccgaagggacattaatcacagccatgaagacggccggtaaaacgcttgatgatgaagaagcccaggcgattctcaaagacgtgcaaggaattgggacaagtgcgacccgggccaatgtgctggaagtgttaaagaagcgcggctatttagttactgaaaagaacaagctccacgtcagtgaagcgggaattactttatgtaaagcggttgaactcgaacccttgctaactagcccagagatgacagcgaaatgggagcaagcgttacagcaaattagtaccgaagaacgtaccccggataactttttgaaccaaatcaaaaagttcgtggcaaagttgatcgctgatgttcccacgcaattaactggcagtgcagccattaagcaacaaatcgatcatcagcagcaagcccaaaaagccgctgaggtcttcttagaaacaccgcaagcgaccgttttaaataaacagaagttttacattgtaaagcctaagcaaggcgaagactttaccctgcccaagaaatggagcagtaaaaccctcggtaaaactgcgatcaaagccttaatcactaagggggaaaccagcaaattaaagggtttcaagagcaaaaaaggaaaggcgtttgacgccaagttaaagcttgacggccataaattaagttttgattttgattagaacctgcctaccgccctgcactacgttccggttggtgaacccgtcatttaggttcacttttacaaccctaaaagtaaacccaaacaacgggtgagattaacaaagcaaaggagatcatagaatgaacaacgaattagcagttttagccagtgaattacccgttttgcaagctaaaggaacctacaagtatttaaaagaaatcactggtaacggcgcttattatcaagtagcctggcaaaaattagctgatggctacatcgccctttatggcacgaccccgattcaaatcaacgtagcccctatattgaatgatatttttgaagatgaggaggggtagacaatgccgagtaaagcagacgttaaagcctggaaagcacaattagtcgcccaagccgaacagcaaatcctaaaattaactgatagtgaccgatttaaacagtatcttaataccctggctaaattccatcattatagcgccagaaacattgatttgatttatgcgcaaaatccgcaagcgacccaggtcgcaggatttaagcaatggcagaaggcttttaaccgcaccgtcaaccggggcgcaaaagcgattcggattgcggctccgatcattaagaagctaacaccagccgagcagaagcatcttgataccaccgatgagcgcgccattgtcggttaccgttatctacccgtctttgacgtgtcacaaactagcggtgagccagttttaagtgccaaggattttgtcaaagaaaatttagccgatcatcagaatgtaacgagcttatataacgcgttcaaagattatttaaaccagcaacccgaccttaaagttagtgaagtgcctttagcgacgctaaatggggctaaggggtattttcaacccagcactaatgaaatcgtcattggcggtgatgagcccgacaatgatttgaaactaaagacgttatatcacgaatatgcacatagtcagctacacggattaaaatcagcctttaaagatcgcccacgagcctatcaagaaacgcaggccgaagcggtcgcgtatgttgccatgcaaaacattggggttgatacaggcaattactccctcgggtatgtagctacctgggccaaagataaagccgtgatccatagtgctttaagtgaaatccagcaagttagcaacaaagtgattgagcttagtgacgggttaaccaaacaattaggcttacaagaagccccaaaagagcctgagcacgatttaaaaaagctagcagcccagtcactgaataagtcctatcaaggcttgcaacaacaagttcagcaagcaaggaacccacaacaaaaatcagaactaaaaaataaattaaatgatgtacaccatgaaataagtgagcgaacacaaaagaaactgcaagcatttgctaaacagaatccagaaattaaacaaccagattctgaacctgatcaaagcctaaaacgttagccagtttttaaagggcatgctataatggaaacagaaaaggaagccccgccgaaaacaggacttcccacgcaagccgcttcaaaggcggtggcataattacaaaactatattaatgtcgtcccgtaactcgccaaagttataatcggggcggcttttttatttgtggtgcttgtcgatatagctgagtagcgcgattaaaaacgtgccaaacagcaacatcaacgagagtgtctggaagacgctcattgactgtgaaaccttcctgaagattattccatgttcccatgggcctcacctcgcaagggaaaagacagccaccgcccttaaaacttcctgcgtaatccattatacaggtgaattaagtgttgaccaagcacaataaaaatcaagtcatggggtttcataggatcctaaatttgatcaaattaagaatcagcaaaacatcttttgtagatacccctttttaagttcttggagtttttcaagcttacgctgatgaagagcgatagtgtcgtctagaagtttgaagaacgaaccgattttttcttgttcttcaagatgaggagctttaatttcccatttttttacttctgacattggaactaaattggtaattgccgatccaggattagcacctgttaaatttttttagtagatggcagattgcaagctaatttcgtgtttgaagatggtaaaggtttgatatacatgctgctgtcaccacacagaggtcaccagccccgaatagccagattcagttccaggtctgccggacccaagacgacgagcagggttgtttcaataatcaccacgaaagaaggttgccaagtttttgacaagcatcaacgctgcaataaggacggtaagctaaccgtaacgccaaaagctgataaaaccgcggagtatgctggtaacccagcaaaaccaacgatgccagcgcctaagccaacggttactaaagtagttaagatgatccagactggtcatcaccaaacttaatttgatcgattggtggcttggttcaaataattgctagtctgagggctcagcacgtgtactaaacacattaaggaatgactgatgaccaaaataggaggaatcaacatggctgataatgtgttaatggcctatcatattgtgcatgatcccgatgattgggcgaaacatgtattgaatacgaaaaagttgtataagtggcggatcactgaacagacgagagggatgccagtgatttaaatttaaagtttaattatgttattataaacgtgatttattaagaccacttaattaataatgggactttagcatgatttcaaatattttcgtgcgaaagataggcccaatttaggggatattagtagtttctattctaattgaaaagacccgatagccttaataaaccgggattttaatgacaacattttatctaaaaaattgagaaaggtaggttcttttatgttaaggaataatttaaggaataattattttggagagattaaaacgcattataaattatataaatgcggtaagaattgggctgtcatggggatttcattattttcgctgggattagggatactagttaccagccagccagtgtcagctgatgtgacagccacccgcacctcaagcagtgcaccaaaggccgaaacgactagtgcaagtagtagcagtgcagtgaaggctgaaacgaccagtgcaagtaatagcagtgcagcgaaggctgaaacgaccagtgcaagtagtagcagtgcagcgaaggctgaaacggccagtgcaagtagtagcagtgcagcgaaggctgaaacggccagtgcaagtagtagcagtgcacaatttgtccaaaaattcggattaaatttgcaatctaccaatttgcaatctaccatactaattaacggtaatttatcctgaaagggtttgttgtaatggtatttcaaagtatctcgtttaatacaccgataagcactttacttaacgatacataaaaatcgtgatacgattcagttgtagttttaaaggatactatggtcactaagttacacacataaatttttatggaggtgttgtaatatggcaaatttctacggaaatgatccttttttcaacaatgatatggatgatgttttcaatcaattatttcggcgcatggataatcaaaattcggagcgtgcacggtatttagttaatggacaatcgctgacaccggatgagtttgctcaataccgagcaactggtaagctaccccaaaataataaaacaatagaagtatctaaagatggtaaacaggctgttaaaaaaggggggattttagaaaagttagggactaatttgacggaacaggctcgtgatggattactagatccagtgattggacgtgagaatgagattcaagaaactgcagaaattttgagtcgtagaacgaaaaacaatccaatcttagttggtgatgccggtgtaggtaaaactgcaatcgtcgaaggtctggcacaagcaattgtggctggtaaagttccagaaacgattcaagataaagaaatctattcgattgatttatcgtctttggaagcaggaactcaatatcgcggttcttttgaagagaatattaaacagctggtaaaggaagttaaagcagctggtaatattattctattcttcgatgaaattcatcagattatcggcacgggtgccactggtggtgaagacggtggcaagggattggctgatatcattaaacctgctttgtcacgtggtgagctgactgtaatcggggctacgactcaagatgaatatcgcaatactattttgaaaaatgcggctttggcacggcgattcaatgatgttgtgattaatgaaccgacggccgctgacactttacgtatattacaaggtgttaaaaagctgtacgaaaagcatcatcatgttgtattaccagatgatgttttgaaggcggctgtggattattcaatccaatatataccacaacgcactttgccagataaagctatcgatttgatcgacatgactgcggctcatttagcggctaaaaattcgcaaactgatgttgagacattggatcaacgcgttaaaaaattagaggcagctaaggaggccgccgttaaatcggaggactttacaaaagccgctgatatcaagaagtcgatcgaggaaaccaagcaaaaaattaaaaaaacggatcaaaaagaaaaaatcactgccacgattgatgatgtggcacaatcggttgaacgtttaactggtataccagttgctgatatgggtgctaatgatattgagcacttgaaaaatcttgataagcgtctgaaaagtaaggtaatcggtcaagatgaagcggttgaaatggtagcgaaggcaattcggcgtaaccgtgcgggcttttcagagggtgatcagccaattggaagttttctgtttgtgggcccaactggcgtaggaaagactgaattagctaagcaattagccttagatatgtttggaaataaaaatgcgattattcggctagatatgagtgaatatgctgatcgtacagctgtgtcgaaattaattggtacctcggctggatacgtaggctatgaagataatgctaatactctaactgaacgggttcggcgtaatccatattccattgtattattagatgaaattgaaaaggctgatccacaagtattaacgttactgttacaagtgatggatgatgggcgcttaacggatggacaaggcaatgtcattaatttcaaaaatacgattattatcgctacttctaatgctggctttggtaatgaagcattaagtggtgacaagcaacgagatcagtcattaatggataagttagcaccatttttccgcccagaatttctgaaccgttttaatggaatcgtggagttttcacatctgactaagcaagacttaagtcaaattgtcgatttgatgttggcggatgtacaaaaaacgttagccaaaaaatctatcaaacttgaggtaactaaagcggccaaagattggctgatggaacaaggctatgatgaagcaatgggtgcgcggccattacggcgagtaattgaacaacaaattcgtgataaggtaacggatttctaccttgaccacttagatgtcaaaaacttgaaggctgatttagtggatgctgagattgtgatatcggcagcttagcttaaatcagtgttcataaataactttatgtaagaggagatttattgggcaggagattgcttgatagatatccttttttcgttgattttcaccatttgatattaatctaccatctaataaaatttcgattttataacgtgataatctcgtgactttattttcagacgtaatataaacgcattctcgtgcattgtttgcttatacgtgtatatagttgtcaaatgcgtgctatgattgtatcaataacttagcatatacttgaaagggtggtagatttgacaacaattgcagaaatttcaaaggatttacacatatcaagagcaagaatttatcaaataatagattcactagacgacaaagacaagcctttaaaagatagtgataataaatatattttaagccaagatgttgttaatgctatacatcaatattatgccaacaatacaaataaggatagacaagacaaaagcacgtcaagcaacgatcaattagttaatatacttagacgccaacttgacgaaaaggatcaacagataaacaaatttcaaaaattattagaccaacaacagcaattaaatttatccagtcagaaattacttgaaaatcaaaagtcagaacaaaatattaaaagcaacaccgtacaaagccgtgagaatgattctaaaggcgatagcaatgattcagatacaaatataagcaagcaaaacgaaaagccctctaatgagacgagagagaacttttggaaacggttgtttagataggttgtgaatattttttgagtagtatgggtggcttttttgcgtaagttaagtgacagcattgattgattgttatatgattgtgtatgtcctaaatggacacaagcaacgcccctaagcaaagtctgtatgtactgatttcagaaaagccctctattccgcataatagagggcttttcttgtacattctgcttcatctaaacggacagttatacgtctaaaagctgaacgtgttgtctgagcgcacgtgattatttactttttacgcgtacatcacgtttttctaaagaatcaatttgaaattctaattctttacgttcgtctgaagtcaaagattcaatataaacagataaagctacttcaatagctgccttttgattgtcactataccctaatacagccattgcttgcaatttgtttctaatgtggttgttgatttttaggtttgtgtcaaaagtaaccgaagcaacttgattttgtggggttttaattcctttatttgaatttgaaaaatccgaaatttcagcctgcttatctggcttaattgggttgcggttagaccgaatcaatttattagccattttcaattgcctccattctttttagcatctcgtcagttacgtctttgtatactttgaatacacgcctatcaaactgagtattgaaagtaataccagttattccataacgcttgatcctctgcatcgagtgaattttatgtttaaaaatgttttcagttccaaactgattaatagcattttgaatagttgcttcatctacaggagctccggcttgcaatagaacagccaatataccaacgatttccaaacggggagccttgtaggtatcaataacttgttcctggatatactctataaatgcttgagctccctcaaaactatgttcatgagtttgcataacaattacacaataatcgctggcatacaatgctgaatcggtgattaacgagatagtaggcggcgtatctatgatgacataatcatatttatctttaataggcttgataagattactgaattctttgacgcgttcattatagtctttgattttttccatatagcgtgggaaaagagcaaagtcaggtgcagaagctaggatatcgaagttttcttttatatgtattaaagattgagttaaatcgccatcttcaatactagccatgagagattttttaaaatggccaacttttccatcaatattaactttagtattcaagagtagatttgtggcgtttccttgggggtccaaatcaactagtagtgttttgtaaccacgattgctaaggtctagagctactaatgttgaattactagtttttccaactccgcctttaaaatttccaaatgttatggtttgtgtcatgataacgcctcctaacgattgttgttatattagcactatatcgtttttaaatcaacacgatatagtgctatagtgcgttagttctatagttctataatgctgttgttctgtagtgcttatgttctacagttctatagtgctgtagttctttagttccgtagtgctagcactaccgtatagctttaagccctatgtgcaagcatttactaaaagaaaaaaaagtgccgtagttctttagttccgtagttctatagttctatagtgctgtagtgcttatattctatagtgctgtagtgcttatattctatagtgctgtagtgctgtagtgctagttttttaaaagcattgacttttgttgtggttgagctataattctaaatgaaatcgataaatagaacataaaaaaacacccaccaacagccattttataaaaagatattttgtttttttacggaagtagctttataaaatgagaagtttcgttatataatacgatatatcgtattatgtaacgaggtgataaatatgagaattcaagatctttttattgagcataatatttctgttaagaatatctcagaacagacaggtattccatacacaacgttacaatcagcgtataagcggccgctgaaacattggtctgtggcaattctagaggctacatctgaggcaatgggaatggggatagaacaattgattacattattggatgtttccgatccactatcgccctttatcaaatgggtaggtggaaaacgacagttgctccatgatattaacgcattaataccagttgaatttggtcgttactacgaaccctttgttggagggggagctgtttttttaaacttagcacctaaacatgcagtaattaatgattttaacccagagttgataaatacttggaaaatcgttcagtttaacccgcagaaattattagatgtgttgaaaattcatgaaaataataatagtaaagagtattatcttcatttgcgggctaccgatcgtaatggtcagttggagagaatgtctgacgtagaacgggcggcacggtttatttatatgaataagacaggttttaatggtctatggcgagtaaatcaaaagggacagaataatgtgccctatggtcgttacaaaaatcctaaaattcaagatgaacgtattttattagcagctgagtacttacagaaaaatgatattaaaattctttgtggcgactatcgtgatgccattcaaagtgctagattaggggatttggtttattttgatcctccatatgctccagtaaatcctacatcgtcatttacatcatatacaaaaaatgaatttgggttacaacagcaaatagaattacgagacacttttgtgaaattaactcaaaaaggagtaaaagttattttatcaaatgccgatgttccattgattgaggaactttacaaaaatatcgatgatgcagtaattcatcatgtgaaagcacggagagcaattaattcggttggatcgaaacgcggaaaagttggggaagtgctcattactaattattaagtgggttttcagtaatgaggctgtgacataactagtctctttataatggaataggacgagaaaccgatctttgttttctcgtcctattcttttgctcttggagttggctaccagtgtaaccagtttctggatattcaaggccataatcacgatcccggcttccttacggaccctgtctaggccgcgaaccgagaatcgatggaaccttaaagaggccttcatttttccaaaaattggctccacgtctatttttcgttgggcgtagatggccgctgtttgggatgttgatagaaggtcgcgttgcttggctttaaagtattcccaagcgctgttaacttggattcttcgtaggtttccttttggcgtgagggcttcggaaatcacattctgattctcatctagtttttcggcgacatactctttaaaatcacgtataaatccatacttatcagtccttttccgatacgccttaaaattaaaccgtacacctttatcaacatagtaatcatcggcttcatagtagtcccagttcatgaccttgcggtcatcgcttttccacttccgactattctctttgatcattgtcccataaggtattagggccgtatgttcaggcaagctgtcttctagaaaacggtagttactttccgagccgtacccagcatctgccacgatggtggcgcctaacgttccgtgttgctgtaaatgcttgatgaatggctgtagtgtgcgggtatctgttgggttttgaaagagttggtaacccgtgatgaactgaccgcttgtggaaatctgaagattgtacgctggtttcaattgaccattttgcatcggatcttccttgacccgcataaaggtggcgtcatgatcggtcttggaatagctgtttcgttgcccatagattgactgttggtcttgatgctcccgcatcttatcccgtcgttcaactagtcgtttctttgctcggaacgtgcgacgtttttgttttgctggatttggcgagaccttttcggtctccgccactttctgctttaaaaccactaaatggtcctcaaccttactgatcatcatctccaaaagctctggtgttaagttcgacccagccggaacttcaccgatgatttttgcctcatgtagctcgcctaacagttcaaccagcttttcacggttcatttcatcgaaccgaatcgtattctttttccaaacgaagctatacttgttcgcatcggctagaatcttagtaccatcaatgaatgagacgtcatcaatcagcttattttgacgaagaaaagtggtcagttgcgttaaccctgcttcggtcaatttcgcaagttcatcggaaattctaaaacgacaaatggttcgatacgaaggaacttggttgctgaccagccatccggctggtttattttcacgcgcgaatctttcaatctgacgactgctaaaaataccataactgtatgccaaaagaaccaattttagtagagcccctagatcgtattcccggggccggccaaactggtatgtatcggtcagttttaagctttccacgaattgattgatgtatcttgccggatggttttcttcaggaagatagtctaaagtgatactcaaagtggtttgattcatgttataatagtcttgcatatttagatgtcctttcggggataatctgtgggtatcgggtgtgaccgatgccttttttattttctattatatcaaaaggctgtccagtgagaatccgaagattctcactggaccgctttatttgtggagacttatgtcacagcctcattaaaaagagattggtagcatcaagcattgtctagtagtgttaggcaatgtttttgtaatttcttcaaaggtggtatgttgtatcttgagcgatataatcacgtttacttagaagattaaaaaaatcattaactaatccaagttatcagtggttgggataaaaatggattgtttttaattggaaaatgggatactggggtatgatcgtcagtaatctggttcggaaccagattactaatttgaatcgtaatgctatagtgatttattattaaggtatattgcttacctttggaggatatgattatgaacaatcaggtgaaattaaagtatgttttacagccagaagataaacgtaaaaataagccaagttatgcgtgggatattttgtttaaaaaatatgatatcgttaaagagattgaacagcaagggtattatgatattcgaactgatcaaatgatgcgtaatcgaggagttattgcactatggcaacaaaagtatccgggaaagtctattccagataatcgaaacatcttaaagtttgacttttctgtggatttaccaaatgtcttcaaaggttaccatcttcaaattatgccaattggtggtaatatctatcgaattgctccttttaacatgtattacaaattaaagaatgagaatgtacccatcattccgatgacgagtcctattaaaatgtctagtttagatttaagcaatgttaccacagagcctaacgcccagacggtggcagaaattacaggaatgttctcctatgtttttcatgatttgaatgataataatagaacagttgttagcacgttgagcggcaaaaataatgttcaaaatgttaattttaatgtcgacaatattttgaatcatcaaccaataacgttaagtattgatacatggcaagcggagattgatggtgtgtatgagtctgagaaaacagtactaattattgaaagtaaaatgaagtttcctaaagactttaacattcgtcagttgtttattccccgactactgattgaacaaactatggaaaaactggaactacataaagaagtttatgcgggttattttgtaaaaacgagagacatttacattttaactgtgtacaagtttaccgatttacagaatatgaattcaatgaagaaatgtaaacaatataaatttagtttgtcagatgatcctcaaaatatatttaagattaaagatggttcgactattgagttgaataaagaacgaacaattaataaaatctataatctcatttataacactgagatgacaacgatttaccctagttattcaaatggagatataattagttttccccaagccaataatctacaaatttcattagattatttggatttgttggatagctctgaggattacataactatcaacggcgagaaagttgagcgaagtggggcggaagcttttatggacgcttttaagtataatagacgtcaatataattattatttgaattggttgggttatttggggttggttgatagagatgctgtatcggactctccttatgttacaaaaaatggaaaaagttttcgaatggcgggatttcatcaacaaaatgtaatgttaattaaattaatggcgtgtcacatcagttttagaaaagtactcttgaaaatgcttggaggagaaactattgatactgatcaaatgaaatatgttattcaacaggaaatgaaagacattccaactaaaagccaaatttcgagttcaacttttcctagaagaatctcaagcgttaagtctatgtgtaatcaagtactgacgcagatgggggtgtacaaaaaaaaggatggttagtaaggacatacttgagtatggattcattcacgaccgaaaaacgggtaaaccgaataccttgtaccttaaaccagttcaaacagagcttttattgtaccgtcaatggctgcttggtcatcagctggattctgaatggctctttccttcaattcaacacccagaacgccatatcacggaaaaacagttctacaaaatcatgagcaaggttggcgatctgttaggaattaattatctagggacccatacgatgcgcaaaaccggggcttatcgggtctacacgcaatcaaattacaatattggcttagtcatgaatttgctaaatcattccagtgaggcgatgactttagcttatttaggcttagatcaagccagtaccgaaagtatgttagatcaaattgattttgggtaaattagtttgattttgttgtcgccaacggcgacttctgatacaggtttttaatgggtctagcacaacatagaataaattctatgtgtaagtgcgcattgacctcatttcactcggtctgctgataactataaaattaatttctgccgttgttgaattgaatgtatttttaattcaattatccttacacttaactaattttgttatgctttaaatacttaaaaaatgttgcagattccactgttttaagccaatttttttaatcgttctgtgcaaagaatctttataagtttggtaacaaattttgaataacggtactgtaaaatctgtgaatctaaattgaaatcattattttgatgttaggagtaatcaagatggacgaaaagaaagtattaaaaaccattgatgaaatgcttgctaatccttggcaagttgatattcaagaattgtttgaagcttctttcaatgaacctgacgagatcaaaaagaatttgtatgattccctgtatacttatattttgcaaaaaagacaagaagatattattagtcgtcctggcttcgttatttagccctctaagagcctgctgagggctttttgttttgctttggtataaatgtatatgaatagtcttaaaattgctagaaacgaaaaataaggccctaaaaaacgaacatagcagctaagttcttgttaatattcaaaaaaactaactgtttgctgtcaatggtagcggacgagcgtagcgtgggagcataaggaattgacagctcttaaccagtcttaacactgaaatggcgaaagccaaagttttgtagaaaccttgctttcctgcctaacggcgagtgaaaaagcggtcaagctggttcagcttggacggggttcggggcgtcagcgcccgaataaacgtggcttgccgcaccttttaagcaacgaacagcgtgaggcgcaaagagcatagcgactggagtttaatgtgagccggttttgggctcactcctttgtatttttattttagattttgatcttgtacagtggtgcctcttttaaacctcttttataaacctcttttaaacctcttttagacccctcttgagccttactctcccaaggcttgtagaagtttatcaacgaggttttgtctgtttatcaacgaggttttgtctgtttatcaacgaggttttgtctgtttatcaacgaggttttgtctgtttatcaacgaggtttttaatggtgatcgttgataaacaatcgttgattttatataatagttatggaggtgtgattatgagcaatgaacttataaaatatgatcctgaacttaataccattccgttacgtaaattcacccctattgaaatgaatctatttttttcaattatttctcgtatgcgtgataagggagatcagacagttagattttcttttgaacaacttaaagatttgagcaactataaaccgactgcaaataatcgctttgaagatgatattcaaagaacttatgaaaagttaatgggacttcattttggaagacgtagtaaatctggattaaatagagaaatgtttgttatgtttactaaattcagaattgttggtgaagctgactctccttatatagacattgaagtatataaagatgctttgccacttcttaataatttagacacgtgggttagatatgctttagcggaatttagagatcttcgaagcagttatgctaaaaccgcttttagattgttaaaaggtttcagaacaaccggttatgcttttttatcaaaagaagatttttttgagttacttgatattcctaaaagttattggaaaaaaccgggagacgttgatagatacgttcttaaaccaatcagagaagaattgacccctctttttagaggcctaactgttcgaaagaaatatggtaaaggccgcgggaaaccagtgattgggtattcttttacttggaagcctgaaaagaaagacgctaacgacttctcacaaggtcaatttcaagatgaacgtcaaaaactatttaacattcagcataatggtgaattaacagaacaggaaaaatggcgtgccattgataaagttaaggggttaactctaggctctactgagaaacaagcattggctgataaacaggccgagcacgataaaaaaataagagatcaagcaagacaagaagcacttgctgaactccgaaaggggtttggaaatcatgcctaaaactattagagaacttgctgatcaattgaatgtctccaaacagactattcaatatcattaccaaagactaccagcaaagaatcggcaaaaagatagtcagggtacaaacatgattagccctaaagctgaaaggattatcagagacaaagtagcaaagcctttgttagcaaacaaccaacaaatagatagcaaagaaactacaaagactaacaaagacaataatgagctggttgcaactctgataaaagaagtagaggacctaaagtctcaacgagacaaacagcttgctaccaaagaccgccaaatagacagtttaacaaagttgatagatcagcaacaaaaattacagttatcaactgtaacagaaaaccgacaattaaaagaacacgtgcgaaaattgagttatttggttgaatctcctaattcaactaaaaagcaacaagcaaacgaccaacaaacaaaatgtagggtgggtgaaactgataataaagaaagaatcatacctaaaagttggtggcgtttttggaaaacaaagtgatttggtagattgtaaaattaatccgaacagcgttcggattaattttacaatctaccaaatataaaaagcatggtaaaaatattacaatcactaatttcagtaacggaccgtaccatttttactatacttttgggattcctatgaaaccaagagcaacttatatttatgattatctaattgttctatatccttgtattaaaactactagtacaagagggattgtaatccaccaatctctccgatataccaatgaaatacctaagaacagtgaaaataaaataaacacataaaacgatggttttttataaaaaaggggtttcatccgcttaaattcacctcttatcaatataattttattgtatccctaaaaaattaaaattcaagtccccgttgtgctagtttatttgttgacccttggccgccagtactttttgtactgcaacactaccttgcttaaactctttatctgtaaggctttgtcagttttctcctgtatcatttgtactgacatgcgcttctttgtatcgacttgctttggctttatatcaagcatttacaccttttttctatctcactcgcgtttttggcacctgtatctccgcgacatgcctaccacaataaaatgctctctatccagcttgatagtaggctcgccgtagtaattgacattcctcaaccttttatcgagcgatacacacgttgtcagtgagcccctagttctgtcgtgatttctgggactgataactcccttttagtcaatacaagccacctcctgtttgcagtatatgattattatagccaaaaaaagtagtccttaacgggctactccgccttatttatcgaacattttttaattgctaccaaccttttgtactcttgcaatctaccaaaacaaaacaccaatgatattttcctatgcatcagggggtataacttacaaataggcctttgatcatttctaaagccattcttcagaacgttattacgatctgaggaatggctttattggcttgtgcaagtaacatttgcgtgactaatgctagtaattcttgctaggattgtcttagatccttgattatgatttaggaggagtgagatttgagctttaaagacgatatcaagaccttgcgcaggcaatctaatttaacccaagaagcgttagctcaaaaactacatgtgacccgtcaaacggtctcaacttgggaaactggcaagaatatgccaagtttagagaccctgcatgctttgagtcaattgtttaacattattcaataatgataaatgactgtacctccgtatcatacccgattgtatccatacgatattttccaaccgtaaactccgatgctataaaattgattcccaacgtgagactaatattgtcttcaatgagattctgtaatctcttttctttggtaaaaccaattgaatcaatttcactcaagagcaattgatcggtactatcaggtttaactttataaagtttcacgttacttccaccccaattatagatatattttttaatgaacatcattatttcttcgcttcatcttctgaaatctacctgattctattatatataatctaacctgatagactagttcaaaattcaagttagtttttacgaatcgtttaaactagtaaatccacccccaaaaagctccgacaacaatacgaacttttgcaacaacaagtatagtctacacttttcgccaataaggattgcatccgccaacgcctaagattaaaatacaattagaaatcaattttattgaggaagtgctttagatggctctaacccaccactaccttcgcgcaagcaatgctgcggccgcggctcagctcatcgcgacgacactcctgacgactaatcgaaaggattatcccgccgactatctggccgccacaatcgctaagctccaaccccaagatctcgtcgataaggccacctggacccacttttacgtgttctatgaaggaaccgagctcgtgggaacgggggcgattggttcttattgggggaaagttgatgaggccagtctgttcgatattttcgtttcacccgagtatcagggtaagggaattggccgcgccatcgtgacgaccttggaacaagatgtcttttttaaaactgccaaacgagttgaaattccggcatcaattactgccttgggtttctatgaaaaactgggctaccggcctaagaatcaccaaacccaccccgataatgaacaactcttccgtttagaaaaattcaccagtgtatcaccaaaataataaacgcggctggctttcccttattttctagcctttcagcttttatctcgttaattgcaaacctatacgtcatttacttcgtgacggtaatcggtttcattggtatgcttagagcgtatcaatttcatcttttcgaggaggagttatcatcatggcaagtgttcatcaccataaattactctatagtttattcgtatccttattagccgccgggagtgttaccgccctgcccggcttagccgataccgggcaagccgccaaagtcaccacgcaaaccgacaagtatcgcgtccccaccagccaaccgggattcaaaaaagtggctaaaaagtacaaacaagccatccccatccaaatcctcggtattaatgacttacacggtggcctggaaaccacggggagcgtcactattgggacgaaaacctataatgatgtgggaaccgtagctcggttaagtggctcattggaccaggcgcaaaaccagttcaaaaagagccagcacgccaaggcggccaataccttccgggttgaagccggtgacatggtcggcgcctcaccagctaactcaacactgttagcccatgagtcgacgatgcacgcactgcgggcgatgaactttcaaattggaacgttggggaaccatgaatttgatcacggtctgggtgaatttaaccgcattttgaaaggccataaacccgcggccagtgccgattccttgattaaaaactatccacatcaggcctcaaagattaacttggtcgtggccaatgtggttaagaagtctaatcataagattccatacggttacaagccctataccattaaaacaattaaggcccatggaaagacagccaaggttggcttcatcggtattgaaaccaccgatcttccccatctgactctgttgaaaaactaccaaaactaccaagttttggatgaggccaagacgattgcgaagtacgataaaattttaaataaaaagggtgtcaaagccgttgtggtcatggctcacacgggcattgccagccaggatggcaaaactgacggtagcgccgtatccatcctgaataaagttaatcaattggataagcagaatcacgttgggctgtacgttgccggccattctcaccaatatgccaatgctacggtaggcaaaactcacgtggttcaggccgtttacaccgggaaagcttataacgatacgcaaggctatatcaatccgaaaacggggaaatttatgcacttagaatcccatgtctaccctgtcttgccagctaaagccaatcccaaggctaagagtaacgcgaaagtcactgcgattgtgaaggacgcggataagcgagtggcaccaaaggttaatacggttatcggtaaggcggccacaccggaacccatcaccggtcgcaataacaacagtaagaccatggaaaatgccgccggagaattagtggtcgatgcgcaacgttacgaagcccaaaaggccggaacagcaccagactttgcgatgactaataacggtggtgttcgtgccgatttggcggtcacgaaacaaggcgatatcacttggggcgcggccgtggccgttcaaccatttggcaatattttacaagtggtcgagatgacgggtcaacaaattaaggacgcactgaaccagcaatacgatgaaaaccaggccttttacctacaaatctcgggcttgcgttacacttatacagataatcatgatgccaaacagccgtacaaggtcgttgatatcaagaaagacgatgggaccccggtcagcatgacggccacctatcgcgtggtgatcaatgacttcttgcatggtggtggtgataatttctacgctttcaagaacacaccgatcaaggcctccattggcgctgataccgatgtctttgtccaatacttcaaggatatggcggcggccaacaccccaatcaaggccccaaccctggatcgcaagatttatcagccggctggtagcgcgatggctactcatacacagccagttgaacaggtggcattgggatagaacaggtatataaaataaaaatcaccaaccgcaagaaaacgcgcggtggtggttgctgagaaacggttgactggtcgctaaggctggttagccgttttttgtcgccttcctaaactaccacgctgagaacgcgcaatgatgaattgaaagaagcttcaaacatgcgctggaaagctcaaggaaaacggtcggtcatagtggacttgaagggctttcagagttacgtatactggatttatatgtttatataccaagcttcataatttacctaacactaaatctcaaaaggagtggcatttatgaataaactgaggacatctatcttaatagctactgcaacagtaagtctgtccctattcgccccaacacttaatcaacccgcccaagccgcaacgtggcacaaaggaatgcctaaggcactacgtgggaaatggtcacactcagtaaaaaagttcccaaagtatatgggaatcaaggggtctggtacatatcgcctgactatcgttaaaaaagcatttgtgaatagttatttcactaagaaaaataaagaactagccccagaaattttcttagccaatccccaatataaaaaaatcagtaaaaccacgtatcgtctgcaaggtggacatggtaatagtgggatgagtagtggttatggtcaccacgatccccttcaaatagctaagcagggaaataagattaagtataagtactcatggtcatcacacgttaaatattctacttggttctataaaatgtaaaactctgacaacatgccgatttacgatttgaaattaaaatatttcaagaataaattctatcaagataaacaaaagcattggtatttaactgtccacgttttagatgaaagtggtagtattcgttaccgaaaactaccaatgacttacaaaaaatcaattgtgttttaaacaaaccatatagtgttcttctgctccccaatcaagctctaattttaaagtttttcggttattggcatagaaagcagctccctttttcttggtcgatctaagaataacagaggtgctttccttgttatacataaggtaacgaaaaaactagtcttagaaattattttatgatttctaggactagtttttaattgaaaaacattgaaagaataacccctaatatctataatgtagatattaggggttgtttattttcatattataaaaataacttcttctatttgtcattttttcgataccttttagcacgattttgaccaggaaataaacgatcatgcgatccgactcgaatgccaattaagactagttcatctttatcaatcgtataaaccaccaggacatcgttagtttcgcttggtgttttgtttttcggggtatctcgtaagtgaaattcattataaccgctcattcgccgattaagctcatgatcttcaaattctggtggtaattgttgttgctcaagtaacaggtcaatggctgctcgaacttcatcaataatagatttgtctaaactggctaaccgttttagatcagcattaaaggttgcacgtggtttaaatcttagttttttcattatttaaactgactccaataatcatcatctgattcaacaatttcatcgtcaggtaaaacatggcgtttaattaactgatcacgtgcaattgcatattctaacgaaccttctttcgcttttaatgctctttctagccagtccattttttcttgtgaaacgatggctactgcgcgactatttgaacgagcaatataaacggtttcgtcttcgtcattaacttgatctaaatatttttttaggttggcgcgaaaatcgctctgtgttaatgctaatgtcatatttaccaccctttcattgtacttaatattgtactttaatttgtactaaaaatcaattttttaaggagctaaaactatgcaacaaattgtcttacccatcaaagattcaaatgtgctcaaagaagtgcaagatacgttactccataatttcaaagctggttggcgtaactataccgtttttcaagtgggtaaagcgactctgttgcgagtgagcgacgttatgaagcttcgttggacagatgtctttaacgaaaacggcaccgtgcgtcagaatgcgtttatacacgaccaaaagaccggtaaagctaacctgctctacttaaaacccgtgcaaactgatttattagcctatcaagcttggttgcaagaaaaccatttggtttctgactggttgtttccctcgattcagcacccagaacgacatatcacggaaaaacagttctacaaaatcatgagcaaggttggcgatctgttaggaattaattatctagggacccatacgatgcgtaaaaccggggcttatcgcgtttacacgcaatcaaattataatattggcttagtcatgaatttgctaaatcattccagtgaagcaatgactttagcttatttaggcttagaccaggctagtactgaaacgatgctggataaaattgattttggttaggaggctggctttatggatttagattttaaatcaaacaagtatgatcttttcgatgattggcatcaaaacaagactaaacaagagtttacacaaaagttgcagcaacaagctcaacttgaaaaaacacagctgccacagttattgtcgcgtgaagatttaaaaattcgctggcagatgaactctcgtcaaagtgttcatcaagttgctagtaagcctgattttccgcaacccgtttttgcttttaatcatggtaagacgccactttacttagcaactgaaattcaaattttcgaaattaatcacccttgggtaataactcccggtgctcgtcttgcttatagtcattggatccttcgtaatgtgattgattaatcttgagatttagctctatgtttttgagggtttattctaggctttttatagttggcgctagccttctaatacaaataatacccatttcgatgggtattaaatctacccttgacacttgtcaagggtgtaagtgcgcattgacctcgttttactcggtctgctgataaccatgaaatcagtttttgccgttgttgaattgactgtatttttaattcaatttatgtttgcacttaactaagatttttatattttaaatacttaaaaactgttgcagatcccactgttttaagccaaatttttttaatcgttctgtgcaaagaatctttataagtttggtaacaaattttgaataacgatactgtaaaatctgtaaatctaaactgaaagcattattttgatgttaggagtcattaagatggacgaaaagaaagtattaaaaaccattgatgaaatgcttgctgatccttggcaagttgatattcaagaattgtttgaagcttctgtcaatgaacctgacgagattaaaaagaatttgtatgattccttatacacttatattttgtaaaaaagacaagaagatattattaatcgtcctggcttcgttatttagccctctaagagcctgctgaggctttttatttttgctttggcataaatatatataaacagtctcaaaatcgctagaaacgaaaaataagccctttagaagcaagcatagcagttgaattcttgttgagattcagaaaaactaactgtttgctgtcaatggtagcggacgagcgtagcgtgggagcataaggaattgacagctctaaaccagtcttaacactgaaatggcgaaagccaaagttttatagaaactttgctttcctgcctaacggcgagtgaaaaagcggtcaagctggttcagcttggacggggtacggggcgtcagcgcccgtattgaatgtggcttgccacaccttttaggcaacgaacggagtgaggcgcaaggagcgtagcgactgaagtttaatgtgagccggtttttggctcactcctttgttttttttgttgctaagttttgacttcgtacagtggtacctcttttaaacctcttttataaacctcttttaaacctcttttagacccctcttgagccttactctcccaaggatcacagaaggttatcaagtaccttttgtctgtttatcaagtaccttttgtctgtttatcaagtaccttttgtctgtttatcaagtaccttttgtctgtttatcaagtacctttataagttctgtacttgataaaaaggtacttttattttaatatgtgtttgaggtgataatcatgtctaatgagttagttaagtatgatcctgagttgaatactattcccttgagaaaatttaccccaattgagatgaatttatttttttcaattgtttcccgcatgcgggatcaagggaataaaactgttcgtttctcttttgaccagttaaaagagcttagtaactataaaccaaccgcaaataaacgttttattgatgatattgaaaatacataccaaaagatcctcagccttaggtttggccgtagaagtaagagtggcttaaatcgtgaattttttgttatgtttactgaatttgaaattaaaggtgaagctgaagaaccttatgttgatattcagatttatcccaaagcattgcacttgctaaacgatttagaaagttgggttcgttatgccctaacagaatttagaaatttaaaaagcagttacgctaaaacaatgtttcgtctaattaagcaatttcgaactactggctattcttatttctctaaagaagatttttttgaattgcttgatatacctaaaagttattggaatagtccttcaaatgttgacaaaaaggttattaagccaattagagaagaattaaccccgctttttagagggctaacgattagaaaaaaatatggtaaaggcagaggaaaaccagttatcggttattcttttacttggaaacctgaaagaaaggacgcaaatgatttttctcaaggcaaatttcaagatgagcgtcaaaaactctttaacattcagcacaatgatgaattatcagataaagaaaagtggcgtgcaattgacaaagttaaatgcttgcctttaggaacaactgaaaaacaggtactggctgaaaaacaagctgaacatgatcaaaaaatcagagatcaagcaagacggatacaggtttttaatgggtctagcacaacatagaataaattctatgtgtaagtgcgcattgaccttgttttactcggtcttcttatagctatgaaatcaggttttccgttattgaattaaatacatttttaattcaatatatgcgtccaaatcaactaaatttgctatgctttaaatacttaaaaactattacatattacgatgttttaagccaaaattttttaattgctttgtgcagagaatctttataagaatagttgccgtgtgttcatggtcataacggcaaaaataccctgatcacgtgctgcctgtgcaattctagccatgccgttaccatgccaaacaaaaagggccgcccctaatcgaacggggtgcctctggcgtgtctgtttagttgtgtcaactataccaatttctacttaatataatgcgtataccaataactaattacctacctcttactccaagtgaaaaattctcattacctgacttaacacaaccggaacgacgtagccaatgacacacaagataataccggtcttttgaataacggttaagtctttaaaatcatgccagaatcccacaattagacaaataaccccaattaaaattaagaatggaattaaaactgcaatattaacccaattaatcatgtgatcacctcatctattagctataccgattcttactttacataatcgcgattatgacaagaagcccgctaaccgttgagttagcaggcttcttattttttgggcttgtgaagttaactttcgaaaaatgcgcctgccgttaaatcaacatttaggccctcgaaaagttagtgaaatttacgtcaattcttcctagaccatctaatttttaacactacctatgctctaatgaccagttctaaacaaattaaccagattccaaagtaccaacacggctaaaatactcgagaaaacaccaacttctcaaaaggcttattaaggctcatattccttcctccatatcctaaaccaacataaaaatataaaacgactcaatcaagactggtagctgtcatttttagcactctatcaggactgaatacaacaatagccataactgatacaatccgcattaaaccgccaaaaatcgctcccacgatggtaccagtcagataataagcagactcaccggtcgccataaaagaagcctgtaatgccaaataaccagtaccaattaaaataatcacaaacaataataaatgatcaaacgagacaaaccattcccttaactgatggtcagttaaaggaaaatgtgttagacagatagctacactaatcacataaaatatgactaaccacccattacgtgggtaaaaacgtgtcatactcgatatataggacaaaacagtaagcaccatcataaaaccataactaaccttaaatatcctaagatttttcttactcaatttttcaagttcactcaatctatctgtcattacttggtcctccctcagcaaagtatctaaagatattgaaaaaacatcactaattttaaccaatgtcttaatatctggatagtttcgtccattttcccaactggaaaccgttttacgcgaaactaataaagatttggccatagcctcctgagtcatttttccctgcaatctcaaagttttaattttctcttgaaatttcatattgcctcccaaaatcaactatgaatagttcttattaaaaaacaagctagtatttctagacagccttatatacgtactaaaactaagcacaaagatacttaaacccaaccaaaggttgagccagactggctctctcatgagtctttccccgaaaatgggaaaaacggcttctttggagccctaaacaactaagttcaaccccggatttactccgtggctcaatttagccgtttaacaaccgtttaagcgcacatagcccttgcccctataatctaccgtcttttagcctggtcgttgccagtcgcgcttttatttaacctgagagcgtgtttcaactcactttgaccatagggcggtcgtttccattttctatgtttcctaccacgtctttagtcgcgttgatctcgactgggtttagcatacccctggctttaactacaaacggggtaacgaaccacgctaacgaatgatttgagtgaccaacatcaggggattacccacgcgtcttttaactgggagtcgtttccagtcattccacgtccacaaaaaaagaacacgttagccaacctgctaaggttaactaacgtgttcttatcaaatggttttatttaaccagagttcatgataaaatacgttattgagatagggactggttcttcagtcctatcagaaaaccttagtagtctgtagctactaagtcatctaagccttgggacgccaatcccgaaggctttattttttttgcgctcatattcaacttggtttcatgatagcgtattcgaaagcacaatacaacgtaaaatccatcaattttcaaatctaaccgtaatcatataagccatgacaatggctatcaagatgccaaatatatccagcaaaatatgccaaggctcgtctgtccacgacaaattcaagaagtaaccaatcacattcaacataaaccacaagttaatgacaaattgaataccaaaaactagcttttgtttcatcattaaactccttactgcttaaatagacgtgaccagaagccacgttcagtcttatccgttgattcatctacgttatcgttactactaggctgtccagtaccctctggctcaccattttgtttttgaatatcatccgacttattctctaactgtttgatcttattctcggccataaactgtaattgttgagattgatctagcagcttttgcatattttctaattgaaaatccttttgcttaacttgaagcttcaggttatcaatctgtgacaacagagcattctcatatttatttgaatccgagttactgtcagaggtacaattttggttgtcaccagttgcttctatgttgtcacttatccccataaagtcccttatataggcctctacccggttgtctatctggtagctatgttgcacttttttaggtttctttgttgcaggaagtttagatatcactttctgaacatactgtcgactaacattcaattcatcagctaactcttttactgttttcgtcatagcacaccacttttaaataccttttttatatttcattataaatgaaatatcgactaaatcgatgtgaaaccaagtttatgagagtctttgacaaaatattaaaaatcctttgtaattctagcaaactacttgtttctctatgagcggattattcaccggttttataatatgttgttgccgcccttgtctcataccagtgtatcattaacgtaaatatttcgttccttcctaaggaataaagagtagaaatatacttcgttagttgaaaggggataattagaattgaaagattctcgttcgttagtgctttattatgatatctggtgttttgcagccattggccttttggtgatatttaccggatggtcttttccacaacaagtttttaataccattgtagttatggtagttacattcctttggatgaggagaggattgtctcaagtacgccagaatagtctatattatcgattatcgtggtatttgagattaatagtcttgggattctctgctgccttgttgatttttgccgtactaaagcaaatcacaaatcagggtctataattaagaaaacattgaaagaataacccccaaaatctataatatagattttgggggttatttgttttaatattaaagaaataacttcttctatttgtcatcaatactaaacaataatttgtacaaagtgattatttcttctagttcttcacgcgatacatgatcgacaatagtttcatcagtgacatgtcttgcccgtaagtctaaggctatggtttgatctaataatacttttccatatactgtttggctactagttagtcgatgatacattggaaaattacgcttggtactgctaattggagccacaatcgtcatgttacttgtctgacagactaaatcattgcttagagcaatggctggtcgcttattcatctgttcatgaccacggcttggattaaagttaacataaaatatatcaccttggcttaccattgaagttcattaccttctgactttccccaatcaagctcgtgatcccttttcccgtcatcttgccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgctaagcgtgtttgttctttaataagttccatattttcccctcctaaattattattacaagttaagtatatcccgtgtagatacacaatgcaaatattcttactggaggtcatttacatgcaacaagttgtcttacccatcaaagattcaaacgttcttaaagaggttcaagatacgttactcaataactttaaagctggccgacgtaactatacgatttttcaagttggtaaagctacgctactacgagtgagtgacgttatgggtttaaaacagaccgatatttttaatccagacggttctattaaacaaaatgcgttcattcatgatcgaaaaaccggtaagcctaataccttgtaccttaaaccagttcaaacagaactcttattgtaccgtcaatggctgcttaatcatcagctggattctgaatggctctttccttcccttcaacaccccgagcgccatatcacggaaaaacagttttacaaaatcatgagcaaggttggtgatctgttaggcattaattatctaggtacccatacgatgcgcaaaaccggggcttatcgcgtctacacgcaatcaaattacaatattggcctagtcatgcacttactaaatcactccagtgaatcaatgactttagcttatttaggattggatcaagcaagtacagaaaacatgttgaaccaaattgattttgggtaaattggtttgattttgttgtcgccaacggcgacttctggtacaggtttttaatgggtctagcacaacatagaataaattctatgtgtaagtgcgcattgaccttgtttcactcggtctgctgataaccaaaaaatcaatttttgctgttgttgaattgaatgtattcttaattcaatttatgcttacacttaactgagtttgttatgctttaaatgctaaaaattgttgcatatcccgctgctttcaaccaaatttttttaattgctttatgcagagaatcttcataaacctggaaacaaaatttgaataactaactttaagaactgcgtatctaaattgaaatcattattttaatgttaggagtcattaagctggacgaaaagaaagtattaaaaccaattgatgaaatgcttgctgatccttagcaagttgatattcaagaattgtttgaagcttctttcaatgaacctgacgagatcaaaaagaatttgtatgattctctgtatacttatgttttgcaaaaaagacaagaagatattattaatcgtcctggcttcgttatttagccctctaaaagcctgctgagggctttttatttttgctttggtataaatatatatgaacagtctcaaaatcgctagaaacgagaaataaggcctttagaaacaaacagagcagttagattcttgttaagattcaaaaaaactaactgtttgctgtcaatggtagcggacgagcgtagcgtgggagcataaggaattgacagctctaaaccagtcttaacactgaaatggcgaaagccaaagtttatagaaactttgctttcctgcctaacggcgagtgaaaaagcggtcaagctggttcagcttggacggggtacggggcgtcagcgcccgtattgaatgtggcttgccacaccttttaggcaacgaacgtagtgaggcgcaaggagcgtagcgactgaagtttaatgtgagccggtttttggctcactcctttgtgttttttgttgctaagttttgacttcgtacagtggtacctcttttaaacctcttttataaacctcttttaaacctcttttagactcctcttgaggcttactctcccaaggcttatagaagtttatcaagtaggttttgtctgtttatcaagtaggttttgtctgtttatcaagtaggttttgtctgtttatcaagtaggttttgtctgtttatcaagtagaactataaagttgactacttgataaacataatctaaaattaatttgtaatcattaggaggtacagcatgggaaatgaaattattaaatatgatccagagttaaataccattccacttcgaaaatttactccagttgaaatgaatttatttttttcgattatttctcgtatgcgtgataagagtgatcagaccattcgttttacttttgatcaattaaaagagctaagtgcttataaacctactgcaaataaccgttttgaagatgacattcagagaacttatgaaaaaatgatgggattacattttggtagacgaagtaaaagtggattaactcgagagttttttgttttgtttacagaatttaaaattgatggagatgcagaagaaccttatgtagacgtaaaagtttatgaacgtgctttaccccttttaaacaagcttgaaagttgggttcgttatgcgttggcagagtttagagatttaaaaagtagttacgcaaaaacaatgtttcggttactaaaacagttcagaaccactggatatgcttatttttctaaagaagacttttttgaattactagatatgcccaaaagttactggaatagtccctctaacgttgataaatttgttataaaacccattaaagaagaattaactcctttgtttagaggattaacggttagaaaaaaatatggtaaagggcgtgggaaaccagttattggctattcgtttacctggaaacctgaaaagaaagacgctaatgacttctcacaaggtcaatttcaagatgaacgtcaaaaactctttaatattcagcataatggtgaattaacagaacaagaaaaatggcgcgccatcgacaaggttaaggggttaactctaggctctactgagaaacaatcattggctgataaacaggccgagcatgataaaaaaataagagatcaagcaagacatcgcgtggcaacgtcctatcctcgcagggggcgatcccccaactactatcggcgtgctgaagcttaacttctgtgttcggcatgggaacaggtgtatccttcaggctatcgccaccacactataagagaacttcttccctcaaaactagatattattcaattattctcgaaacaactacgttgttgacttggttaagtcctcgaccgattagtactggtccgctccacgcctcgcggcgctgctacttccagcctatctacctgatcatctctcaggggtcttacttccatataggaatgggaaatctcatcttgaggcgagtttcacacttagatgctttcagcgtttatctcatccatacatagctacccagcgatgcgcctggcggcacaactggtacaccagcggtatgtccatcccggtcctctcgtactaaggacagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctctcttctgcctttacactcgacgaatgatttccaaccattctgagagaacctttgggcgcctccgttactttttaggaggcgaccgccccagtcaaactgcctacctgacactgtctcccaccacgataagtggtgcgggttagagtgttcacacagcgagggtcgtatcccaccagcgcctcactcgaaactagcgttccgagttctacggctccgacctatcctgtacaagctgtgtcaacacccaatatcaagctacagtaaagctccatggggtctttccgtcctgtcgcgggtaacctgcatcttcacaggtaatataatttcaccgagtctctcgttgagacagtgcccagatcgttacgcctttcgtgcgggtcggaacttacccgacaaggaatttcgctaccttaggaccgttatagttacggccgccgtttactggggcttcatttctgggcttcgccgaagctaactcatccacttaaccttccagcaccgggcaggcgtcagcccctatacgtcatctttcgattttgcagaaacctgtgtttttgataaacagtcgcctgggccttttcactgcggctgcacttgcgtgcagcaccccttctcccgaagttacggggtcattttgccgagttccttaacgagagttcactcgctcaccttaggatactctcctcgactacctgtgtcggtttgcggtacgggtaattaatcactaactagaagcttttctcggcagtgtgacatctggcgcttccctactaaaattcggtcctcgtcacgccttgtccttagcgataagcatttgactcatcaccagacttgacgcttgaacacacatttccaatcgtgtgcacaccatagcctcctgcgtccctccatcgttcaaacatgattaactagtacaggaatatcaacctgttatccatcgcctacgccttgcggcctcggcttaggtcccgactaaccctgggaggacgagccttccccaggaaaccttagtcattcggtggatcagattctcactgatctttcgctactcataccggcattctcacttctaagcgctccacaagtccttgcgatcttgcttcgttgcccttagaacgctctcctatcactcgaccttacggtcgaatccacaatttcggtaacatgcttagccccggtaaattttcggcgcagaatcactcggctagtgagctattacgcactctttaaatggtggctgcttctgagccaacatcctagctgtctatgcaactccacatccttttccactcagcatgtatttagggaccttaattggtggtctgggctgttcccctttcgacggtggatcttatcactcatcgtctgactcccggatataaatctgtggcattcggagtttatctgaattcagtaacccatgacgggcccctagtccaaacagtggctctacctccacgattcttaactccgaggctaaccctaaagctatttcggagagaaccagctatctccaagttcgtttggaatttcaccgctacccacacctcatcccagcatttttcaacatacacgggttcggtcctccagtgcgttttaccgcaccttcaacctggacatgggtaggtcacctggtttcgggtctacatcaatttactgaaacgcccgtttcagactcgctttcgctacggctccggtctttccaccttaaccttgcaaattaacgtaactcgccggttcattctacaaaaggcacgctatcacccattaacgggctctaactaattgtaggcacatggtttcaggaactatttcactccgcttccgcggtgcttttcacctttccctcacggtactggttcactatcggtcactagggagtatttagccttgggagatggtcctcccggattccgaccacgtttcacgtgtgtggccgtactcaggatcctgaactgagggttgacgatttcacctacgggggtatcaccctctatgccgagccttcccagactcttcggttatcatcaactttggtaactcaaatgttcagtcctacaaccccagaaagcaagcttcctggtttgggctgttccccgttcgctcgccgctacttagggaatcgatttttctttctcttcctgtgggtacttagatgtttcagttccccacgtctgcctcaacttgactatgtattcatcaagttgtaatcatcggtaaagatgattgggtttccccattcggaaatctccggatcaaagcttacgtacagctccccgaagcatatcggtgttagtcccgtccttcatcggctcctagtaccaaggcatccaccatgcgcccttcataacttaacctaacggtcacttcgtgatcgtcaaattaattgagtattagcgataaactaattaaaaaactcaaaaatacgcagttgtttctcggtttaattatcttaataattaaaggaaaataattgataatatctagttttcaaagaacaaggtagattgtaaaattaatccgaacgctgttcggacaaaaaagatcagcttcccttaaatggtgtttaccacaaactcactttttaggagttgctctcttgtctagtataacctattgggtactcaatattgatcttgttccttatgttagtggttcttggtgtggtttatgcttacgtatgatgtaaatgaatattagattatttttcgattgataaaattacgattgtttagggagtatgtatgaatattattgaattggttttgggagccttaattgagttaatttctttttccgtaccagatttattatttgggttacctagaatgcggctgaagaaaaaaataacgaagaaagccaattcccttagcttttcagctataaaattaaatgaattagcaagaaagcctgaatatacgattacagatggcaggtcaggtggtttcgatttttcagggtgttcctatcatgaactaaagctattatggcgtactattcaatagtttaagatactggtaattgtgtttaacaaatttgctgatgtcttttgtgttggtgataaaatgatccagtgatgttctgctagagtgtaccaaaagtagtcacttcttatattggttggaattagctactgccattgtaagtagattgctttgggatttttaatttctgttcggatcaattatagaattttcccaacctttccattttacttaacctatgctatgctactgtctacagtttttactaagtacatctatctaggggagcattaagaatgttagttataagtcatttatccagtacgttcgtggttgggtatccaatcaccttgtcgattatttggatcacaggctgtgttttttcagcactttttcgtcatcaacaagtacgaccattgataacatgtagtacttcaccatttgtctcaattttagttcctgcacataatgagtcggccactttggccgaagccgttcaatctctgatcaacttggattatccacgatatgaattgattttaattgatgactgtagccaagatgacacactcactataatgaacaacttacaggcaacttattcacaaatcgcaatcactattgtgacattacccgttaatcgaggaaaggccaatgccttgaacgagggttttaaggttgccaaaggtactgacattgtagttattgacgccgatagcctattagcgcctgacgccgttactcaacttattaccacgctaatccagcacccagactgcggcgctgtaactggtaaacccgttgtccgtaatcgttccacactaatcggacgcttacaattgttggaatatattggcgtgatcgatttgataaaaaaggcacagtcttatctgactggtagtattacaacagtatcgggggtcattgtggcctttcgtcgtgatgccctaaaagctgttggcggttggaatcctgctgtcatgacggaagatatcgacattacgtggcggctctatcgtcacaattggcaggtcgcttacgaacctcgagccatctgttggattcttgttcctgaacgcttacgggggctcatcaaacaacgccagcgttggtcccgtggtggccttgaagtactggccaccaattggcgtggcttttatcagaatcctttgggacaacgctttctattattggaaacaattgttagcaacctttgggcactactgacggctattagtattctcagctatacgattaacttgatttttctccacgatctggccttaaatggcaatttgttatttatcttattggtactcagtaccttacagttcacaattggctttgtcgcttcccaagtcactgcaaaattagcaggaacagagctgctgttggtacctatctacgtggtgtactactggatggtcaatttactcagctgtctagcagccatggaatcgtacgttgttgatccacaacgtcggggaacttggcgtagtccagataggggcgtttaacatgaaaaaaacaggattttatccaattattcaccaccaaacaaatcacatcagtcgactcattcggcgactcattttagtggcactttgggtctttgtttctctcatcatttttgccaatattggttttcatttgagatggtacagtgataatcttgtcagcttgtaccttttattaaacctccgaccacatgctgacacacaactctttgggttgatggggagcctattaatagcggttttgggttatggcctttaccgatggcaccagctcacacacactatgggggtgactaaatgaccccacattcacgccagtcattgttagttgtaatgatgctagtactcgtctgtagtcttggctgggcctctaaacggcaagcagtgatacagcaacggtcatccgagagttatgcgctacccaaacaatatcgtcagatccataatggtattatggttttttgctatcatcgagtacttagaaactcttggtcaacacaggttatacgtcatttatctaacaactcacaactacaccaatttaacgtgccaactgatcaatttgcttaccaaatgacttatctgcatgaccatcacatcgccgtcatcagcgcgtctaccatgaccaaaatgattgctcatcatcaacctattcatggtaagtacgtagttctctcctttgatgatattgaccgtaccgttgttgacaatgctattcccgtcatgattaaatatcgtcttccttttaccacctttatcattaccggaaacacaggtgattatcgagagggctcgcagatggcaacctggcctgagatcaatagggccaagcgacaggctggaaatttgatgacattgggcctacatacgcacgatatgcattatttaaatgcgcaaggtcatccggtcttcactgaaccccatatgatgccacgatttagacgggactttgcaaaatctcgccatgaactgatccaacatactggcgtacatgctacatcctttgcctatccatatggcgccagcaccacccaaactaataaatatctagctcaccaaaaattaggttgggttgcaacactagatgctggggtagttactagccagactagcttgaacgaaacacctcgattaatcatcaatcaagaaagctggccttctgtccgtaattggcttacccactgactattcaatcgaaaacgaaaacggtactagtggtagattgtgtaaatacgttggagttcggactttttcataacttccatgctctggtcgttaagttccttaccagtcccttggaggtgtgtttccttcaagtttttggtggctgaccgataattctgcgctaaactcgttaaatcatcaaaggttaaatcagtttgtgtctgcttagccaaagaactgatgaagctctgattaagtaatgttgatattgaaccactcttcttaactaacgccatcagaacagcccgttgccgcttctgtcggccatagtcattgtctggatcatcataccgcatccgagaataagccaatgcttttttcccattcatgtgggtcttaataccttttttaaatgtataacctgcataagtaaaacttaacgttggcgtaacatcaacaccaccgacctgatcaataactttttccaggccacccatgttaattaacgcataaaagtcgataggaatgtttagcattttttgaatcgtatcgatagtagtctttgcttgtccccaagcataagctgcgttaattttcgaaggggactgactagcaaaaccaggaatcgttaccgccgtgtcccgcggaacactcgtaattgtggttttattagtggtcggatttaaggtcacaaccatcatactatcggttcgacccttgtaactccgacctaatgcacctgtatcagttcccaataagagaattgagataggcttcttatcagataattgcttatttacatctcgttctttagttacaccagaagcattaaacgaactgttgacagcatttttaatacttctatagcgtgtcataccatacgccgcaccaccggcgatcaataagagaataagtaccaatatggtgttacgaactggatgcgtcttttttctatgttgcatactaccaaccaccccttcggtctccccaaaataactctaattatactacaattacttcaaatttattttgaaactccgcaaagccttctgccaagttggaatctcaaatccagtcgccttaaccttatccaaactcatcacagaatgcttcggtcgataagctttttgtggaaaagctgtagaatcaactggctcaacttgaacttaagtatcctttaaaatctcacaagcaaaatcataccaagaacaactgtcatcattggacaattgatataacccatacgccaatttctcttcaaccgcgtaactcataaattcagccaaagtctttgtccaagttggtcgaccaatctggtcacgcgcgttttataatcaagttagccaaatacttttagctaattgataaaataaaaaacaccaagacaaatctctgttatcattgatgttcctacacaaacaatgaaagaggttattgtcttgattcaagaacagaataccacagtcagaaaaaaaggtcagcacctaacttcgtttgaacgaggcagaattgctacgctgcacagccaaggctattccaatcgtgcaattgccagagcgcttaatgtttgtcatcaaacaatcaataatgaattgtgccgcggcgagatcgaccaagtaaaaaaagtgaatggtcaacgccaatattatgctgtatactcaccagaaacagcacaagctaagtacgaagctaatcgagcccactgtcatcgacctttgaaactcgtcggtgtcgctgattttatcgactattttacgactcatttgcgtcaagatggttggtcgcctgatgcagcagtaggacgggccaaacctgaaggcttatatcaacctgaggagatggtctcgaccaagacgctataccactatattgatgcccagttacttgaagtccgcaatcttgatctactcgaaaaaacgcgccaccgtgccaaacatcatcactcgatcaagcacaagcgtctggccggacggagccggacggagtattgatgaacggcctaaaagtatcgaccagcgccaagagttcggccatttcgaattggacaccgtggtgggcaagcgcaacggtcaagagagtgtgatcttaacgctgatcgagcgtcaatcccgctgccaaattctacgtttgatcgatggtcgtgatgccgattcagtcaactatgagctggccaagatctgtcaagaatacggatcaatcatgaagtcagttactgccgataatggcgctgagttctcggaagttggcgctgtacttaccggtgtcgctgacctttattatgcccatccatatcgttcctctgagcgtgggactaacgaagcgcataatcgaatgatccgccgcgatgtacccaagggtctatccatggatattttgggtcctcatgatatccaagcagttgagtcaaagctaaacaatttaccgcgccggcaaactggctatcaaacacccaaagagcttttctccgctgcttccgccggttaagttaagtccataaaatatgaatattaatgaaaatactgatttaataggatttatcgtgtggctaatttgttcttgcaatttgggccttccttaatatgccccattaggtctgaaaaaaacactaatagttttaattaaaacacccaaatcaaataatacgcttcgatgcaagatatatttcagatcaagtccaaccatttcatcaaaaccaacttcattgcgaaccgtaacttgccataaaccggtacatccgggtttcacaaataatctttgcttatcataatctgtataatttacgacttcacctggtaaaggtgggcgaggaccaaccaagctcatttgtcccagtagaacattcaaaagctgaggtaattcgtcaatactatgttttcgaataaatctaccaacttttgtcacccgtggatccatcctaattttaaagatcgccccatcaacttcatttttatcaatcagatattttttcaagctatctgcattaacgaccattgatctgaatttgtacattttaaaggggcgctgttgtcgtcctaaacgaatctgcgaataaaatactggcccctttggctcttctaatttaattgcaatagcaacaatactgtttccagggaacaattctgcgctcaaaacgtcactccctctaaactgaatggaaaaccataacccgtcaagtcaaaaccaacattagaatcaagaaagttgatgatttaaaatgcttgatttaagagattgtgagattgcttttaccggacgtctaactaccatgactcgggatcaagcttttagtttggcgaaagtctttggggcgaaaccacaaaattgggttacgaaacagacagattatttagtggttgggttaattgagacggctttaggtgaggagcccatcacaaaaaagttattgacgggaacaccaacgatttcagaacgggattttttggactggtgtcaggcacgattggcgcaatggtctaggagtttaggcggttaaattcacaaagtgagttactgattttttggggatttttcatctagaccactcctctaccgtcaaatttcacaaaggccaaataacggatcgttgttttatcagggtgaatggtggttacttgggataagccccattatgtaaagtaaaaattggtatatagaaaaaagaccatccaaagaagagctgagggtaccttcttagacggtctttttaacactgtatcagaattacagaaacttctcaatgatatagataagaagggtaacctaagaacgccactggaacacttaattgtaactaataaaatcagttgtttttgatggatacattagggtaggcctaagttaaacaaaatgagctggaagggaaaatatatgtttttttcaatatttttaggattagttttgttatcagttgggataatcttaattgcatttctatcctcattgatttcatgttaatttaaagctatgagatacgttctaagacgttttagaacaacttgaatataaatatacgtgagtaagatagaatggcttaaaagagcttataattgattacagaaagaaatgataacatgtggttaaaaatttttggcattattccaatgataatgtttatagttgcgttgttcttaattgggatcgttgggttagcaatcatgatttggcttatcgttgagtaagacgtaccagcttaatgatatgaaccgagtgacaaaactagattaaaatttaaggcatttcatttacacaagattcttgacgctaccctttagttaagtacgcagctttgctacaccataagaataagacatattttcaagtaatatgatggctactgtcacttgtttttaacaacgctattagcaagtatcggatgttagctaagcagaacttatttcccaatgtcgattggaactaatatcaaagttaagcaagtccaagtcgtatcgttcggaacagcggaaactttcggtaccaaaattattcactgctgtagagtagaggaggaatgcaatatggatataccgacactagcaaaatatttagctaaacgcaaactgacattgaccagcgccgagagcttaactagcgggacctttcaaagccaattagccgccacaccacaggctagtcaaatttatccaggcggtttcatcacctacgccaccacggctaaaaccaagctactcggcgtgccggccgctttgatcgcaaaatatggcgtcgtcagtcctgaagttgctaaaagcatggcccaacaagcgcgcaaaattgccggtactgattttgcgttagcatttaccggcgtggctggtcctgataaattggagggcgtaatggtgggggctgtttgtatcggcttagctaatccggaaacgacgttagccaaaacgtattattttcctggtgaacctgagtcagtaatgacgcagagctgccaagcagggattgatttattggtgcaatacttgcagaaatattaaaacgatattgccagcgaaattcatcacgagtaccgaacacctgaatgtttgtgtctgtaattcccagtaatttaagtgtattatctagttgagacatctattcctaccccgcttattttgagtttcgtcgcttaaagcatagcactagggaggcttagatgcccttttttgttatcaaaaagggcctagtacttttggaatggaaatactttccaacaccaaaaattctagacccaaaacaatcctgaaaataaaaacgattggcctagttattaggttgatcgttttttaatttatccggtttatgggcgttgacatagtcagcaaatgtttttaaaagttcttcggtttgttcgaccgagaggttattagcttgaaagtacttttctaataaagcccctttttgaattaatcggcgagaacgggctttgcgtgcttgtcgattttcataatacttagattggcgtaacttaaaatcttcccgctcaattttttgttttaaacgcgcttgttgttcaattagtttttcatattgattaggcatggaactccccatctcctatgactaatgatctacggacttttcctttaaaaactcggatacttttttggataaggacttgatattgtcattagataaattagcataatctaaattggcttgactgatgatttgtttacctagccgttgttcaatcgttgttcaatcttatttttttcggccttaattttttgattaagggattttaatttagcttcttgtttctctaagttactttgctgcataactatccctccaatcatcttaaaataatcaccgacactatatcataagggaaacgttaagtcaaaggataaaagttgaaatagcgaagcggaaggcatacactaaaagtaaattcaggagaatcagcagaccgagtgaaatgaggttaatgcgcacttacacatagaataaattctatgttgtgttaaccccattaaaacctgtattagaagtcgccgttggcgacaacaaagtcaaactcatagaatcaaaggaagacggtgaccaacatggcaatatttcatattagttttagtttgtaattcctagtatagcacagaaataaaaacggccaatagggtataccctattggcctttttgagcttttaaaatagaataagtcctgctttttctaatatcagatttaatcatccatatgtttttgtaaattttgcgttagacatattaagtctggtacatttagctcaacagtattagtgccttctctacgatagtacttaccattgtagggttcaggtttcccagtattatctattttaatggataatactgttgcaccgttataggtataactttttatgtcttttaacattgtcatcatctcttcactaacaggctcttgagatagtgctgagaaataatgttgataatactcatcgatactttttccacttaatgttaaatctcttttaatcccaacaatggaaataggtcctatcttaaatggttctattccaaggtcagatgcgttataagaatcagaatcggcaacaccaatcatgatgtaagaactcttatgactcggagtattggcaaaagaagttgcttttttttgctatattggatactagtttcgtgttgaaagttttcttttgcgtctgtggattgaacgaatacaaaccaagtttaaattcaaaccgttctgtttcgccagaactgtcttcaagtatttgtttaagtatctgttcatcgctatatttttttaattcgtccttgctaaaaatgaaccctggatcaagtaatccctcaacaagagtaatattggtttccctatcggaaacttttatagaatgagatccctttgctaatttagattcaagtccagtgctcttatgctagatttacggacagattttcttctgccctgtaaactaatagcataggagcattttttaatatgattcgatacaaaaaagaatttaagcagttgttgcaggcggcaatcaaggtcggaacggtgaataagcagttgcagcgtgagacgatggtggggcggttgattgcgggcaatttgcctagttacgcccctagccatcaaacattgaatcccaagtcaccgttgatgggtcggcggattgcatttctgggatcgtcaattacggccggtgcgggtgcactggaagattcgttcgtcgattatctcgtcgcgacggatggcgtgattgccatcaaggaagcggtgagtggcaccactttagcaggtaacgcaccagatagctatgtgcagcggctctatcatcggattccagtgacccaaccattggacgcttttgtctgccaactttcaaccaatgatgggcggcatgacaaggctatggggaaagttacgggtgcacaacagcgccacggctttgacgaaacgacgacgctcggagcgattgaaacaatcgtggcctatgttcaacagcattgggcggtgccaatcgtgttcttcacttgtgtgcgaaaacacgatgcgaattatggtaaattagtgcagcaattgaaagtcttacaaaaaaagtggcacttcacgattattgacctctggcaagatccagtggtcaaagctgaaaatcgcgcccaaccactagcaatggtcgacgacgctcatccaacccgattaggttatcggaatatctggacgccaatttttcggcaacaattaacggacgtgcttcgccagtcggaaccataatcgtcaatcgatttcgcgttttcaaggcttccgtcgatagtctaaagaaataaacataacgaccggatgaacctgtcatgtgataggctcatccggtcgttatgttttagcttacttcaaattttaggttagtctgcgacttcaatcttcccaaccgcaattggtaaggtgatgtgtgcatcgtaggcgccaacttcaccagcaacggtggctggtaaagccaagtcttgtggtacgccgtgaatgtagatgacccgtttgtcgagttccaagtcatcggtaccaaagacttctttgaacttcgcttgcaaatcagctaatggcacatcgatttcgtaggcaaagtggccttgggcgtcagcgactgggtagttatcatttggcacgtccatgtgatgtggggcgttgtcaaatggcaccatcgttgtccctgagactggttcagtttctggcaagtcgacaaatccgtcatgattggcatcctgcgccatcgtggcaatttgggccgccttaccatctggaaaaccgtggaaatgttcccagtgttgcgtatttgcaggtgtatcaaacatttcaatcgccacgtgtaattggtcaccgtcttcaacaaaggtggcagttccatggggtgccgttccaatgccttctgcgtttagtggtacgatgttagcaacgtattttttagtcatgaatgattcctccaattcttcattataagtccattatatgctattctaaacttattaaaattgatatatgtcaagaaagaaaaatttatgcactggcaaattctataattaatccgaacagaaattaaaaagcccaaagcaatcacttaaacctgaaaaaagtggtattattaccttgcatagagaggtatctctgtgtacgtgcgtgtgtgttaactgattgattgagagaagtccctatcccccacggataggggcttttcttatatacccatgtgtgataacatgtaattgcatgaatgaatgctctttcatttatcgagtggtgagtccctgctattaatctggtaggggcttttcttatatgccaaaagtgttacaatatggatgcgtgtataatacgcaacatcttcttctgagtcctcattttctggttaattggggcttttttattgtctgaaaaaatgatactatcaagaagcacgagaatgccctttcgtgtattgagtggtgggtcctcacttgtattctggtgagggcttttcttatacactaaaagtgctatactacctactgtagcatttcacctcaaatactaccttcatcaatttgtgcagagttaaaaaggccctctagttttatcgctagggggtccttttattatctctttataaataataccagatacatacgaatactaccttatgaagctgtcaggggcactcaaagtatctcttgggaattataaagtaacgacaaaaaaggcccctactccgcataatagagggattttttgtgtgcattctgcttcatttaaacggacaagtctacgtctaaaagctgaacgtgtcgtctgagcacgcgtggtgttattcgttaatttggcagttatacaagatgcctatcctatagaactatagatctatagatgtttaaaaatctcgcatattttgttgaacagctctaacactatctattaccaactttttgctttggctcggcatattctgaacatagttttcaacgatttcgttgagaacctcatagtttcgcttattttcaatggtagctatttgctttatggccatatgagtgtctaattgtgcctggacagactttggagtatcttttgctgtcaatctacgttttggcttaattagtacttggtcatttggcatgcttctgtgttgttcttcaaatttttgtggctcaattttctgaggtcgtgtggttttattctttctagtttctccaaaagcacctaatcccattttatcgttagcagtcattttttaacctctaatcaattttaaacgttctaataattcatctacaaccaaatcataaagatggtgaacccttctgtcgtttatgtcatggctagcgttatttgttataccagtgcgatcaaatcgttttaatctagccatttgacgcaccttttgtttaaacatgtttgcattgccgaagcttgtagttgcatcttcgataacgtctaaatctaaatcatttccgttttgttgtaagacaggtaaaacgcctaacaaatcaatgtcgagagagtaatcgtctttgatttgcaataagtgcttaacgtatgtttctgcccctcgcaatgagcgctcttgggtttgcaaaataacaataacgtaatcacttgcaaccaaagcggaatcagtaaatttgtttaattgtgggggaacgtccaatattacaaaatcatatttacttgaaatttttgataatagtttagagaaataatgatcttgtgtgtagtcatcaggaaacgaagagctcagaaatttatcatagttctgtaaatcatcatccgaaggaagtaaatctaagttatcatttacatgaacaattgcattttctaaactacctttttttaaagcaacttcaagcgtttcgctaaaatcaggtttagttccatacacttggctcattgttgtaaacagtaagtctgtagcattagcttgtggatcaagatctactattaaggattttttccctctattggataaggtgtaagcaatcataacagcattagttgttttcccaactccgcctttaaaattaccggttgtaatagttgtggtcaacatagacacatccttttgggaaaaattatagcacaaaaaaataaaattctatagaacattttattcagatctatagaactatagaaatgaatatctatagaactatagttctatagttctatagacctaataaatagcgaatattgccgacatagcagttctatagaactatagatttatagaactatagaaatgaacatctatagatttatagaactatagatttatagaattataaattacgtggttctatagaactatgtaaaaagcgcctttacttattcttgctattgagatattatttagacatcaaatagaacataaaaaaacacccaccaattggagttggtgagcgccacagaagtcatctaagttactgactattatatcatggccggtgcgatttttaaagccctaggggacaagctggggtctaaatctaaggggacacgtttgccagtaaaacattcagtctacagaggccaaaaccgttacagaaactattcattatcaaggcgctggtaatcaaactcctgctgataacaccgctcaagtgacctttacgcgtcaagtctcaactgatgcggttacaggtgaaaagacctatgggtcttggtcagctgatcaaagctttgcggcagtgactagcccagttattaagggttatacgccagatcaagttgaaattggggcacaaactgtgagtggtgacgctagtgatcttgacttcacggtggtttataccaaggatgcgccaacaaaaccagttaatccaagtcaaccaacgacgccagcaaaaccagttaacccaagtcaaccagcgacgccaacaaagccagttaatccaagtcaaccaacgacgccaacaaagccggttaacccaagtcaaccaacgacgccaacaaagccggttcaggctggtcaagcagcggctactaattttgtggatcaacggttgcctcaaactgatgaaactgatcaacaacacatgacgctgagtggcttattactattagccatgagtagtttgttaggactcttcggaatgactaagcggcagcgcaaagaataggatgatattgtatgctaaatcatcggcaaactaagaaccagtttgagagcttaacaaccctgcaagctattcagaatcaggcataccagatgttagtgcaaggactggccaaaactgacttttcaatgtgtgagtggggaatattagtctatcttgaacaacatgggcaagctactgctagtgaattatctgatgcattcacggtcacgcgcacactaattcccaggaatacttggcgattgattcaagataatttaattcaatcacaagtgaatccaaatgatcgacgagttgtttggctatctttgactgttaatggccaagaaagggtccaggaaggtgttcggcaagtgcaagaaaatttaaaaactttcaaccaaagtcacgatttggagaagttgactaaacaagtggaaactttgtcacaacaactggctaagataaattaaaagtttttcaaagtaagtaaagatgccttaatgtaaataaagatcggtccgttaaaacccttgggtttgagcaggccggtcttttgttgaagtgaagaaaatttaaacattaagattattttagtctcgtcacaataatcattttgtatacctaagtaatcaatcaggcactacaagtggctaagcgttcccctgttaaaagggattagataaaaatttttcttgacgttttttatatataatgagtaaagtgtttagatagagtgaaatcaggccataacttaacagttgtggcctcttttttgatgctgtataattaaagggttagaaccgtgtcattacttaatgacataagtaaggagataaaaagatgaaatatggctatgcgcgggtcagtaccactgatcaaaaattagcaaatcaaattgagttactaaaattggcaggagcagaaaaaatctttcaggaaaagtttaccggcacaactactgaacgaccggagtttcaaaaactgttgcgcgctctaaaaacaggtgatactttgattgtcactaagctggatcggtttgcgcggaacacgcgcgaggcattagccattatccaagagttgtttaaagaaaatgtcaaagtcaacattttgaatatgggcttaattgacaatacgccgactggccaattagtctttacaatatttagcgcctttgcgcagtttgaacgcgatatgattgtcacgcgcacacaagaaggtaaattgtatgccaagcaacatgatccgttgtttcgggaagggcgaccgaaaacgtattctgatgaacaaatcagatttgcttatgagctgcgaaaacaaggcatgacctacaagatgattgaacgaaagacggggattagtaaacgcacgcagcagcgacggtttaagttaattgagaaaccaagtgatgcttctaaaatctaagacaggtgaaagatcatgaaaaaggatattttaaattatttcctattttgactgatttttaataatcgtgtgatgtccctaatagtttgatttttaccgtgtatagtaaagtgtttatatggtagatcgcaaatttaatccgaatttttggacaaatttgtcagcataacctgatacggtgtttgccagtcgagtattttaagcggtcaaattgcggataacacagcataaaataatattatttggcagataataaaataattaccaaaaaaacgattgatataatcttggattattatattagtgacctttatcgaaacgtatattataaggtctatcatgaaatgacggaaaaggaacgtcagtttgtgcaagcaatggtaaaggtggggcatcccaaggtgaaagcacaggagatcggtcatcaaatggggcagaagccgggttatatttctgtttatcggcgcaagttaattgatgatcagattattatgccggctagttatggctatgtgcaatttatgttgccattttttgaccggtttgttgaggaacaaatcatgtttgatgaattttaagattctcggtatcttactgctaaatcgacttactaaaagcaatcgtgttaagtcaactactcgtttcgttagccagtgagcattcgtaatggttgtttgtgttatactaaaattgttaattaggagagtggaagcaattccctcaacaacaaagcccctcaatttgctttgttgcagatgggtgctttttgtcttccctaaatttaaggaggatgatcttttattaggagtcagataataagacgattaaggaaaattgcgttaattgtgacattaggtggattacttttcggtgttgatactggggtgatcaatggggcgatcccatatatggcctcaccgcaacaacttgatctaacccctgcggaagagggattagttacttcagggattacgttaggtgcagcggtcggtgccctagctgccggtaaattagcagatcagtatgggcataaacaccttttgattggactagcagtactattcttcgctggaactctttgttgctcaattgcacccaatgcaattttaatgattatttttcgctttttacttggcttagcggttggcggtgcatcggtaattgtgcctgcctacttagctgaaattgcgacggcttcaacacgtggtcgattagttactcaaaatgaactaatgattactggtggtcagctactcgcctttaccgtcaatgccttattaggctcatgctttccgcaggtcggcaatatttggcggtatatgattgcatttgggatgattccgtcaattatgctctttattggtatgtggcgggtaccggaatcgccccgctggctggtcatgaagggcaaacaaaaggcggcattagaagtattgcaacggattcggtccagccatcaacaaagcttgcaggaaattcaaagtgttgatagcgtcatgaaacggaataaagatattaaacgcgtccattttcgtgacttatcccatccctggatgcgcaacttagtactgattgggatcggactaggaattgtgcaacagtttgttggaattaacatcatgatgtattatggtaccagcattttaatgaaggttggttttggccatcgagcagccttgattgctaatattggtaatggattaacctcgtttattgctacggcggtcggaatgcagttgatgtataccgttaaccggcgacggatgttactaaccggaattatcggaactggtagttcaatggcgatgttgacgttggcaattatttggttaaagggaaccatcgtcttaccatacgtagttatttcgatgacgatgtgttttcttgccttcttccagtcttgtgtctcaccgactacctgggtgttactctcagaaatcttcccgcaaagcttacggggccttggcatggggatttcgacattttgtctctggcttgctaactttatggttgggttcaccttcccaattatgctggctcactggggtggtgttggaacgtttgccttctttattacctgcaacattctctcattgttctttgcttatagcttcgttccagaaactcagggaaagaccctcgagcaaattcaaattgaactacggcaacggacaacgattaagcggcatcatcaccaccactcgatgaatagctatggtactaattggcagaataactaaaattagaaaagtacgaaaattttctggaacctgtaatatttagtatccaataagttttcttaaattaaatattatgatctctttaaaaataagaagaacactttgaataattgaaaataccacccgacaaatatctgtatttggcaggtggtactttttaaatataatcgccgtcccttaaaattatgcgcatccgaggaaaaggcaaagcccataccactgcgaataatcttagcggttaatttctcgacattatcgccgaacactccaagataactactactggtcagctgcgttaaacaacccatttctacaaaatcatataaccggtccggttccttctgaaacccatggttccgttccggatgggcaatcactggtgtaatcccacgcgcctgcaactcaaagatcatatcttccgtatattctggaatcccactatgcggtaattccaatagtagatacttgccgccctcatccataaataggatatcgtcgtcatctagtgcccttaggagctctcccgtcaagtgcacctcttgtccgggaaagaccgttaacgggatcttagcagcgtctagtgcttcttgaaaggccgttgtttttctcaatacatctaccttatggttggtatattcgccatccatatggtgcggtgtcagcagaatatgactaatcccttgcgccaccgcgtcgcgtgccataccaagcgccatcggcaagtctttcgcgccgtcatccacacccggtaaaatatgacaatgtaaatcaactaacgtcactttttatcatccgttccgtaatagccgccgtaataactgccaccataataattaccaccgtaataacccactgacttttgggctgtcacacgattcatcactgttcctaaaatgttagcgtgaacagtctccaacagttgcttagctcgacgcactccattcttgtcagcaataccttgtggcacaactaaaaccgttccatcaatttggctcgccaataattgtgcatccgtcaccgtattaaccggtggtgcatcaacaatcaccaaatcaaattcagcggttagttcacttaacaaattttcaattcgtttactacccaataactccgccgggttaggtggaactggtccacttgtgattacgctaaggtccttgaccatggtctcgcgaaccactgccgataagtcagcgtttcctgatagatagttcgtcaatcccatccgattactaacatcgaacgagcgatgaacggctggtcgccgtaagtcagcatcaacgagtacaaccttagtgccctgatccgcccaggtaactgccatattattactgatcgttgattttccttcagaaggtcccgacgatgtgaacagaattgattggagttgcttatcaaccgaggagaattgaatattcgtccgaatggttttgaactgttctgcaatcatcccattgggctctgtatagctaactaaaccgacaccatactttaaacttgtatcatcaagttttttcttgtttcgcttaaaccacgccattgtcgtcacctacacccttcttcggctacgcgcttctactctgccatctgcaccggtaattaagacgtctgaactgtgacgttcacgcgtaatccgctttttaacttccttatcgtcaatttcactaacgatacctaagctggtcaatcccaattcatccgtcaagtaactctcagaagtaaccgttcgatccgtaacctcacgcaataatgccaatccaataccgagaatcagccccacaattaatccgattgccaaattgatggtctttctcggactgaccgccgaatagttcggtgtcgcttttgacacgattgaaacattatgaacgctcatcatcttgacaacttgttttttaaatactttggcggtttcattcgcgattgttgccgctgttttagcatccgttgccttaaccgtaatcgagaatacctgcgagttctgctggttactaattgaaatagcatttttcaatgcactcattgatcccggatatccagggtaaccgctggttgtgttattgactgtctttaagacagttgggctagtaatgatgtccttatatgtactaatcatctgcacgtcggcttgtacttgctgatactgtgccgcctgcatactggccgatagttttcgattaaccaatatttcggttgtcgcctcatattttggcgtcatcacaaaaaaggtaacaaaaatcgacgccaaaaaaactactaaagttgtgatccaaattgctttgatgtgtttacgcaagataccaaaaatttgcatcacactaattgtttgctcagaatccatattttcctccagtacggaccatgaaaaaagtacctcacaatcgttagacttctttgtctaacaattatgaagcacttcaatgcttctaagcttttcgttttttgattgtaaaaaagaacaccgctaaacgttgatttagcagtgttcctcttttattactattatgccccgagcaggattcgaacctgtacttgatctctcaaacagcgacctgaacgctgcgcgtctgccagttccgccatcggggcaactcaacaacaaataatatattacactaagactgcataaaagggaagccctttattcagttttttttacgtctggaaacctcaccgctgtgccatacccgtgaacgactaaaaatttaggtgctacattcatacgtacgacttcggtattaaaccgcacttcgattagcccatccgcttgattctcttgtgcttgcttcattaactgctgcttaacctcttcaaataatccgtcaaacagagaaaattcatctggcttttccgaccgtaacattgtgctagccgtcgccgttaaaattccttgaatggcatgcgttcgattcaaaccacccgtcgtcataaacatttactgccacgccctttcattttttgctgccattgacgccaacaccaaaatagaattgcaccaatcactattccggtggcattggttaagacatcatttacatcaacccatcttcccagaccaagtaaccaatttcccagcgcttgaccggcttctaaggttagccctgtgagtatccccgctaacacccattggggccaacgcaaccgcggccagttccaggctaatagtccgccttgtggcacggtcatgacaatattcagccaaaaggatgtatcaacacttgctggttgtaagggacgtattacccaaatgccaccagcccaccaatgagtcgtaattccaccaaccgcactcccaaagttcagcgtgactggtgtccacgttaaggttgttaataaccaccagcccaaccaccaacaacgtcgatactgtcggttaaaaagcgcgcgcaattaggctaccccaaagtaggctaaccacaatgtaaaataaccatctcactcacttcatccccttgtcctctagtataccgactccgtttatcaggaacaatcccatatttgcaatatatcagtttgttttctaccctcagatgaactattttaaaagtctacttgcacagcaagctaagcggttacacaatactaaaaatggtggttttatcattagataacatttcacattgtgattattaggccgccgtttaaacttgtatctagccactttcttataagttcttcactaaacaggctttaaatttattaaagttctgctatacttatggttatacgattaagtatctaagctattggcaattgtaatattattttggtattgtgcttcgtcacaatcgaacatgattactgtctgttatatcagctggtcattaaattacaatgtccccaagttctcgatatggctgatatgtccggccatctcatcacaatgaatttacctaaacacattaaggaaaaataaccttaatggtttttacttgtaaacaacaattcaattgtatacaatactctgaaagtcatttaaaaggaggtctgtgccatgactaaagtgacaccgattttgctagacgaacaactctgcttctccatctattctgctagcaaaaagtttaatcatttctaccagagtgccttggcaccttttgggttaacctatccgcaatacattgccatgctggttctttgggaggatgcgccattaaccgtccaccaattaggggaccgtttggaacttgatagtggaaccctgaccccgcttctgaaacgattagaaaaacaaggttgggttactcgagtccgaagccaaactgatgaacgccaagtgctaattcacttgaccgacatggcagcggctaagcgtgacgaggtttatacgcgtatcggtcaatgccaaacgttgttgggaatgtccgacaaagaaattgatcaaatgatgactgaactggtcaccgtgaagtcacagttagaccacgtcagccaagagcgcatgattgctaaacaagtcgatcaagattaatattttcttttactactaccattatactaccttttgagtaccttatcaatagataaagccctggcttcaaatcacttgagctggttagcctggttagctctggcgctcatttaaaagcccctattattctatttaagccatttaaatctaacttaagtataaagaggttagtaagtcttaaaaccgcttagaaaggattttgtagccttttaggactagtagtacaaaccactgttatcgttgtcggccgacttttcttcttcggggtgtttggccgcatattctctagccgcttgtttattccaccaaacgccaaataggttttgcatggtgccgtacaggtagttttccacgttcttgatgtgcttctcattgcttcttagggcgttaaagtaacgtctcaaggctttagaagctgtctaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgaactctacgaggtcttctgtgcggtcctatatgtcttgaaaaccggttgccaatggcgtcaagtccccggtgatttcccagaatggcggtcagtttacaactactacaaaatttggtcaactaaagctgagcctacggctgattctttattggaacaagttttaaaaaaattgtcattgctcggcgaacttaccaaggacgttcagctttaacttcctttattatcgttgacgctcagagcgtcaaaaacaccgctactgctgaaaacaaaggttacgacgctggtaagaaaatctcgggaattaagcgccatctggcagttgatatccatggctttccgcaggccattcacatgacgcgagcgaacgtctctgatcgagacggggccagtgcaatgatcgctttacatgccatgcatttacgccaggttcaaaatgtcttagttgatggtggttattcaggcgttaattttcagctcgatgtagccagtaatttaaacgcaaccgtgcaggttgcgaagcgtaatgagttgcatcgattcgaagtcataccccaacgttgggtagtcgaacgctcctttagttggttagagaattgtcggcggctttggaaaaattgtgagcgtcaattaaccaccagtctgcaaatggtcgttttggcgtttttagcactattacttaagagattttagacagcttcttagtcattaaaaatttaagttcttcgtcgtccagtgggattatgacgccaatatctttatgatccttctcaactcggtacttagcatttaagataataccaacgaagcgacgtatctgttgcggggtacggcaccaaaaactaagcagtattcatcatgttacagcacccaagtaaaagctacgaagataaaaacattcatcctcaaaatatgtaacctagaaaaaaagcctccagtgttaaaccgggagccttttttagtataccaatttctaattcacataaggcggcttatcccaagtaacccacattcaccgcggtacttccacattccgttatttttcgattgtgaacttatccaaaaaagaagtggtataggtcgcagattggctttaattggggaaaggcactttgtgaaatttactgggattactcctagaccattcccttaaattcaactgtctcattctttgtattgaccaaaaacctaccgacatttccctgatatttaacggatactttaaaggaatacttgtaatttacccgagtatatcgaatactactaattctcccccgatacccttgcttatgcaaaactctttttacttgatctctctgctgattggtaattcttgcagaactccgatagattgtcttcttaacgatcacatctggattcaatggaacaatgtaatccttacattccaacaattccaccaactttctttttttctttggaatttgacttgacgggttatggttttccattcagtttagagggagtgacgttttgagcgcagaattgttccctggaatcagcgaaacaaaaattacgttaccttcgccggaagaacaagctcagttgggttcattcttcaagcagttagacaacactatcgctcttcatcagcgtaagcttgaaaaactccaggaactcaaaaaagggtatctacaaaagatgttttgctgattcttaatttgatcaaatttaggatcctatgaaactccatgacttaatttttattgttcttggtcaatacttaattcacctgtataatagattacgcaggaagttttaagggcggtggctgtcttttcccttgcgaggtgaggcccatgggaacatggaataatcttcaggaaggtttcacagtcaatgagcgtcttccaaacactctcgttgatgttgctgtttgcaatgtttattttagcgttgctaacatacatcgacaaaaggaacaaataaaaaagccgccccgattataactttggcgagttacgggacgacagtatcgtttagttaactaatgccaccgcctttgaagcggcttgcatgggaagtcttgttagcgcagggcttcctttttctgtctccattatagcatgccctttaaaaactggctaacgttttagactttgatcgggttcagaatctggttgtttaatttctggattctttttagcaaatgcttgcagttgtttttgagttcgcttactgatttcttcgtgtatctcatgtaactggtttttaaattgtgctttttgttgtgaattagtcgtttgctgaacttgttgttgcaagctttgataggacttattaatatcatgggctgataacttttttagatcatgctcaggctctttttgggcttcttgtaagcctaattgtttggttaacccgtcgctaagctcaatcactttgttgctcacttgctggatctcacttaaagcactatggatcacggctgtatctttagcccaggtggccacgtaaccgagtgagtagttgctggtatcaacgccaatattttgcatggcaacatacgcaaccgcttcggcttgggtttcctgataggctcgtggccgatctttaaaggctgattttaagccgtgtagctggctatgcgcatattcgtggtataacgtctttagtttcaaagcattgtcgggctcatcgccaccaatgacgatttcattagtgctgggttgaaaataccccttagccccatttagcgtcgctaaaggcacttcactgactttaaggtcggtttgctggtttaaataatctttgaacgcgttatataagcttgtcacattctgatgatcggccaaattttctttgacaaagtctttagcacttaacactggttcaccgctagtttgtgccacatcaaagacgggtagatagcgataaccgacaatggcgcgctcatcggtggtatcaagatgcttctgctcggctggtgttagcttcttaatgatcggagccgcaatccgaatcgcttttgcgccccggctgacggtgcggttaaaagccgtctgccattgcttaaaaccggcgacttgagtggtttgaggattttgcacataaattaaatcaatgtttctagcgctataatgatgaaatttagccagggtattaagatactgtttaaatcggtcactatcggttaattttaggatttgttgttcggcttgggcgactaattgtgctttccaggctttaacgtcggatttactcggcattgtctacccctcctcatcttcaaaaatatcattcaatataggggctacgttgatttgaatcggggtcgtgccataaagggcaaggtagccatcggctaatttttgccaagccacttgataataagccccattttcagtaatttcttttaaatacttataggcgcctttaattttacatttacattacaagtgcatacccccatcctcatgccggttccggctaaatctggatcatagtgatatttgatagctttgtagcagtatgtaaataaaattattattctgataaaagcaagcaacgattgacaattctgatcgttatttttcgaatcatggcgtttttatattacaatgatcctagaaaaagtaaagttatggaggcgattagatgagtgatttggatcagacaaacagctatcgatacgtcattgttggtggcggagtggttgctggctatgccatcaagggaattcgacaggaagattcagagggtgagatcttaattatttcgcaagaggcggatgtcccatatgaacgaccggcactgagtaaaaaactatggctagatgatgaatttactgaagagaacattcagattggtgctgaaaattatcccaatgtgacttttaagttcaagacaacggttacggctattaatcggcaagataaggtcattacattggccgatagtgagcaaatcaagtatgaacagctattgctagcaactggcggagaacctagacaaatccagggaccttctgatccacatgtgctagtctttagacagtggtcagattatcgcaagttacgtaaatttagtggtccgaacaagcgagttgtgatcattggtggtggatatgttggtacagagctcgcatcgtcactcacccaaaatgagactgaagttacgatgatttttccagaaaaagcgctgggtgagggtaaatttcctgagtctattcggactgagtatgaagccacgttcaaacgcaatggtgtcacactgatgagtggtcagtttgtccaatcatatcaacgccaaggtgaccacttgattctattgacaaaggatggtacggtgatcgcagccgatacgatcattgttgggttaggcgttacgccgcggattagtttagctgaagacagttgtttggatttagctgatggtggtgtgaaagttaatgagtatctcaatactagtgacccagccatctggtctgctggagatattgcctcttatccagatcaaatcttgggtcggcaacggattgagcacgtggaccatgcccgactttctggtgaattagttggccgtaatatggcaggtgctcacatgagctatcagcataccccatacttctattccatgatttttgatatttcctggcaagcaatcggtaatattgatcctaaattgcaattgatttttgatcggcgaacgcatggatcgcttgtctatttcatagataccgataagttagttggtgttttagtttggaatgttaaggtgaatcttgatgatgttcgcgcattgcttgcgaacgctccagctacagatgatctggtgggctccattcgagagaagaaggcttagtatctggatgagatatcggtgaatcattgcgtcatcacgaatgtactttaggacaaaatggccatcattaacgatggctcagtagcaaataaaaactagccttgagtcattttaaagtgcatgaagtgcaacacaaaagttagacaaaagtaaatattattatgccgctaaggtatgttctcgatattcacacggggacataccctttgtttttgatgagattcgtcggtaattgaaccaattaacatattctaaagaaactgcttttaattcggctaagcctttacacggtgggaatccagccaaacattcggtcttataaaggtgaaaaaagctttcaatcggggcattatcatgacaatttcccttgcgggacatactttggataaattcatgttgagaggtaagcccctcaaaactgaacattgtttcaacaagtatgtgtagcctccgtatattccttagaaaggaggtgatccagccgcaggttctcctacggctaccttgttacgacttcaccctaatcatctgtcccaccttagacggctgactcccgaaggttatctcaccggctttgggtgttacaaactctcatggtgtgacgggcggtgtgtacaaggcccgggaacgtattcaccgcggcatgctgatccgcgattactagcgattccaacttcatgtaggcgagttgcagcctacaatccgaactgagaacggctttaagagattagcttagcctcacgacttcgcgactcgttgtaccgtccattgtagcacgtgtgtagcccaggtcataaggggcatgatgatttgacgtcatccccaccttcctccggtttgtcaccggcagtctcaccagagtgcccaactgaatgctggcaactgataataagggttgcgctcgttgcgggacttaacccaacatctcacgacacgagctgacgacaaccatgcaccacctgtcattctgtccccgaagggaacgtcttatctctaagattggcagaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcatggactaccagggtatctaatcctgttcgctacccatgctttcgagcctcagcgtcagttacagactagacagccgccttcgccactggtgttcttccatatatctacgcattccaccgctacacatggagttccactgtcctcttctgcactcaagtctcccagtttccgatgcacttctccggttaagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaacccttgaacagttactctcaaaggtgttcttctttaacaacagagttttacgagccgaaacccttcttcactcacgcggcattgctccatcagactttcgtccattgtggaagattccctactgctgcctcccgtaggagtttgggccgtgtctcagtcccaatgtggccgattaccctctcaggtcggctacgtatcatcgtcttggtgggcctttacctcaccaactaactaatacgccgcgggatcatccagaagtgatagccgaagccacctttcaaacaaaatccatgcggattttgttgttatacggtattagcacctgtttccaagtgttatcccctgcttctgggcagattccccacgtgttactcaccagttcgccactcgcttcattgttgaaatcagtgcaagcacgtcattcaacggaagctcgttcgacttgcatgtattaggcatgccgccagcgttcgtcctgagccaggatcaaactctcatcttatgatgagaacttaagtaagctcatcgattgttattgccaaaatttagagacttatgctccaacctcatgtttcatgaaggcatattgcttcaaatcggccttagagtacagtatgacgtctaataaagtcaaaaccatttccattcataagttcacggtactttccaatatagtttttcagtgacacctcatcaatatccagatcatctcgttgtctacttccagtagctgatattctgccactatctatcagcttagccagactactcgaatcactatcaaatccggacttcgtcagtaaactaattgcctcttgttcagtcattatgaccccttcttcacatattgttcaattcgcctaatcttgttccattagtaaccacaagatcagataagctactaagccaagaaatggtgtcaacgtcaaaataagctaaatgacccgtaacacgcatcccagtcataattcttagtagtaccacctaaaaaccaagcaaagactctattgttacgagaacgtttaatcttgatatgtaaaaaattacctccttgccggaaacctctactcaatgtcattctactccatctatggtaataccctttaaagatatgacctccaaaaaccacatcatttatgatatagagacccgtaacacactacacaacggttcctgattgtacacacctaagttcagtcatacattgggaataaaacacgttgtagtcctttggaacactcatcctaatcaattcaataataacacgtactgaagcgtttcacgtgaaacagttatcatgggtcacggcggcttgtggccgaccgacacccccagcaaatatccattcaccaatagcaaacatcaataacacctattccaagagaaagataatcatacaatcaacctcagtagcaagcgacccaagagcatgaacgtcccttgttcatgctcgcaaggagcagcacagctgggacagcgtgcttagtagacaggccctaggccgtatagaggccaatcaaaatatcaataacacagcaagaaaaaaccggcggagcccctcaaaggccccccgatttttgttcacaaacataatcaaatcaacaagaccccgaaaaaccgcatacggacccacactaattcctctcgcccactagtatcactgattcaacttatttgattttctattgatttttaatatcagttctcgctccatttttcccgtctcatcattcctagatacaacgtaaattggaaaattggtaacattatttttctcacatttttgagatagtattttaattatcttcactttatttttatcgtcagttttaggaccaaaagtcactgatttcaattctgaaaaatcataaaaaaatgtcctacttttaacggaagaatatccatcaataaaatctgaaataattagtcttgactccctttgcgtactccatgaatagtcttttgtcaacacagtttgttcagtccactgccaatagtgactctttaagtttgcttctatgttatatatatcattttgttatgtctcaaagtaacttagaaaaacaagaagctaaattaaaagcccttaatcaaaaaattaaggacgaaaaaaataagattgaacaacggctaggtaaacaaatcatcagtcaagccaatttagattatgctaatttatctaatgaaaatatcaagtccttatccaaaaaagtatccgagtttttaaaggaaaagtccgtagatcattggtcataggagatggggaattccatgcctaatcaatatgaaaaactagtcgagcagcaagcgcgtttaaaacaaaaaattgagcgggaagattttaaattacggcaatctaaatactatgaaaatcggcaagcccgcaaagcccgttctcgccgattaattcaaaaaggggctttattagaaaagtactttcaagctaataacctctcggtcgaacaaaccgaagaacttttaaaaacatttgctgactatgttaacgcccataaaccggataaattaaaaaacgatcaacctaataactaggccgatcgtttttattttcaggattgttttttggcttaatttctggattgtgtttagcaaagtcttttaactgtttttgaattctttgtgtaagctctgctttactttctttgtgcttccttttacttgatcgctgttgaattatcttttgacccttacctcttctttttgattttaggtcaagcataaaatctgaaattttattttgatctagcttacttaaatgaccgatttctttaaagtttaaaccggctttgggaaagcgataaatattaccaagatcgacccaggaaggtttctccaactcagcggattgccaatcttgaatcggataatattgttgcttgatataagccgacttcttttcatactgactagtaattttaaaagcctcgaccttctgttctgatacccgacgaattaaaactggccgagacttgccaccgttagtttctacaaaactaacgtataggctgactaagtcattagtcctcatctggatcgttgagccaatcagcgacctctttagcgtctttgaactcggtgactggtgtcccttcggtcgcctttaaaaagcgtaaattagctctttcttcttcgcttaaagacacattaaaaggtaaagcaccattagcaacaatccgcttgtaaaacatgttaatggccgtggttggatttaagcccaattcgcttaaaactgcttcggtatcatcggccaaatctttatcaatcttgacttggacccgtttcttttccttaactgccatgattgtctcatctcctttgcttatctgctgtataggtgatcgttgtatctgtaccattatcagaaggtattggcggaatatagcccttagtacggtcatcgggatcaactggcaccaaaggagtccccatatggtcttcaggtgtatagccaggaagaaaatcaataaccgggtaatcaggcaccgatgaatcagcaatcttagtagggtcactaggatcattgggataaataattgatgttgtcgagccattagggttagagacgacccagttgccgagcttgctgtaaacatacttaatatcagaggtttgtggaatatatggatttacaattccgtatgtcgcagaacctagtggatacattatcgcagaacctgagggctttatacctgtccatgttttgaggacttttccattttgagcaattgaagcagacattgttccatctgaaccagtctgagtgtaagtaataactactccattatgaaagtttttaacataactagcaccaatctctccgtatggtgacataacgccatttgaattagaaggtgcagtagcatagtaaccatttataacatttacgtcgctggtcgtataattttggccaactaaccctttttgtgtataagcaacaaccggattaccattactgtcggtgatttgcttgccatctttatcaacgtaataggttgtttgtgtgatcaatttgggtacaaaataagaaagtgtattgtagtaggtactatcaaatttactagcagtatatttagtaacaaaactattgcttgaacttcgaaccatttcaaaataagcatcattatagtaggtagtgctatcagatacagcagatgttacctgagtattttgatttaaagtgtattgttttaaaacttgatttgatgccgataattccgttacataaacaattccatcgcccgttcgattagttgaaaaaacaatctggtttccaccagattttgcttgcaaccattcataactataatgagatttatctggatcaatccacatcccagatggataatctggatcactaactgagaaacccgtattggtaactgaacctgccaatacccttctaccatagttttgagcaaacttagttgtaactattgcatcatttttagaaacattagtggctatctgcgctacaatctggtttccacccgcactgattgcatcagccttcactgcactactacttgcactggtcgtttcagccttcgccagtttccagtcttaaaagcagcccaaaaaatgtcgagttttgtgcggcagtggattcaaaaacgagtggcgggggtcgatgtcggctgcaataactttggaatttttcgaattccccggcaagacaatctagtcttttttgatgcacatatgttggtccaggtgagcgctctgatgaagtggtcacaatattatgctgcccaagttccggttacgaagccggataaacgacaggtgatttctctagccccagatgaaggtcggcaggttgaccaagcttggtttaaagccttattgaaagtgacaacagtcaaatcaggtcaaggtttagcccgtcacaacacggttttgacgttagctttagcgatgtatcagtctaaaatttctcagcagcgtgcgagagacgtgcttgacgtctttaattcaaatttacatgacccattggtcgatcgcgaagttgtacagtgcgtcagagacgcctattcaggtaactatcggggggccgcactgagttatgttcaaggactattggatcaatgggtgcctaatttttcaggtaaagtcgttgttgggattggctggcataaatttgctaagccacgtgccgaacgacaatacagccatgctaatgaatggcgtaacgatgtgattgcgttgattaatcgaatgggtggttctgctgcttcggttgccatgtcaacgcgtcaaattcaggatgagttagggatttctcctgcgagtttgaatcgggttatgaagcaattacaagcaacttcgcaattgaagcgggtgcagcgtggtaaccagccgactttattgacgacggtgaccatgttatttaagtcggctatggtgagccgtcaggctcaaagtcaagcgtggacggggtatttaaccaccctagttcctactgtaggaccaaatgggtatgagccaacagttggcactttaactgagatgcaagcggtgagtggtgattcagcgccaccgtgggtaatggagacgaggagaagaacggggtgaaaagtgctgctatcaattgccataggtatatatctagaataggcttgttgctgtgtgagggtattgctacttaggggtcttgtgtggggactcggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatagcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaattttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaacccggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcacgcattttgtttaatagaaccgtccggattaaaaatatcggcctgttttaagcgcatgacatcactgactcgcagcagtgtcgctttaccaacttgaaaaatcgtatagttacgtcggccagctataaagttattgagtaacgtatcttgaatctctttaagaacgtttgaatctttgatgggtaagacaacttgttgcataagctgttagttcctttactttaaaattaatttagttgcagaaaacctaaaaatcgaatattataatgtagtacgatggtaaacttaaaggaggcggattagaatgagtaatactattattaaaaacaagacaatttcaactcgtgtaacacctgacattagtgaacgggctaaagctaatctagcaaaacaagggctaaccgtttctgagtatatacgcttatcgttagttaaagcggccaataatgaagttcgattagtcagctttttagattctccggaagccttagccgctaaaaaagaagcagaaacagggcaggtcaaaaaaattggttcattgactgactttgaagattggatcgataagttagatgcaaattaaacagaccaaatcttttgaacgtgaattaaaaaaactagtcaaaaaacatttcccaataactgtcttgaagccttgtttagaagcaattgttgaacaagatgtacttgttttgaaacagattaaagatcatgcattaaaaggaaattggcgtggctatcgtgaatttcaccctgccagatatggaaactatggtaaaaattatgacaactggattgttatttatcagctagatcatgatgaattgattttgttattggttgcaactggctcccatgaaatcttgaatcaatagctatagtttaggggcacttataaaaaaataaattaaaataattttggaggattagctcagttgggagagcgtctgccttacaagcagagggtcacaggttcgagccctgtatcctccatttgagccgttagctcagttggtagagcatctgacttttaatcagagggtcgacagttcgagactgtcacggctcattcacctacgggtgagtgacaattggatattgaacatgatactgactatgccgacttagctcagttggtagagcacctgtcttgtaaacagggggtcggaagttcgaatcttctagtcggcatttatgcggaagtagttcagtggtagaacatcaccttgccatggtgggggtcgcgggttcgaatcccgtcttccgcttataccgagaggtattaagcatgatatattttgcacccatagcgcaactggatagagtgtctgactacgaatcagaaggttgtaggttcgactcctactgggtgcatttgaacgggaagtagctcagcttggtagagcacctggtttgggaccagggggtcgcaggttcgaatcctgtcttcccgattaaataaatattttatttaacatttcgcggtgtagctcagctggctagagcgttcggttcatacccgagaggtcgagggttcgatcccccccgccgcgatttggacttggactggacctttagctcagttggttagagcagacggctcataaccgtccggtcgtaggttcgagtcctacaaggtccattattcaaaagggcacttgtattttatttttatggaggattacccaagtctggctgaagggaacggtcttgaaaaccgtcaggtgggtaaaaccacgcgagagttcgaatctctcatcctcctttttttaaccaaaagcgggtttccaaaacaaagaaaaatttggttggttgattgggataaaaaggaaaaaattaatgaatggcgaaaaaattgggcgttgagtgttaatcagttcttagcacaaaaaaatattccggatcggattagtgaaaaatcgtttgtcgatcaagggattcaagagacacctacccaacacgaaggcattaacagccaaagaaaaaatcgaaaaacatttaatcaacaagttagagcgcaaagaaacgctcaagctaaatatcataatcttgacgaaaagataagaaatcatgaacattttgacgcgttaactgacgagctatccttctctgaaaaacacacaattagtcatctaagtcagcaattgaaaacctatgtcgatttagaacatttagatgataaacagcgcatgctatttaattggaagaacagcttattaatcaaacacgcagttggtgaagatgtaaccaaacaactgctgactattgaccagcaaacgacatcactagcacaagctaatcagttgttaaataaagtggtggaacgagcaacgaaaaagctttatccggaacttaattttgaacagacaaccgccgccgaacgacgggaactgattaaagaaactaatagcgaacaaacaattttcaaaggtagcgaattagcagaacggttagcggatattcgaaacgacttactgacccagcaattattgacgtttaccaagcggccgtataccagctggcagttagttaatcagcaggcccaaacaattgagaagcaattaaccacggtactagccaaacatggtcaccagttagacgatttgaagcctgcttcaaatcgtctaactggtgaccatgtttggctagtaccgtggttaattgcttctcaattgtttgggcctgctgattaactaactgccagctggtatatggccgcttggtaaacgtcaataattgctgggttaataagtcgtttcgaatatccgctaaccgttctgccaattcgctacctttaaaaatcgtttgttcgctattagtctctttaattagttcccgtcgttcagctgcagttgtctgttcaaaatcaagctctggataaagcttttttgttgctcgttccaccactttatttaacaactgattagcttgtgctagtgatatcgtttgctggccaatggtcaacagttgtttagttacatcttcaccaaccgcatgcttaattaataagctgtttttccaattaaacagcatgcgctgtttatcgcctaaatgctctaaatcgacataggttttcagttgttgacttaggtggctaatcgtgtgcttttcggaaaatgataactcgtcagttaatgcatcaaaatgttcatgatttcgaatcttttcgtcaagattataatacttagcttgagtgcttctttgtgctctaacttgttgattaaatgcttttcggttttgtcgttgactgttaatcccttcgtgttgggtaggtgtctcttgaattccttgatcaataaatgatttttcactgatccgatcgggaatgtttttttgtgctaaagactgattaacacttgttgcccaattttttcgccactcattaattttttcttttttatcccaatcgactaaccaaatttttctttgttttgggaacccacttttagttagccaattaagacatttaagtggccgtgaattcagataccaattgatttgaaccagttggtaatcacttagttcttcaatggcttgtcccttgggaataaaccgtcgcaaaactcggttacggttctcattactaccgcgttcatgtggtgaataagcatgggcaaaataaacctgagtacctgttagctgttcaattgtctggtagttagcgaactctttaccatgatccacagtaagcgtcttgagcttgtcttgaagttgactagctagttcaagtacggcttgagtcatgaactgactgtcgcgaccatggagccgtttaacaattgtcaggcgacttttacgctccacaaaagtagccacagcttgacctttacgtttaccagaaagtacggtatcagcttcaaagtggccgaattcctggcgagtttcgactttatgaggacgcttctcaattgagcggccgtgactgaacgtaccacgcttttctttagcacgatgacgacgaattccatgatcaggcaaatcgggtagctgtacatcaagccatccttgatcaatccagttatagaccgtcttgtaggcaatccccaccacatgggcaacttgttcaggggaccacttctggacttgaatcttttcctcaatcaagtgtttaaggtttttagtaagcgaagactttcgcccccgttgactaacctttcgttcaaagtcagtttgcgctagctcagcctggtactcaccatttagtcggtgaagttcgttaaagatggtggtcttactaaagtctaagtagttagcgatgtatcgcaaggaacgtccttcattatgaagcgtaaatacaatcttgaaaataaaaacgtgtacgatgaatcgaaagctactaagcatgcaatcgaagaatggaacaacaaacactttcagaactatgttgagcacagttgtttgcattccgattaataaatgataccactctaacatgattcccatcattttctcaaaatagttttgctgctcataaaaaacggtttttaatttatctgacatataagtctcatctttttatattaaactttttgcgatatctgataaaggtcgtccgtttaatacctgtatttcgggacacatcaatgtcactcatgccagctcgataaagcttaaaagcatgttgcaagcggggatcatctttggcatattggggtttgcgcccatgatatttaccctgctgcttagctaaggcaatcccttgctgctgccgctcaatgattcgcttacgttcactttcggcctgatacttatagagttcaataatcaagttggtcatcagttgacgtaaatttgggtcagcaatcccggtcatggacggcaaatttaacacatctagggtggcacccttattttgaatggagttcatgatcttagtcaaatcatggttgtttctgcctaagcgatctaattcagtgaccattacaatatcaccctcacgaatataggccagcattttttgcagttctggccgattagtgttagccccacttaatttatccgtaaataatttatcaacgtcttttaaagccgctaactgtcgatctaaatgttgctccttggaactcacacgcgcataaccgattttagccatttccaattctccttttggacagttctaatgaacacgtttgatgttgccgctgctttttcgtcattgcccactcggtctcttttaagccacgtagctgctgctttctgagatagtccgtgttcttcgcatataaaatggttattaaggcttcgtccaaaatattagtcaggtagtttttcgggctagttgggtaataattaagggcctgatagtccttaatttggtcttgcttatattgatcaaaccgtgttgtctgttgtttcaaacgggcttgcaccatttcaatttgtttgtgatccaacttaggatcttggccacattcgccgataaacagttgccgggtgccatcatgttttaagacccgttgcagtcgatgatcctgaatatcttttaattccattttacctaacaggtaatttaaaccggcttggtgttgctgactagtaaagactaccggtggctgctgttgtaattgactaagatcatcggcgcttaatggctttaattctgggtcatagtaaaccacagcggtatagatttgctccttatcaatcgtctctagcttatccaggtcactgcccggaaaagcagtcgttagaatgctgttgtattgagtttgcactacggctttaacttcccgcatgacccgtaaatttttcaccgctttagaaatgaattcgagttcgttaggttgataagcggctagcatgccccgatcagtaagaagcacttgctgaactccgaaaggggtttggaaataatgcctaaaactattagagaacttgctgatgaattgggcgtttcaaagcaggctatatggcaaaagataaaaagagatgcgtcaatcgatttacgtcaatttacatcaacaaaaggcaatactgtttacgttgatgttgatgggcaaaaagctattaaagcaatgttctcaaacgattcgtcaacaagataccgtcaacaaaaagatgatgttgacgacaacaaaaaagatgcggttgatggacaagatgaagtgaaattccttcgaaatttagtatcagaatttcaatctgaaaagaaagagttacataagttactagatcagcaacaaagattggccttacaggacaaacaactgctcgaagaatacaaggcagaaattaaggacttgaaagccttaacgatggcaccgcatgataatagtgaaaaagaagtgacgtcagacaaacaaccggaacctgaaaatagcaccccggagtcacaacctaaacctaaaaagtggtggcgttttggtaaatagttacaactaaaaaagaaaagaagactagttaaatagcggaagataaatttgaacaatctgtagctgccaagctaaagggtgagggctgggactgtcccacagattattctggtgctgagatttaaaccagaccagataagttgttcttgggtcagtctgtttcgtaaatgtgaaaaccattgtggttgacttttctcaagagccccatagttcataagatacaggcgccaatacggctttagcacccggtattcgggggtatctgggtgataccttttcattaattggacacgagtttggttcaaggctcgtaaggtcatttgaactaaatgaaagttgtcgacgattaatttggcgttaggaaacagataacgaataacagtttggtattgtgcgttgagatccattacaacctgggtaacctgttcacgattttttagcgaataatggtttaggaaaaattgtttaatttcattagtctgtcgaccaggtaaaatagtgataatatcatgcttttgtccatcaattgtaatgaagctcatttggttagaagttgatcgaaattcatcaatgcataaggtttgcggaagaccgtcatacgctggcatggtctgcttactgagcgctaaaatgcggcgactaacgaagttagttgaaacattatactgatctgcaatacttttcatcgttcgatcttcaattaaagacttgtcgatggcgtgtcgcgtattttcagagatttgatgttgtcttctaacgactggtgtttgggcgatacttgtttgtgctattttaaagttgtaaagtaaatagcacagtgccggttgatttatttatcagggcacaaaaaaagagagagcgtaaaatatcttgtgtaaatgcataaaagatttctgaattgtatagaaatagggaatgccttcccttatgatatttagtagctacagaaaacatcacaggaggcattccccatgaatgaacttaccacagaaattatcgctgcactagcccaaaagcaatgagaagcacatcaagaatgttgagaactacttatacggcaccatgcaaaacctatttggcgtttggtggaataaacaagcggctagagaatatgcggccaaacaccccgaagaagaaaagtcggccgacaacgataacagtgggttgtactactagtcctaaaaggctgcaaaatcctttctaaacggttttaagacttactaacctctttatgcttaagctagatttaaatggcttaaacagaagaataggggcttttaaatgagtgccagagctacccagctcaaaaattcagcctttagatcaacgccaagctcaagtgatttgaggccagggctttatctattgataaggtactcaaaaggtagtataatggtagtagcaaaagacggttgacgccagtgaagccaacggatccacagacacctggaacgccaatcaatccagacgaaccagatggaccaaaatggccaactagcaccaactatgataagacggtcaacgagacgattagctatgttgatcagaatggacaggtagtggccaagcaacacactgattctgtcaacttcacacgaacagtcgttgtcgataacgttactggtgaagttattacaagtggtgctgggacaacagcctggacagcgacaaatggtgatacgacctttgatgccgttgttagcccagtggtgccgggatctgtagctgataaagcgcagacagctgccgtaactgacctgaatgccgattcagcagatgttaatgcgaccgtgacatacacgaaagtcggatcattggtaccaagctcaagtgatgggaacttccctgaaacaccaacagtagtctatccaaatgacccaagtgatgcgacaaaggttacaccagccggtgtaccgacggtaccaggttatacagcacatgatccagaaggtcatgttttgacacccggtagcagttatcagccaagtgatccaacgaaagatacaacgatcacctatacagcagataagcaaaacaagtatcgcccaaacaccagtcgttagaagacaacatcaaatctctgaaaatacgcgacatgctatcgacaagactttaattgaagatcgaacgatgagaagtattgcagatcagtataatgtttcgactaacttcgttagtcgccgcattttagcgctcggtaagcagaccatgccagcgtatgacggtcttccgcaaaccttatgcattgatgaatttcgatcaacttctaaccaaatgagcttcattacaattgatggacaaaagcatgatattatcaccattttacctggccgacagactaatgaaattaaacaatttttcctaaaccattattcactaaaaaatcgtgaacaggttacccaggttgtaatggatctcaatgcacaataccaaacttttattcattatctatttcctaacgccaagttaatcgtcgacaactttcacttagttcaaatgaccttacgagccttgaaccaaactcgtgtccagttaatgaaaaagtatcacctttgatccgtttttatcctataaagtcgggtacagtaaattacctagtgaaaaggaaatttctcctaacaataaggcgaccaatggttactggaccgcttggttcaccgataatacgatgggtaatgaatggaccaaattaaccttaacgacggggcttaatcctggggtcaaagatccttatgtgatggcttatcataagggcagctatgttaaagttgcacgtattgtgcctcgcacctacattaatcagacttatgttagcaacttagcagcattagacgccttgttaaaccataagggaaatacagcgactaataatcatgacctcaaaaaatttaagacacagatccatgtatctgacacggtccagcagttaggtgactgaatagagaaccaccaagttacaatcctgcaagtagtttcagggtctataatctccaaataacccctcaaaaacgttgttaaaataacccccaatatctataatgtagatattgggggttatcatgcttgttcgcccaaggatggtaatcttagtttctaaatggtaaatggctcggtagctcagtcggtagagcaatggattgaagctccatgtgtcggcggttcgattccgtcccgcgccattagctcgatataatgcgggtatagtttagtggtaaaaccacagccttccaagctgttgtcgcgagttcgattctcgttacccgctttatatgggcctatagctcagctggtttagagcgcacgcctgataagcgtgaggtcgatggttcgagtccatttaggcccattatggagaagtactcaagtggctgaagaggcgcccctgctaagggtgtaggtcgcgaaagcggcgcgagagttcgaatctctccttctccgttgatatgacccgttggtcaagtggtttaagacaccgccctttcacggcggtaacatgggttcgaatcccgtacgggtcattgtgtcaatttaaaatattagtgctggaaaaggacgaagtgcgattgccagtgcggcttatcgaagtggtgaaaaattatttgatgataaagaaggtcgccgatatttctatgcccgatcggtaattccagaaagctttattttaacccccaaaaatgcaccagaatgggccagtaatcgagaacaattatggaatgaagttgaaaagaacgatcgtaaatcaaactcacggtatgcaaaagaatttaacgtggctttaccggtagaattaagtgaatccgaacagaaagaattactgacaaaatatgtgcaagaaaattttgtcgatcaaggtatggtagctgacgtagcaattcatcgcgatcacccagacaatccgcatgcacatgtgatgttaaccaatcgcccatttaaccccgatggtagttggggattaaaagcaaagacgcagtacattaaagatgaaaatggcaagcaacttatagttatagaccctaaaaccacttgtaggattgtaactaggtggttctctattcagttactaactgttggacagtgtcagatatgtggatttgggtcttatacttcttaaggtcatgattgttagtcgctgtatttcccttatgatttaacaaagcatctagcgctgctaggttgctaacataagtctgattaatgtaggtgcgaggaacgatacgcgcaactttaacataactgcccttatgataagccatcacataaggatctttgaccccaggattaagccccgttgttaaggttagtttggtccattcattccccatcgtattatcagtgaaccaagcggtccagtaaccattggttgccttattgttaggcgaaatttccttttcactaggtaatttagtgtacccgactttataggataaaaacggatcaaatagaagtcgccgttggcgacaactaaaaatccaaataaaactaaccaaaatcaatttgatctaacatactttcggtacttgcttggtctaagcctaaataagctagagtcatggcttcacttgaatgatttaataagtgcatgactaagccaatattgtaattggattgcgtataaacgcgataagccccagttttgcgcatagtgtgggtaccaaggtaattaattcctaatagatcgccaaccttactcataattttgtagaactgtttttcagtaatatggcgttctgggcgttgaattgacggaaagagccattcagaatccagcttatgatcaagcagccattgacggtacaataagagctctgtttgaacaggcttaaggtacaaggtattaggtttaccagtttttcggtcatgaataaacgaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagattgattatatttggatcgttggtcaacgttacgccgttggcgtacgccatgttcaggtagatcattcaaggagaaatcaattctcccctgatttagccaattataaatagatttagtagctagtttaaattcgtgagcaatcattcctggtgaccagcttagacgtaaatggttgagaattttttgctttaagcgacttcaataagtctggctataccacaacaaggtcatctgtacggctgggtggtgaatggtgagcgcgaccattaacggcgcgggtggtaaaacgaagcttcggcttggtgccactgattagttggtgatcgaacaaacataaatacgtattaccaacgcctgctagggcgttttttagtaggctaaaccgaaaacgtaggtttataatgagtggtggtagcaataccgcaattgtacagacaagcgacgggcgttaacgaccgacgaactaaggggaaacttttagtagtagaattgtactctggttcagttattccaaatacttaatgggggacgcctttaataaactagagcaacaagctggtaaagatgttgcgactaggtttaatgatgacgctagagcaatcctcaatggggaggagattgtgaagccggaatttactaggatttcggtgctcaagaagaaaaagaggttttggttattctaatggatcatggagaagatcatgctgagtcgattgcgattgacttggatcatgaacggcatcgttatatgtatcgtgtcgtaaaacgggtgtttgattttgtagcaagtttgctgggcctgattttattatcaccggtatttctgtaaaaataccggtaagagtaacactaggccaaaaaaactagctacaaagtcaaaaatccgctttaccgaccgatatacatagcgatgtcgttcgtaattcaaatcaatcacaatatttcttgtatgctcttctccataatccattagaataaccaaaacctctttttcttcttgagcaccgaaatcctagtaaattccggtttcacaatctcctccccattgaggattgctctagcgtcatcattaaacctagtcgcaacatctttaccagcttgctgctctagtttattaaaggcgtcccccattaaaaatccctccaatcatattagaaataatcaccgaaactatatcatataggaaacgttaattcaaagtataaaatttgaaatagcgaagcggaaggcatacactagattaaagttaagataatcagaagaccgagtgaaacgaggtcaatgcgcacttacacatagaatgaattctatgttgtgctaacccccaaaaacctgtattagaagtcgccgatggcgacaacaaagtcaagcccatagaatcaaagtaaagaggtgactaacatggcaatatttcatattagttttcaaaggtagtgtcagctacgttgatgatacgactggaaaaactttaaagacggactcaatctcaggaacaacgggttcaaaatccagctatagtaccagcggtagcattgccgattataagaaacaagggtatgagttggtcaccgatggctatccagcagatttgacgttcgacaatgatgacacaactgatcagaatttcacggttcacttgaagcatcccttgcagcgaaaacgttgtttgcggagaatcaaaataacggtgcgctcgctaacgtttggtagcctaacatatactgttttatgaccattacaaacgacctgtcgttgagcacaatacggacaaacattgagtttgtaggaaagagttccataaactctaagcgcatcgcgcttagtatcactaacacgcaaatgagttatatttttatctttaaattccttggcactctcgtgccaatggagaatagcgggatcgaaccgctgaccccctgcttgcaaagcaggtgctctcccatctgagctaattccccataatgatgaccttgcggtcaatgggcataaatggactcgaaccatcgacctcacgcttatcaggcgtgcgctctaaaccagctgagctatacgcccaaaatcatttagtttcactcgaaaaacttctatttaacgaggagattgcaatgaaaaaagataaagaaccctctttggctacccagatagatcatgatgttaagcttaaaagtcgttatcgtcgttggacttttggtttaggtggcttgatcgtactagcactggttagtattggtattttatgtttgggatattataaaggtattgggacgattgatcgctcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttctattatcgcgggatggagcagtctggtagctcgtcgggctcataacccgaaggtcgcaggttcaaaccctgctcccgcaatttttggtccgttggtctagttggtttaggacgcctgcctgtcacgcaggagatcacgagttcgagtctcgtacggaccgtggtgaagtaagtattttcaaactcatgactgagatttaaaccagaccagataagttgttcttgagtcagtctgtttcgtaaatgtgaaaaccattgtggttgacttttctcaagagcttcatagttcataaggtacaggcgccaatacgattttagcaccccgcttgatgaggttgagaacgttagtcctcaactctttacgactatcaaaacgtttattaaaaatagaaagctcatccaaaatatgaccaatagtacactttccaacggtcccattgaaggcgtcaatcgaaagattaaacagattaagcggacaagggctctttgtcaacgggtgttgatggaggatttatgtggaacttcgttcacttgcgaacggggttccttttctttactctgattttaaattcaatctgaatacgaaaaacaaagtttttccaattccggtatccgtatgcaattccgattaaagcgttcattactaccacgttcagctggcgtataagcatggcagtaataggtcttaataccatattgtgattcaagtgatactagcccactaaactcagtgccacggtccacagtaaagctgtgcaccgggtagattgtaaaattaatccgaacgctgttcggacaaaaaagatcagcttcctttaaaatggtgtttaccacaaacccatcttttaggagctgatcttttgtctagtataacctattctggtgagcgccacaaaaaagtcatcattgtttaatgactattatatcatggccggtgcgatttttaaagccctaggggacaagctggggtctaaatccaaggggacacgtttgccagggcgaaggctgaaacgaccagtgcaagtaatagcagtgcagcgaaggctgaaacgaccagtgcaagtagtagcagtgcagcgaaggctgaaatgaccagtgcaagtaatagcagtgcgctttcaattggttttcgtcgacttgattgtagcacagggcagtatgccctttttagtttgttttacaaaaaaggcgtcgatggattttatccatcaacaccaaatatcatagagcctagacaaaagatcagctcctaaaagatgggtttgtggtaaacaccattttaaaggaagctgattttttttgtccgaacagcgttcggattaattttacaatctactagacaaaagatcagctcctaaaagatgggtttgtggtaaacaccattttaaaggaagctgatcttttttgtccgaacagcgttcggattaattttacaatctac
